United States Patent 6,900,016 (POLYMORPHISMS IN KNOWN GENES ASSOCIATED WITH INFLAMMATORY AUTOIMMUNE DISEASE, METHODS OF DETECTION AND USES THEREOF) - sequence listing, part 4

SEQ ID NO: 765 - DNA, 129554 bp, Human
  misc_feature (1)...(129554): n = A,T,C or G
caccatcatcccaccttatcttttcatttatttatttatttattttttttgtaactccatcctgttactgccttagtcctctgaaaacctccagctagttttcatacgaatgcgtttgaagtcttctccattttgcacttgtgtagaatttttttaaaaattcaagaacaaaactttttattaactgaaagcctattatgtattaagtatcatgctgagttttgtggatataggggctaggacaaagtatcaacagagtaaaagtgtaagctccacgaggaaataactgggtctgtcttgttcattaatgaatccccattcctttttctttttgtttaattaattacttttatttttatttcaatagtttttggggtacaagtggtttttggttatatagatgaattatagtggtgaagtctgatattttagccacccaagtagtgatgaatccctatttcttgagatgatgtctgcacacggttatatgcttaccatttgttggatgactgagtgaataagatagtttaaaatggagattttttcctataagtcaaaaagtattttcctagttcatttattttataaattcagatattttgtacaaggctgtcacaatctaactcacttttttttttttttttttttagacagagtctcgttctgttgcccagcctggagtgcagtagcgtgatctcggctcactgcaacttccgcctcccgggttcaagcaattctcatgcctcagcctgccgagtagcttgaattacaggcgcgtgccaccaggcccgactaatttttgtatttttagtagagacgggggtttctccatgttggccaggctcgtctcgaactcctgacctcaggtgatccacccgccttagcctcccacagtgctgggattacaagcgtcagtcaccgcgcctggccctaaatcacttttgttgttgttgttgttgttatactgttctttttcattgctaagtaatattccactgtgctacatatggaatatgctacaatttgttcatacaaccacctgctgaggggcatttgggtgtgtgtcagttttttaggctgtataaccaattatcacaaacatagcagcttaaaacaacctaaatcacttttaaccaaaccctagagttttctcctcctaaggtagacccaatttccaaaataaacccatattgtaccttttcaggccaaagaaaatatttatatgctttatttgctggaggccattatattccaccgttgaaggacttttgttaagtacctgtttgacccttagtgcagggcttacatcccacagttagcaatagcaagttatgtgctttttgagctctaaacactgagaatttcttgaaccgagttctattcggccctgacttgctgtgggggagaaaagattcctcgggagaagtgtgggtggcgatggcttaggaggaccttgaaattccgcatttgtctgtgagctgctgccaggtgcccattggcccagctactctgggtcgcaaacctgcagatgccagatacatgaaatttggggacgttcagcttcctaaaaccacagttaggcaggtcctaggacccgtgattcttgccacagtttttcttagtatttgggctacaagtgaggcattggccgccatcttgatatcaaatgccaggcaagccgctactggcgtcgctcggtaaccacggagacacccgtgcccctcccgtttctcatccttagaggctgtaaactacaattcccatcagccgatttcctctgcgtaatggcaacttatctaaatctggcttgtgggcaaccgcaacgctgccgcagtgaactgtgggagttgcggttcacggcgtagcctcagtttttttcctgggggaagttccagaactacaaatcccgtgagccagtgggctttcgcctgcgcacggagaagccgattctccttggcccctcagcctgcgcctgagaggtaagagagggcggggggaaggaagaggaggcgggatccgggcgctgcgttggctgcggcctggcaccaaaggggcggccccggcggagagcggacccagtggcctcggcgattatggacccggccgaggcggtgctgcaagagaaggcactcaagtttatggtgaggagacggtggaggccggggaacggtggaggcgctggcgttggcggcgtcgctggcctgggccgcccgcccactgcgggaccgggcagcgggaccctgggccgaggctggcggcggagcggctggagggatgggatgggagctccagaaaggaggctgggggttgcggagcggacccaggggtgggggcagcggctccgccatcttgtggatgagaggccaagtgacagcgggagcttaatcgaggagggggctccaggcggcgcgcggggccctggagggaaaggggcgtggggactgttactgaaaagcggaggaagctctctggagaaacgccgtgaggccgctggcggggccttcctggtgtcagggttaccggtaaggcccgggagaggaggtgcattcacgactggggaagggagcgcgggatagagtgaagacagatacggtgggtagaggggaacgggcagggctggatgcagatggatttaagggtggaggagggaacgctagggctggtgagaggcttatagttttgtagaatgaggagggaggatagcctttgccttgagggtggaatcccagcttggccaaactactgttgacaaactctggaagggaagaggcctcactaaagaagataaggactgggaatgaggacctagggctataatgacagtccctgggaggggaaaagggtgttgactgtaagctagaattacaaatgtcagggaggggtacataacgctactttgaaaggagaagctaaatactgtaataaggacaaggtgatgaaaagtaagagcagattgtcagggaaacatgggtacaggagattggggcaaaatgagtatctaatagggtaagcaaaacaaaatttaaaggtaaattgtgggacggtaaaatgtggaggccaggtgctttgtatcattttctgggaaaggaaaggccgtggagatgagagttgcaaagacccataagaagtgatgagatcagttgagaaatttaggagataaaaagggtggaggttggtagagggaagtaagtcagggataagtcaggatttgtggttacccgtcagttttaggttgaagcacagtgtgagcaaagattggattttgtgggtgtgcttaaaccccttggaacatatttctttaactttgtatcacgcttttctttttgctgtgcttatctttggcaaactcgtatagtctgatatttgatgcttttaatctgatgctttttgtatttcctaggtgtaaaaccagactttgtggttacaactaaagaatgatggaatgcatagattttaagcttaacaggtggccttagggacattgatattatttgcagtccagtcttgctttttcagaagttattgtgacttgtcactccaaatcttactcctttgcttaaaaaaatagctattttgtatctttgcctaaaataccgtaacaaatccagataaacatggatactaacaaaattgaattttagactttaaactgccccatttataagaatacttttttggaatctagtcaaattcactaaaactttatcttgcattagtgttttcgaaaacacctaattaaaattcaggggtatcattaacaaaatttcattgagcctgaagaaggttcttggatttctgcccaacattaaaattctaaatatgaagaagagaccttgaacttttactggactttagaagtaagtgaaagttactacacttaagttagaaaactgttactgcttatttttgttttcctacttagagggttgactcctttttttcttcttttgagatggagtcttgctttgtcgcccaggctggagtgcagtggtgcagcctccgcctcctgggttcaagcgattctcctgcctcagcctcccgagtagctagaactacaggtgtgggccaccacgcccatctaattttttatttttagtagagtcggggtttcactatgttggccaggatggtctcatctcctgacctcgtgatccgcccaccttggcctcccaaagtgctgggatttcaggtgtgagccacagcgcccagcagagggttgactcttaatcctaatcctgacatttgtgtcagatttatggaataatgtgatttacagatcataaagagacattatgagatcatcctttttactctcagttagacttcagcctagtaacattctcagctacttaatctctgctttgtaccagtgagttatgttttgataatggcctccctggttgagttaaagtggacttggagatgaccatatagtagttgcagcttttagagcaccacacattattaaatcttgaatcagttttcatagggagaagccaattttttcttttaattttagttactttcattattgaccttgcctgctgttttggctgccatttgagaaaaggtcaactagaagagggtcaccagaatgacaccttaataaaagaaacagagaatggagagtttgagattgggtattctctttcagtgcagtaacagtcttatgaatctgagtaagtcacaacttccctttggtgccatttaccctgctataacatgtctgtttattcagagtcagttttaagaaaggaagataggccgggtgcggtggctcatgcctgtaatccaggactttgggaggccgaggcaggcggatcacgaggtcaggagatcgagaccatcctggctaacatggtgaaactccgtctctctaaaaatacaaaaaattaggcgggtgtggcagcgtgcgcctgtagtcccagctactcgggaggctgaggcaggagaatggcgtgaacccgggaggtggagcttgcagtgagccaagatcgcgccactgcactccagcctgggcgacagagcaagactccgtctcaaaaaaacaaacaaacaaaaaaggaagatattggccaggcgtggtggctcatgcctgtaatcccagcactttgggaggctgaggcgggcggaacacgaggtcaggagattgagaccatcctggccaacatggtgaaaccctgtctctactaaaaatacaaaaattagccaggcctggtggcgcgcacctgtagtcccagctactcgggaggctgaggcagtagaatcacttgaacccaggaggtggaggttgcagtgagctgagatcgtgccattacactccagcctgggtgacagagcgagactctgtctcaaaaaaaaaaaaaaaaaaaaaggaagctatttgagctagcatcaaataattagtgcacagtacacatggaagaactatccttttaatcaaacgggcatttttattactatttggctttgttctggtcttaacctttccctcaattgtgaatcgctaatgacaacttttatacagatgtcatgatttccatggtttaaacaaatgtaaaattagtttaaaatgccagaatgaaatggatactctcacaaatttgctcattgctatactaaagtgccttgataaagaattttacaataaaatcctgttaataagactgctgattcagagatgaccataattcacacgtgatcgagacttaaagcttattgttttacttgtgaaaaaagtttaagcagaatgtttaacttttaaaaacaaataaatgatattgaaagcaacggtttacattaacttacgtgctaatgtctctcattcagctttagcaggtcctcaaggacctttcttaatacttttttggttaacaaaagtataaatggaaacttgaagagaacctaagaagagaaatgaaaatgattgagggaatatagaccccaaaacacacaaacacacacacacaagcacgtttaagataggggttgaaaagacatactgaggaggaatttgaactttatttttgttttcacctttgagacagggtctcactatgttgcccaggctagagtgcagtcatagcttgctgcagcctcaaactcccaggctcacatgatcctcctgcctcggcgtctcaagtggctacaggcacacaccactatgctggctattttttttttcttttttgtttttgtagagacaagggtcgccctttgttgacaggggtggtttttgaactcctgggctcaaggggtcctcctgccttggcctcccattgttgggattacaggcgtgagccaccttgccaagccacgtttatttttaaaaacaggataaatatattcttgtccagccaatcccagaatcaagtacagtagcttgaaatagatgaaataattttagaatgtattgttttatttatagagctgatagataaatgaaacagtataaagggtaaatatttgctgtttaacagacaacctcaaaacttagcttaaaaaaaacaattatttttcccctcaaatctgatggtttttctgcttcacttggtattggctgaggtgtgggaaagaccttcacttctcctctatatgggcctttctctacctggctgcttggatttccttaaagtgtggtggcaaggttctaagaagggacattccaggagacaggaggtagagactgccagtcttctaaatcctagatttggaagtccaagaatgtcactgtgggtcaaagccagtcaaggccaactacagagggaggagaaataatgtctacctattgataggaagggtggcgtgcataaacaaggaagggggaattgctgggggccaccttttgagacttgctaccgtaggtgctatgctagttggatgttaaggctaaaaataaaaatggtatcagccaagtttgtgggtcataatgctaggaatgtttaggaggcatctctttttttgaggttaacttcggaaggcactaacatgatctcctgcgtgacttcccttaatgatgtcactgttgacataatactgggtgaattaatgtgattaagtaaacttgcttacttacttcaggaaacagaggtatctaaacagattacattttaaaataaattgtcagatgtttcactgtaatggaattttctttacatcagtgaaattgattaccaggtagtgggatgaacatctgaaactagttcttagtttaagttgtctgagtttttgtgtatactttacctattcccagtttaaattggctttcaaacagtttgttttctgggtactcttataggtgttggggtatgaaattagtggtaattctttttgcctattttctttttttttgtctgagataccctgagtctcgctctgttgcccagactggagtgcagtggcacaatttcggttcactgcaacctccgcctcctgggttcaaatgattctcctgcctcagcctcctaagtagctggaattacaggcgtgtaccaccttgcctggctaattttgttgtatttttttttttttgagatggagttttggtcttgttgcccaggctggagtgcaatggtgcaaactcagttcactgcaacctctgcttctgaggttcaagtgattctccttcctcagcctcccctgtagctgggattacaggcatgcaccaccacacccagctaattttgtatttttggtagagacagggcttttccatgttggtcaggctggtctcgaactcccaacctcaggtgatctgcccgccttggcctcccaaagtgctgagattacaggcgtgagctgccgtgtccggcctctttttgctaattttctaaatttatgtttatagtagattttcataaattatcaaaagtgaattattagatgtggagtaaaaattcaactttgagtagttttagaaattatttattgctaaattagaaaataaactttcaaaagagatctcttttttttaaaaaaacttaattgagacagggtctcactctgtcacccaggctggagtacagtggtgcaaccttggctcactgcagcccctacctcctgggttcaagcaattcttgtgcctcagcctcccaggtagctgggaatacaggcatgtgccaccacgcccagctaaattttgtgtttttagtagagacagggtttcaccgtgttgcccgggctggtctcgaactcctgacttcaagtgatccgcccaccttggcctcccaaagtgctgggattacaggcgtgagtcactatgcctggcctagagatgggatctgctttttttttttttttttttttgagatggagtcttgctctgtcacccaggctggagtgcaatggcacgatctcaactcactgcaacctccgcttcccaggttcaggcaattctcctgtctcagcctcctaagtagctgggattacaggcacctgccatcatccctgactaatttttgtatttttgtagacggggtttcaccatgttggccaggctattcttgaactcctgacctcaggtgatccgaccgcctcggcctcccaaagtgctgggattataggcattagctaccgcgtctggcctctagagatgggatcttgcttgctctgttgccaggttggccttgaactcaggctagggttaagtgatctttgtgcctcggcctctccagtagctgggactacaggtgcgtgccaccactcgcagcctaaaatactttttaaatctcacctactttctagcagtattttattttatttgggcgcagctctgccatcagtaggctgagctccctgcagcctcaaactcctgggctgaagcaatgcctctgcctcagcctcctgagtagctgggactacaggtttgtgccaccacacctggctatatttttatttttttgtagagatggggtcttgctgtgttgcccaggctggtctggaactcctggcctcaagttattctcctgcatcagccttccaaattgctgggattacaggcttgagccaccatgcccagctttagcaattttttttttttgagacggagtctcgctctattgcccaagctggagtgcagtggtgcgatctcagctcactgcaacctcagcttcctgggttcaaacagttctcctgcctcagcctcccaaatagctgggattacaggcacgtgtcaccacacctggctaattttttgtatttttagtagagatggggtttcaccgtgttagccaggatggtctcgatctcctgaccttgtgatccaaccgcctcagcctccctaagtgctgggattacaggcatgtgccaccgcacctggccagcaatattttaatatagcacagaagtcctttctaaatgtgtatagtgagaatccattgaggatgaaatagaaaatatttaccaaagtttaacaacttagtcaataaaaataaaactttctctttccgtaataagtcaatctcagcattctaaaataggcaatggaggggggaagaaatctctatgggaagggtccactggatcttaacagtttcaactagtgttccacaatatttctgctgtacttggggagaatttctggataattagaatagtctgaggcttattccttttagtttcccatagcctgattgagatagagctataagaccagctataacattgtacagaagactcagagataaacaagtgaaaaagataactgagattaatgttgaactaagaatatgattgttctctgaggcactacctgctagttcctggattacctttatatgtggccaaggtggggattgggaagcaagggagcaaaagccctagagctaagggagagagaatttctgcctgcctaagatgaaccttctgagttggatatttttttttcttcccccttgagacggagtctcactctgtcgccagactggagtgcagtggcatgatctcagctcactgcaacccccgactccctggttcaaatgattttcctgcctcagcctcccgagtagctgggattacaggcacgtaccaccacacccagctcatttttgtgtttttagtagggatggggtttcaccatgttggccaggacagtctcgatctcctccttgtgattcgcccgccttggcctcccaaagtgctgggattacagctgtgagccaccgtgcccggccttgagttggaatttctttctaaagtcttgctcctttctgtagtttggctttcctttcagggtatctgattttgccttcctgctcctaggcttgtgacctgacctgatgctgtcaattacaggagaatgcagaggtgcaagaaatttttttttttttgagatggagtttcgctcttgttgcccaggttggggtgcaatggcacaatctcggctcacagcaacctccgcctcccgggttcaagctattctcctgcctcagcctcccgagtagctgggattacaggcatgcggcaccacacccagctaattttgtatttttagtagagacggagtttttccatgttggtcaggctggtcttgaactcccgaccttaggtgatccgcccgcctctgcctcccaaagtgctgggattacaggtgtgagccaccacgcccggccagaagaaattttttgtgttttgttaatacagtcagccacgaatagctaacagctaacagctggtccctcatatttgtgggttccatatctgctaattcaaccattgattgaaaatattcagaaaaagagaccacaataaaaaataacaatataacaataaaagtgggaattaaaaacaatacgtataacaactacttacataacatttacattgcattattatatgtaatctagagatgatttgaaatatatgggaggatgtgtgtaggttatgtgccgtttaaggcactataagagacttttgagtatctgtggattttggtatccgatgggaggatcctggaaccagttccctgcagctatggaggtttgactataattatttagcatgtactatttgctgttctaaatatactgttctaagctctttatatatattatttcatttaatcctcccagtaatcctgtgagatagattcagtattattattatccccatttctcatttaaggaaaattattccagagaggttaagtaacttgctcaaagtcatgctagcaggtatcctgagattaaatccaggcagtctgacttgagagccttacttacgtgcagtatacttcctctttgaagagcaggaaaactgtgggatatggtggcatgtttccttaatatctgttaaggcacactttggtaaatgctaaaatagaagcacaaagtgctatagaatttaagggaggggaagttcgtttttgtttttgtttttgttttttcttttttttgagatggagtcttactctgtcacccaggctggagtgcagtagcgcaatctcagctcactgccacctccacctcccgggttcaagtgattctcctgcctcagcctcccgagtagctgggactacaggtgtgcaccaccacgcccggctaagttttgtattttttagtagtgctgggattacaggtgtgagccactgtgcctggccgggaagttcgttttaactgaagagctctttagcagctttgtagaagaaagcttcatattagatcttgatgaatagatagattttgacagatatctctctgaggtaggcagtcaagcggtggccagagtggaagaattactgtccagatttacatataggtttcctgattatttaaattaccgatgaagtgcagtaagactctactgttgtcacagtatcatttcagttagctattggcgtttagaatcacaaaataccagcatcttacagtgataggtatttattctcttgaaattgtgggtttgctgggtagtggatgatctaaacttggcttactcaaagtcaaaagcccaaagtcaagcagggcagggagtaacttgcacaatactatagtgacagtaatctactgcagtgatctagtacagttgatttagagaagaatggtaagatgcttattatgacaactattgtgctttcttctttctgctctctattgttgacactctcctgatagcactttttcattttggttgctgaataatacctgttgattggatactcctagaatcataatgtaatacagcagatttcttctcttcatgttatgtagaaaaaaagcataaagaaataatcagaatcttgactattccacagtgatgccctgaaaagttcagcaatatcatggtgctattcttctatctttgggactgataagcttgatgtcactggaatggcatttgtaacagaatttgaactgtaacagagtttacatcaaggtcatacataataacccaacaactcctttgttaacagttttaacagcttttccatctcttcgctgcacctaaacttaaggttgcaaagatcaggtgctgatatatttagatgtctggaaaactttcatgctttcactgaaaagtcatagagacagatatccaggaattatagcatgtggataaatatttttgtagcacagattcataaatccttgtatgcaggaagtactacaccaaactgttaatgtggttatttgtgagttgctgaattatgggtaatatttcaaaatatttaatggtattctgaaaatatactagtaaatacacagaaaagcattatttaggtgatatttcttttaattcttttttttttttttttgtatccccggagcgagtgcaccgttcctggaggtactgcaataccaggtcgatgcatggagtggacggagcaagctcctattccatctccctgctccaaaaatctatttaatatattgtcctcagatagaggacatatcagatactaaactgatgagaacagatactacacttgatcttagccaaaaggccgagaagtgattttaattctttttctttttttctttttaaaatttttttatttttattttttttttaagatggagtttcgctcttggtgcccaggctggaatacaatggcgcgatctcggctcaccgcaacctccacctcccgggttcaagtgattctcctgccttagcttcctgagtagctgggattacaggcatgcaccaccacacccagctaattttgcagttttagtagagatggggtttctccatgttggccaggctggtcttgaactccggatctcaggtgatctgcccgcctcagccttccaaagtgctgggattactggcgtgagccaccgcgcttggccctttttttttttaattttttgagacagtctcactcactctgtcacccaggctgggtgatatttcttttctttaattctttttctttttaaaaattttttatttttatttttattttttttgagacgaagtttcgctcttgttgcacaggctggagtgcagtggtgcagtctcagctcactgcaacctctgccttccgggttcaagcaattctcctgcctcagcttcctgagtagctgggactacaggtgtgcatcaccacactcagctaatttttgtgatttttattagagacagggtttcaccatgttggccaggctggtcttatactcctgaacttaagtgatccacctgtcttggcctcccaaagtgctgggattataggcatgagccaccatgcctagacttctttcaattcttttatgttttacggattttctacagtgaatatatatcataatcggaaaaagtaaaatttagtatattgagtatatgcatttataaaacaaaatgatcatggactacattgtagcaagtgtactggccagtgggctgacagtggctgcttaaacgactccttactctgagctccagttttcttaaccagaaaatcagctattgttaattttacctacttagggtctctctctatttttcctttcagttcatgttaatttctaaattgccatgtataagtaaggggttgtcaatttacaccataaaacccctttatgtatccaaggttttcataggaaatttaggactgtatgatcctaaattgtgctggagtaccacattttctgttaagtagtacttggcaataaagtataggaaaaaaaaatcagtgggttgacaaagagaggtcatgatagtgtacctgtaatgtaatttgataaaaaatgtgagcctgaactgattgcaaagcattgttacatataggggaagacattatgggggcagaggggggtgaagatacaaagttgaataaaacttctctagagcttcacaatctaataagataggcatttataaatatctcttaaggcgcactttgttaagtgctaaaatagtggcacaaagagctatagaatttaagagaggcgacaggaaaaaaaagtaaattgagttaaaggaaggagaaattagttttaatgagagattttttagaagctttaaagaagaaagttttgtattggaccttgaagagtagatagattttgacagacttgtgtctgaggtgggcaattccaagaataggaagtaacttgggtaaaggccaggagatcagaagttgggcaggtgcagtgagttataggtgggtagatagatataatttgagtatagcagataaggaaaatataaattggaggcccagggagtttggacttaatctagttatatatatatatatatatatatttttacatttatatatatatttatatatattaatatatatttatatatatttatgtatattaatatatatttatatattaatatatatttatatatatttatatatatttatatatattaatatatatttatatatatttatatatatttatatatatttatatatatatttatataaatatatatttatatatttatatatattaatatatatatttatatatatatttatatttatatatttatatatataaatatatatatatataaatataaatatatatatatatttttttttcgagctagagtctcgctctgtcgcccaggctggagtgcagtggcgcgatcttggctcactgcatcgtctgcctcccaggttcaagccattctcctacctcagcctccccagtggctgggactacatgcgcgcaccaccacgccagctaatttttgtatttttagtagagacaaggtttcgccatgttggccaggatggtctctatctcttgaccttgtgatctgcctgcctcggcctcccaaagtgctgggattacaggcgtgagccactcactgcgcctggcctaggtctatatttaagaagaatgttctagtgtactttatgtatgtgttaatgtgagcttttttactaaagtaaaatatatatacaaatagttacatatttttaatatgtacaaataattatatatagctcagtgagtttttacctagtgaacacatcttcgtaaccattatctagatcaggaatagaactttgccagcactccacaagttgccttcatgctccctttagttactaactccctaatcccaagggaaaccactctcttataatatctgtagattagttttactgttattggtatgtaagctcatctaaatggaatcattccagggtgtattctttggtgactggtatcttttgtcccacattgttcgtaagatgattcattcaggttgttgtgggaggtgtggtgtgtttattcttgttaatgtattccactgtgattaatcattcagattagtcattctatttttgatggacacttgggttatttccagttttgggctactttaaattgtgctattataaataatcttgtacagtttttccttaaacatatgtacatatttctgttgggtaggtacctgagaatggaatcgctgggtcacagggtatgaaaatgtttagctttatgctatggtttgaatatagcttgtttggccctgccaagtctcatgttgaaatttgatctccagtgttggaggtggggcctggtgggaggtgtttggattatggaggtgcgttcctcatgaagggcttggtgccatccttttggaaataagtgagttctcgctccattagttcctgccagagttggtagtttaagagtctggcacctcccttttctctcttttggtttctctcttggcgtgtgatttctgcacatgcagctcctcttcgccctccaccgtgagtggaagccgcttgagactcttaccaggagcagatgctagcaccatgcttcttgtacagcctgcagaactgtgagccaaataaacctttttttattatgaattacccaccctcaggtattccattatagcaacgtaaatggactaagacactttagtagaacctatgcaactgtttttcttttttttttttttttttttttttttttttttagagacagggtctcactctgttgcccaggccggagtgcagtggcatgatcatgggtcactgcacccttgaactcctgggttcaagctgtcttcccattttagcctcctgagtaactaggactacaggcatgtgccaccacagtcagccaatgtttttcattttatactttctttagcagtgtatgggagtcccagttgctgaacattcttgcagtgctcacttaatatcgtcttttttgaggccgggtatagtggctcatgcctgtaatcccagcactttgggaggctggggcaggtagatcgcttgaggccaggagttcgagtctagcctggctaacgtggtgaaacctcgcttctactaaaggtacaaaagttagctggatgtggtggcgggcacctgtaatcccagctactcaggaggctgacgcacgagaatcgcttgaacctgggaggcggaggttgcagtgagctgagatggtactactggactccagctttggcgacagagcgagactccatcttaaataataataataataacatcgtctttttcgttgttgccactgtagtggatgatggtactatcccaccgttttaatttgtgtttccttaatgactactgtaaacaagcacctttttaggtttgttgactgtttagacatagtcttttgttgaagtgtttattcaagtcttggccttttttcccctattggagtattattatttttttttttttaaagagatgggttcttgccctcttgtccaggctctcgagtacactggtgtgatcatagctcactgcagcctccaactcctgggctcaaacatcctcccacctgggcctcccaaagtgctgagaggcatgagcctcattattttttgtgtgccaggactccttatttattttgatgcttgaattgttccctatttggccagtgggaagtgcattcaaactgcttcctctgttttttggtgtcattgagcattttcttgtttactgaaagatactccaggctcttcttatactttttttgccctagccctggaattagtgatttctctgagaagctcttttagaagtttcttttagtagagaatgacatgtagaagtccagatctgggtgttaagcgtgctcattgctattggggtgtcactgctcacaagccatcatactggacacaccacacacacaggtgcacattgcacatttacgttgttattttatcttacatattatttaaaaccatgagttcacactgatatccccaattccagtctaataccacagggttcgttcgataatttcataattgtaactccattttctgacagtgagtaacttggctttcattatcctcaaaatattttcttagtcaatcagcccctttctatgtgaccactctcatgttgctgctgttccccacacccactatatagatgccgtccttgacttacttaggctccaaaaccccatgtcagattgctggcctacacccttccatgaacacccttgtccgatacctgtgctagattgcttttcacatcacatttggacttcaacactctgtgcagggctgccatgttacctgccatatttctgtatggacatatcccttatcctgtttttttgtttgttttgagacaaggtctcactcttttgcccaggctgcagtgcagtggcacaatcacagctcacagcagcctcactcaacctcctgggctcaggtgatcctcctgcctcagtctcctgagcatctgggactacaggtgcttgccaccacgcctggctaattttttgtagagatggggtttccccatgttgccctggctggtctcaaactcctggactcaagtgatcctctggcctcggcctcccaaagtgctggtattacaggtgtgagccatcgggcccgccccttcttccttatcctgatggtactctgtcatcctgtactaagacctctgctgatcctgcagatgtctgttttgcctggccctgacaaaatgagtagaggtttattgtagtcaaaatgtagtcaagattttcaatttttaaatttatggttagcactttttctctttgcttatcccaagatcatacagatccttccctccctccctccctccctttctcccatctaggctcactgcagccttgacctcctgggctcaagcgatcctcccacctcaacttccccgtagctgggactacaggcatgtaccaccaaacatcggctaatttttttgcatttttagtggagatgaggtttcttcatgttgtccaggctggtctcaagctcctgggctcaagtgattcacctgcctctgcctccccaagtgctgggatgctggggttacaggtgtgcaccacttcactgggccaagatgttgattttatttatctgcacacacagacacacatacatatgtacctatatacatacacacacatataagcttcatttaaacattttttattgtggtaaaatacatgtaaaatttaccattttaactatttaaaatgtatagttaagtagtgttaagtatattcacactgttttgcatatataatctttagaacttttttgtcttgcaaaactgaaactctatacccattagacaaactatcgatgtctcccttatcccagccactggcaaccactattctttttttttgtttgtttggtgttttttttttcccccagagacggagtcttgctctgttgcccagactggagtgcaatgaatggcaccatcttggctcactgcagactccgccaagcaattctcctgcctcagcctcctgagtagctgggactacaggtgtgtgccaccatgccagctaatttttgtatttttagtagagacgaagttcaccatgttggccaggctggtcttgaactcctgatctcaggtgatccgcccgcctcggcctcccaaagtgctgggattacaggcatgagccactgagcccagccttctattttttttcctatgaatttgattcctctagatacctcatttaagtagaatcatacagtgtttgcctttttgtgactagcttattttacttgatgtcctcaggtttcatccatgttcttccttttttaaggctgaataacatttaattgtatgtatataccacattttatttgttgtcaatggacacttgggaagcttgtacgttttgacctttgtgaataatgctgctatttgtatatgttacaagtacctcttcaagtccgtgagaagttttatttaccatttgcatttagctctgcaatccatctggaattaatttttgcatatggtgtgaggtagacgtcagcattctttttttttttctttctccatgccagacaggtaatgtgcctatgtaacaaggtttgagggaggcacacctcacacatgaggctgaaaacccaatcgtcatgcttacaaactacaaaaggatcagaattctttttttccttttctttctatagccagcttattcagcactatttattgaaaagattgttctttttctattgcagggtcatttttgtcatattaatgtctatatatgtatgtaggcctgcttttgggattttctcagtagctccattggtctattcttgtgccaataccacactgtcttaatttctatatttttatataataacatttcttgatatctgatagtatatgcccctcagcttccccttcccccaagattgcattggctatcttggccttttgcgttttctttttctttttctttttctttttttttttaaatggagtttcgctctttcactcaggctgcagtgcagtggcgcaatcttggctcactgcaacatctgcctcctgggttcaagtgattctcctgcctcagcctcgagtagctgggattacaggcacacaccaccacgcccggctaatttttgtatttttagtagagacggggtttcaccatgttggtcaggctggtctcgaactccctgacctcgtgatctgcccgcctcggcctcccaaagtgttgggattacaggtgtgagccactgtgcctggcctgcattttcatgtgtattagaatcagctaggccggttgcggtggctcacacctgtaatcccagcactttgggaggccgaggcgggcggatcacctgaggtcaggagttggagaacagcctgaccaacatggtgaaatcccgtctctactaaaaatacaaaaattagccgggcatggtggggcatgcctgtaatcccaggtactccaggttgaggcaggagaatcgcttgaacctgggaggcagaggttgcagtgtgtgatcatgccactgcactgcagcctgggcaacagagcgagactgtttccaaaaaaataaaaaagaattagctagtcagtttccacaaaacatacttttatgatttttattggaattgcattgaatccatatataagttttgggagagctgagatcttaacactattgagtttcatagtccacaaaaatgatgtgtctttccatttatttaggtttgaatttctctgtttagaggtctttatatatcttttgttaaattattcctaggaagcagatgtttttaggtgttatttaaaaaatttaatcctctttgttgctgatagtgcagaggctttaaatctgtggtctgtggcccctgtacaagctataaacatgtgaatactttttcctgaaagatctgtaatttacatttgaatctgattcccactgggagcaataacaacaaagatgaaagagcacttagtgctttagagtggattagactagggaggggtaccagagaggcagggaggccatttaaagtatgtaatagtctacgcaagagactgggcttgagctagggcagtaggtatggaaaaggaggaaagacattcaaggatattctggagacagaatgaagaaggttgctgagagtagggtagaacaaatgaagaaaaagagtaaaatatagctggcatcagtcatgttaagggcaattagagggttatcaaagcagtaggtaggtaagggaaaatgagtgtttggtgggtgaagatattgggatggtccctaactataataaggagactttgaatttaagatatattcgtataaataaagatgggcagggccgggcgcggtggttcacgcctgtaatcccagcactttgggaggccgaggtgggcggatcacgaggtcaggagatcgagaccatcctggctaacatgatgaaactcagtctctactaaaaaatacaaaaaattagccaggcatggtggtgggcgcctgtagtcccagctactcgggaggctgaggcaggagaatggcatgaaccagggaggtggagtttgcaatgagccgagatcgtgccactgcacttcagcctgggtgacagagcaagactccatctccaaaacaaaacaaacaagacagaaaaaaaaaaaaaagatggtcaaagtgatagaatatatgagacttggaaggtggaaagctgggtgatgattagatggagattatatattattctgtacttttttgtatatttaaaagtatccatgataagaggttaagaaaagtttatctgctgggccaaatggtatttccagttctagatcccggaggaatcgccacactgacttccacaatggttgaactagtttacagtcccaccaacagtgtaaaagtgttcctatttctccacatcctctccagcacctgttgtttcctgactttttaatgattgccattctgactggtgtgagatggtatctcatagtggttttgatttgcatttctctgatggccagtgatgatgagcattttttcatgtgtttattgcggcattattcacaatagcaaagacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagtgcaccagcatggcacatgtatacatatgtatgtaacctgcacaatgtgcacatgtaccctaaaacttaaagtataataaataaaaaaaaaaaaaagaaaagtttatccgcataaaaagtaggctgaactgaagattgaagatctctggaccagctgtactcaaattgttatgtgagagaaatatcaggatttggttttgagtaatttcataaccgctgtctattgggaacacagttttatcaagatctgccagataaggaggcacaaagctacagaggccaggtgctgcagggtggctaggagttggggaaaagaaattgactaggtgtctgttggcaactcaaccaggtgtgtggacgcaggggaacttagcaagggaaggtgatatgatttggctctgtacccacccaaatctcatgtctaattataatccccagtgttggaggtggggcctggtaggaggtgtttggatcatgggggcggatttccgccttttgtgctgttttcgtgatagagttctcacaagttctggttgtttaaaagtgtgtggcaccttctctgcccccctctcttccccccttctcttcttcctgcttcggccatataagatgcacctgcttcccctttgccttctcccgtgattttaagtttcctgaggcctccccagaagcagaaaccatcagaagcagaattcactacgcttcttgtacagcctgcagaaccgtgagccaatgaaacctcttttcttataaattacccagtctcaggcatttctttatagcagtgcaaaaatggactcatatacaagggtatacattcagcaggagaataatggcagggagtctggggcagatattctggggagatcaataggcagaaagcatcagtgaatactagaaacaggtagcaaagcgttgcttcaagcttgaactcaaaagtggaactgggaaacctagcaaggaactaaataattgattcattcagcctatactgattagtgtctattgtaatagttctacactttaccctgtataggaattatttggaatgcatgttaaaatgtagtacagattcttagttctttttcccccctcttcccttttacttggtacgcctaaaaaattggcatgttcagcaagcatatcagatgtttctgatgctggtgtttctcaggatcatgctttgacaaaatatctagtccactgtgtgctggccagtgtatcaacacaggggaagtgggggaaatgatgtggctagaaccagagtaaaaggtgaggccttgtacttgggaaacacagcaggaaggagctgaattaactggaatcaaaagtgatggcaggccagttgcagtggctcacgcctgtaatcctagcacttcgggaggctgaggcaggcggatcacctgaggtcaggagtttgagaccagtctggccaatgtggtgaaaccccgtctctactaaaaataaaaaaattagccgctcatggtggcccaggcctgtagtctagctacttgggtggctgaggccagagaatcgcttgaaaccaggaggcggaggtttcagtgagccaagattatgccactgcactccagcatgtgtgacagagcaagactccatctcaacaacaacaacaacaagtgatggcagaatgagacaaatctcatggccaaggcttggactctctgaattccaactagttggtagtaagttggtttcagaaaacaatttacttctgtaggctgtttgcagctagagaaatagtgaaccatgggagtaggaatataagcaagctgtgacacttagaagaggtatatctagtggaaggacaatagcaacatcccagaatgtggccactgaggtactacattaaaatcacatcacaataaaactggtagtttttcctagtactatgaacagattgtgtatcatcttcatttattttaaagatgctgtggctggtccctcagctcataatcaccatcagccatggcatctttacatagaggaaaaggatgtaattcagtacaattaaataaggtaaatgtaaaggtgctttgtaggtcatagggtaaggtggtggtggtggtggtgctttcacaacaacattctaacacaaagcaattcatacagactcccaaagtttattgaataggcattccactctcattccattttactctttaaatatatatttattcatgcctgctgtatgcaaatttttgattccaatttttttaatggacatacagtaaaatggatttttcttaatgtacacagttttaggaattctaatatgtgtagtagattcatgtaaaccacaatcaggataagaacaattgtatcactcccccgcaaaaaactcttatactcttcctccacctctaaccccctcttcctcacttcattttatgtttttgagaatgtcatataaatggaaccgtgcaatatgaaatcttctgttactgacctcttccgttcagcataatgcctttgagctagattaatccatgtttttgcatgtatcaggagttcacgtcttactattgttgattagtattttattgtgtagtgtaccagactgtttattcactcctgaaggacatttgggttgtttctggttttggtgattataaataaagctgctataaataaacacttgtgtatagattttgtgtgaacattttcatttctctaaatacccatgagggagaattgcgtgataaatgtaggtttaacctttttagaaattgctattttccagagtgattgtaccagttggcattcccacaagcaatgggtgagagttctagttgatctacatccgtgtcagcatttgggattatcagtatttttaattttagccattctaataggtgtatagggatatcctattgtggtttcaatttgtatttccctaatgcattcctcgattcttgatgcttttattgatggaggatccaacacaaaagataatgcatggtcatgagaacaaaatatttgatatgcctaactttaacattctatgaaagacttcattaatatttttaaaaaggagtttgtactattgaatattcatggtttttcagtgaagtttgaggtactctgaagcctatctacaaagttttaagtaagccatgtgacagtgtggataagagagtgacttcagagcattttttttttttctggtgacctttggtgtgtagaacacttgtggcctttaataaactgaggagataggatgaccaaaattttttttatatgcctgtaatttttttaaagcagaaataagtgagaaacgcttatggacactgtgatcaagatcgtgaacaagatcatgatctacatttactgatttcatgttcctagtagcatagatcaatggtatgattttaataattcttattcagggaagtaatttagatggaggcaaggaaggctttcccttgagtaatatattaatttggccccatctatctcttctcctttgtagatcatcccaagcagcagtctgtattataagaagcaaacttaaatgattgctaattaaatgtttagtgttttttttgagttggttattagcttgaggttaaatttgtttaatgagtaaatatggaagaattatgtttttcacatttggaatgcatacttgctgatcattggtatgttactcccattttatgaagctggaacataatttccttctttttaatgactgtgagttttacagttatttaatctttgttttggtggtgttagtcatgtcagtactttatttgctaccgagttctcagttaggaaataggctcccaattataattttttttttttttttttttttgagacgaagtctcactctgtcacccaggctggagtgcagtggcgcgatcttggtgcactgcaacccctacctcccatgttcaagcgattctcctgcctcagcctcccaagtagctgggactacaggaatgagccaccacgcccggctaatttttgtatttttagtggagatggggtttcaccatgttggccaggctggtctcgaactcccaacctcaagtgatccgcccacttcggcctcccaaagtgctagaattacaggcatgaaccactgtgcccagccccagttataacttgtttccatgggaaaacatccgctttgaagcagtattcagtaatatattgaaatgagaaataggcggtcaagcagtgattcaggtttagtgttcagtgtaattaagaaaaggtgacttaagttgaagaacattgatgtatctgtttttaaattgcacctaattataatgacaacttacaagatctctttccttccttctctcttggaatgttgactataaatttcacataatttaaaaacaatttaaaagctagtcaaattaattgagaagaatcctgctttatcaaattttgcctgtaatcatatccagacatggcattttgaaaatcagaaaggattgcttccacttatatcagagtttgaaagtagaaactcttttcatgtaggtatgggtcacctttgattatatggtagtcttctgaatatggtcctcttacctgacacatatgcacctcatcaataaactacatacaattcttaggtttatatgtggtcatgttacaaaggatttcttaagtactcttaaatgtgttctactaatgtcttgtggaaaaatataatcttttgaaagcattcgtgttaaaaagaattagacgtgatttatctcatttagacctgttctttttcaatgtgtctttaaaatgtaggtacagtatataagaattcatactaaaggatcaactgagactttgatttaaatatgttataaattatagtatggaggcctgcataatatactacatatttttttttcctaagaagcttatttaaatggttctgttaagtgtaggaatgttctgatgattatctttttaattaaaatgagaaatctttgtttaaagtggcactcgtttttttacggcctgttacagtctctgtaacaatcatttcttaagtctgaacgttttatttccaggaatccatttatataaaactatgtttagacttaattaaggaacgattcttacaaagcttgtaaatagccaggaaaaaagggacagaaaataaaactgacattcacatttaacaaaatgattgttacaaggtatgtaataagctataaaaatacaataaagccctttttataagagttcatattttttgatccttgttttcaaaggtatttaagaaaaatatcaaagctttgcaaagtgacatctgtttgctgaatggactagttataacttcttttgtttataactgacaatacgagaattctacctgttttgttagtgtgtcttctttgaaataccttgtaattagtttagattggtaggtaaattttacgttgtaccatagtgaaaacaagacctggttttcaggttctgcttcctagatgtcatagatattgggcatgttgcttaacctccttgagtctcactttcctcatatagaaagcaaagataatatctacttttgtacctcaaagagctgttatgaggagtaaatgaaattattataaatagagcaaatattttggaaattataaaggactgtaagcatccagatcatgtgtctcttaaagatgaattagatttaacaacctcttttttttttttaattaaaaagtaaactttaatgtcaaaaatgcaaacttggggagggcagaaagatcacacacaaggctgtgccttcacacttggagggttgcacagcagccgggcagaggtactcctcacttcccagacggtggggcggctgggcagaggcactccccacttcccagacagggcagcggctattaagaacctcttttaattagcaaacttccttctcttgttcatgcattctgtcaagtacatacatgtacatcctttttgaaatgacacttatttttccatttccttgtctaagtataagtgattgaaaccactattggcatagtggaaattacacaagaattggagtcagaagaactggtttcaagtcctgtcttaactacagtcatgcattgcttaacaatatgtgatacattatgagaaatacattgttaggtgattaagtggttgtgtgagcttcacagagtgtacatagacaaatctagatagtataccttactatacacaaatgccatgtgatataacctgttgcttgtgcagtttgttactgtacactgaatcctgtaagccattgtaacacaatggtatttgtatatctaaacatagaaagggtacggtaaaaatacagtgttataattttatgagaccactgttgcatatctgaccatacttgactgaagtgtcagggggtgcatgactgtatttttacttattctctgaccttattcttgggtggtgataataataacaataataatggcagccaacacttgtagctcagtatataccgtgcaggattctagacactatatatattaactcatttgatcctctcatcttattaggtgtgtattattattatcatcctgatttacaaatgtggaaactgaggcacagacaggttgttactttttccagatcaaacagtttgtgaatggcacagctggtattccagctcagacattctagctccagagtgagtgtggttaatcattgtgctatactaaccatgttccttaatttcctcttctctaaaatgagaataacaataactgttctatctactgggttgaagatccagtaagagagtacacataaaagcactttgacatcacagtgtaccataaatagaagttatatgtgaactgtagaattagcatgcaccttagagtaggtattttatagttttttggtgggtgagggatgttatcttttgacttatttttgagaaatataattttgaagagaggtgttgatggtgtcattcttttttcaactcctcagaaaaattatgagaaacacacgatgataactcatatatccctcacctgaattatctaattgttaacattttgccacatttgacttttcctagtatatactttctttctaaattatttgagagttgcagacatgatattttaccttctgcatgtattttctaagaacaagagcatccttattcctaacctcaatacaagatcccactcaggaaatttaacactgatcactgataaccttttattatttaatatacagttcatatccagaacccctagttatcctaagaatgtcttttttttttttttttttttttttttttttttttttttgagatggcgtcttgctctgttgcctaggctggagtgcagtggcgtgatctcagctcactgcaaccttcgcctcccaggttcaagtgattcttctgcctcagcttcctgagtagctgttattacaggcacctgccaccacgcccggttaatttttgtatttttagtagagatggggtttcaccatgctggccaggctggtctcgaactcccgacctcaggtgatccacctgcctcagcctcccaaagtgctgggattacaggcatgagccaccgcgtccggcccctaagaatgtcttttacagctctttaaaaaaaaatccaggatccaatcatgttatatataatatctctttagtttcctttaatttacagtagttccctaatggtttttattcatgaaattgacatttttgaagagtttgaggtagttttacagaatgtccctcatttgtttttgtctgattgtttttccatgattagatcagggtaaaaaatttggcaggagtataatatatgctgtgttttttttttcttagtgcactactacatcagaaggcatataatgtcagtttgttccattattggagatattgtttgatcatttattaaggttgtattcactagatttctctgttgtaaaggtatatttgtaagtattcagaggagcaaacttggagactgtgtaaatatcttatttcacaacattgtttcacgcagtagttttaccatccattggtgattcttctgtggtagttgtaaaatcaacctatttatttttaggtagttctaaataatttttttctttctcaattttgaaatggtgagtgtttcctattttggaaagacattacatgggctttatcctctttatttcatttttgaacttagaccaattaaagtgtactttttacattgtaaaaaagataaagataacttttatctttagtgcaaaacactactaaagctgcttagagaattgagttaagtttttaagggctttttgtaacaaaaagtatgtctgaattccctggaggacttgttgggccttccctggagattttttttttttttttttttttctgagacagggtctcactctttctcccaggttggagtgctgtggtgctatcacagctcattgcagccttgacctcccaggctcaagtgatcctcccacctcagcctccttagtagctgggactacaggcgtgcaccaccacgcccagctaatttttttatttttcacagagatagggttttgcccatgctgagtttgccattctttaggcctgggttggggtctgagaatttgcatttctaactagtttataggtgatgctgctggttctgggactacactttgaggactgctgtggcttctataagtcttcctttttaaaaaaaaaaaaaaaggctagtcaagttctgaagcaattggttgtgaacacctgcacttgccattcgagcagatattttgctcatgattatttggaccgttttcttcctttcttcttttctttcttcctttctttccttctttccaggctggagtgcagtggttcgatcatagcttattgcaactttgaatgcctaggcctagggagccctctcgcctcagccttctaaagtgctggggttacaggcatgagccactgtgctgaccttgggatacttttctacttgtttgctttctttaatagatatgagaataatatggatatagtatagcagagtaaattgaagtttgtattaggggattttgatgaatgttgggaaaattttggcaattggctaaattactgaataggatctcattaacctagctaattcaaaattatctatgttgtaatgaaaatggttatagggtattttatctatttatttatttattttttagagatggagtcttgctatgttgcccaggctggactcaaactcctgggctcaaaagtgattcttccgtctcagcctcccaaatagttgccggtaccacaggcttgtatcaccatgccctgtctaggttattgtaaaacatatttgtagcatttatatttgtcgaattttctttactttgctcaatgaagtaaccaaattaggtatccatagtgatcagtttgtgctttcagtatttaagtaatctctgttatactttagcaactggttttgttaagtctgtgcaattagtaaagcaagtggcaaatttgttacgtcatagagattattttcacttttacagaagttggccatcagccctccttctttgagtctcctattagaaatactataaacatcagagagaagaggatgaccttaatatttgcttcccaggctaaatcacagccttgaagcagctatttctttccgaataaaaagtttaatttcacgccctgattagtgccagtacgtgcaggtagatacttatgttatgtagctaaactgatgtgcctttgcaaattacttgccagtcagcagaactatagtttcttatgagtagtttatggtaaattatagttctagttagtaagttctgtgtgtttttttaaagtgtgtatttattagatacgagtaggaatcagtcactaaattttggccagactagcagttgactaacagcttttttcaaaggctcaggtttggactaacagtccagccaattagcagtaggaaagagtgagatcttattttcagttgatttgaaaatatacacaggacctagaaagagtggtttctgatggaaaagacctaaggagagattatttttcttattgagaagtaaaatacattgtagttaaaaattgagacctttgagaggcttaaaagataggaagatcaactgaggacaagacatagaaggttttgaaatcgtgggacactacttaactgaatttttaattgcttaattgaaactatggagttttaaaaacttttaagatgaactggggccaggtttggtggctgtcacctgtaatcccagcactttgggaggctgaggtgggaggattgcttgaggccaggagtttgagaccagcctggtcaacttagcaagacccatgtctctacaaacagaacaaaacagaacaaaattagcgtggcatggtggtgcacacctgtagtcccagctacttgctttgaggctgcagtgggctatgattcctccgctgcattccagcctgggacacagagtgagatcctgtctctaaaaaaaagaaaaaaaaaattagccgggcgtggtggcgggcacctgtagtcccagctactcaggaggctgaggcaggagaatggcgtgaacccgggaggtggagcttgcagtgagccgaaatcgcgccactgcactccagcctaggtgacagaacgagactctgtctcaaaaaaaaaaaaaaaaaagaaaagaaaaaaagtgaaactgactttttttgaacttggatgaaggatagatgagatgaattagaaggaagaaaaatactgtttccttaataaatgtatcatttgtcttatctaaaatgtcactaaatttgcatggagtcataggatttaagagtctagaaggaccatctaattcaaggcttttttttttaatttagtttttctattttctttgttctttctttcttcttcttctttttttttttttttgtgtgttcttctacttgataattcaaggcttcttaacctttttttggttatggacttcactgaaaatctggtatcacaggatccttcctcttcccagacacacacacacacatatgttttgtacaaaatttcaggaggttcagagatccctgaatcctatctatggaccctgggttaagaaccctgatctagcttgttttttttttgattcttgcatagtatatttttatttaaaaggttttgctgataattattattttaatataactaagttgtgacctgttttaataagggtctgactgtaaaacttgagcttcatcataaagtgccattttgagaagctaatgaaatgttgagtatgttgcctagtagtgtcaggaaaaatggtacagagatgacttggctggtagttatcaaaaatcctcccagaacatcctgttctcattcccctagctattcaggcaaggggccacaattaatccctgtctatgatgatgtaattttacttttcaggatatatggacagatacacttaaatcctttgattattattctactgatatttccaggacctttctatttttataagttttattaaagatgtggtataaccaagcaaatgcccagcaaggtcagtttactctagtaagtacactctgcatctagaagcatgtggaataaactctgttctgtcaaggtcagccttaaacattgtcaacatgttcacttatttatgctctgcagttctggggaggcctgggaaacatttatcttcttttctttttcttcatcctcttaaggtatcaacactgacaatgctatctatctaattagctcattcaagaaagacttttttgtgataattttagatcagcagtacactttggccagaaaacctggtttggattttatcttatgttatcccacatgctacttagaaaaagagtttttatgagatatcgataaaaagtattgtggaatacttcttctttttaaaaatgagcacatgaagaaccaaggacttgtttgacttgccagtgtcacaattgatgacagcctgaattagagcccacatttcctaagtccaagtctagttggtgcttttccgagtctttgttttgtttgtggtttagcttgtgtttcttctactgataggtgaattggtggggggtgtttttaattagtacttttgtgatttgtttaagaaagcctcccctaatttaagatcatgaaaatagcctcatattttctactagagactttttgagttttggtttttacgtttagaattttagtctttctagaattgatttttgggtttgatgtgacgaagggattccgtttcacttttttccatatggatttacaatggcccccagcatcatttattggaagaacatgcattctccatcaatctgcagtgttatctccctcataaatcatgtcattacatgcattgatcagtttttggactcattctgttctattgttcatttatttatatcagtgccatactatcttattcatatagcttttttttgggcaaatcttttctattttaaaaaattcatattaaaaatttaacataataagtgtacatatttatggggtatatactgatattgtgatacatatagtgatcagattagtaattagtgtatgtatctcagtcatttatttttttttgtattgggaacattcaatattctcctagctatttgaactatatagtattttattgttaattattgtcattctacagtgctgtagaacactaggacttattcctcctatatagctcacactgctttataatacaccttttttatggtagttaaggtctcataccttattttcttcttggctatttgtggctttttataccttcatgggacttttttttttttttttttgagatagcctcactctgttgcccaggctggagtgcaatggtgcgatcttggctcactgcaacctctgcctcctgggttcaagcgattctcctgcctcaccttcccgagttgttgggattacaggtgcccaccaccacacccggctgatttttttttttcttgagacggagtcttgctctgtcgcccaggctgaagtgcggtggcgcgatctctgcttactgcaaactctgcctcccaggttcaagcgattctcctgcctcagcctcctgagtagctgggattacaggtgtgtgccaccatgcccagctaatttttgtatttttaggagagacggggctttgccatgttggtcaggctggtcttgaactcctgacctcaggtgatctgcctgcctcggcctcccaaagtgctgggatttcaggtgtgagccaccatgcccggcctttggaaatttttatagatagcttgtcaagttcaaaagcaacaaatatctaaaggcaaaaatatactaaacctattgggattcaggttagttgattcttgatagaaaccaaagtatggagttacttcaaaattaaaaactaaaatttgagaacttttagctaggaaagatggctttcttttgttttgtttagaggagaatcttgctctgttgcccaggctagagggtagtggtacaatcatagctcattgtaacatcaacctcctgggctcaagtgatcctcctgcctcagccttccaagtagctaggactacaggtaacaccacaccacacccagctaatttttattttattttattttattttattttatttatttatttttgtagagacagggtctctctctgttgcccagctgttctcgaactcttggcctgaaacaatcttcctgctgtggcctccgaaagtgctgggattacaggcaggtgccaccgccccacctgtgtttattgattgattgagacagggtctcattctgttgcccaggctggagggcagtggcatgatctcagctcactgctgcctcgacctcctgggttcaagtgatcctcccacctcagcttcccaagtagctgggactacgggtgcccaccaccacgcttggctaatttttttgcatttttgtagaggtggggttttgccatgttgcctaggctagtcttgaactcctggcctcaagcaatctgcccacctcagcctctcaaagtgctgggattacaggcatgagcgactgcacccagcccagcctgttttattcttaatgttaagagatagttggatatgatgaaagagcactttattgagccagatcacttaagcatttgacctttagacaagtcttttatttatgttagagtttcttagcccttgggccttggccctcttctctttcctgtctacactttgttcctagatgatcatctattccttttgctttgaaataccatctgtgggctgatgatttctaatgggctaatagtctctaacccatccttttactgtgacttctacctttatgtattcaactgattatccacttgaatgttgcataattgtgattttttgtgtgtgtttttttttttttttttttttttttttttgctgatcttcccatactaataaatggtgccaccatttatccagttactgaagcctgaaacctggaatcatcattggctcctcactttttcttatgccgatatgcaattcacaagattttatctgttctacttccaaaatacatctcaaattcgtctacccctctctgcctacactgctatcaacttactttgggttattatcatttcttttatggaaaagtttaacagttttctagctactctcccctttaaatctagtctgtctccacacaatagccagagtgatctttcagagatctaaaatgttctaatatcttccttttggactaaagctatgcatggtaaactttgttgttttgcctggcagagctggtcctttcccacctatgtctttgaccctgttaggtcattactcccagtcttcagttacagtcaagttacactggccttttgccaaacacctttttttttttttttttttttttttttgagacagggtctttctctgttgcccaggctggagtgccatggaataaacacagcacagctcactgcagtcttgacctcctgggctcaagtgatccttctgcctcagcctctggagtatctgagaccacaggtgcacgccaccatgcctggctaatttttaaattttttgtacagacagggtctcactatgttgcccagcctggtcttgacctcttgggttcaagcgatctgtctacctcagccttccaaagtgttgagattataggtatgagctaaatttgccaaactcttgcaagaccactataaggcctttgcattggctgttttctccaactctgactttttggttgagtccttcgtttatcctttatatctcagttctaatcacctacttagagcctaccctatctaaagtaaatgcccctttccttatttgtctattatttctactagaaaagaaaataaagcccatgatagtaaaattttgtgttttactcttgagtatatcccagtgcatgacatgtggtagacaataaatacttgtgaagtcactcactttcttttttttcattttgtaaaatagaagctgatgataaactgcccatcctgcttcctggagtcattgtagggaataaatcaaacaatgtttatgggaataaatcaaacaatgtttatcagttttgatgtcctggtatgatttttttttttttttttttccgagacggagtctcgctttgttccccaggctggagtgcagtggtgcaatctctgctcactgcaagcttcgcctcccgggttcacgccattctcctgcctcagtctcctgagtagctgggattacaggtgcccgccaccacgcctaattttttgtattttagtagagacggggtttcaccatgttagccaggatggtctcaacctcctgacctcgtgatcctcccgcctcggtctcccaaagcgctaggattacaggcgtgagccaccatgcctggcctggtatgataattttcaataaatgagctttagttttttaaaagacattagagcaaatttgagaaagtacaaaataaaaaaaaagcagcctgccatcccacacaaccacttttatttaattttgtttgtcttaaaaaagaaagaaagaaagaaagaaaaacaacaacttttaagggtgaatgtactgtccagcactctcttctttctaattttcctgtcccaagcagcttccaaacactttaaggaggtgcatcagttaagatagattaattttatactttttaagacttgtagggaattcatttatgtattttgaaacttgcgtggaaagaagtaaatacaaatggttctttatcaaatttagaaattttactcttgataattaaagtttttataagaattttgcctaaagaacttttcttgaaactagcctgtatataatcaggatttcttgatatggaatacaatctgatttgtcttttaaaacaacttgtacaggttactatttatcctgtgtggtaactaccgctcctgctgtgattcaaatatttcagcccttaagcagttatattaggcttggggaatagtgtaatttgaagcccttggaacatctttttgaattagaaaaggaattctctaaataaatatattcaactgggagaactacttttttgaaatttattactttggaatatataaagtttggtcatctttggaagtagagatctaatttaccagcaaatggagtttataatactaaaatatagtattgtttgcaaataaaattctttgtttttgtgtcttaggttaataaattgtctctgagtcaattgttacaacaaataccaaatggaaaaattgctttcatttcttagcataggcacaaccttcgtagttcagccttcccaaaatgctctttgttcatctgatgtatgttggagagactctttataaaaatggcaatgttgacatgtaccttaatttgctatgttcttttaaaaataaatttgggaaatttgctctctagaacagtagcctcctaacccatcagaaacattttaaggatttatcctaaatatttttacttcttaatttgcaaattgcaaattgtactcatgccctgccatcattagctactatattaaggcacaatatatacacttagggtaaataaatataaataagtaaatatatatgtgtaaattgtgtccagatagttgtaatgataatgtctttggtttattcacatatggttagttcaatattatttttaccttgtaaagtgactaatgaagggcttgtgcaaagaattagagaagagtcaattgacagtttacttaaaactaactaatattctttttttttttgagacggaggcttgctctgtcgcccaggctggagtgcagtgccgctatctcagctcactgcaacttctgcctcccgggttcaagtgtttctcttgcctaagcctcccatgtagctgggattactggcgtgcgccaccacgcccagctaatttttgtatttttgatagcgactgggtttcaccatgttggtcagggtggtctcaaactcttgacctcgtgatctgcccgccttggcctcccaaactgctgggattacaggcatgagccactgcacccagtgaaaacattcttaaattctgagcacacttaagttttttgcaatatgcccaaagagaatgaatgagggaagaaaccattggcaacccctttgtgttgtggaattcccaatcttcagtaagtgacatttaaccatttaacatcagattaagggaacacgtatcaaaaaaaattttaaagattattttttaaactaaaaattaattgaaagttttttgttgttgttgttgttttctttttgagacagagtttcgttcttgttgcccaggctagagtgcagtggcggcatggtcttggctcactgcaacctccgcctcccaggttcaagcgattctcttacctcagcctcccaaatagttgggattacgggtgcccaccaccacacctggctaatttttttgtagttttagtagagacagggtttcaccatagtagagacagggtttcaccatgttggccagactggtctcgaactcctgacctcaggcgatccacctgcctcggcctcccaaagtgctggaattataggtgtaagcttccgcacccgaccaattaaaagttttaatattccccctgtggtgctatatatgtatacataggttttcatccatggtcctggttcataactcccatatccctttttatggtcttttgttaataatgttgggtgtgttaggcctcagccgcagacctcaggaaatagtctgtctcctgcccttctttcacctgccccagggcaggactctaatctcccaccacctcctttctgattgtggatcttaagaccctccactgagagggtcccacctcataccctcgtgggaggaaggaatgcttccataaaaactcaagaggactgggtttggaaagcttctggatagctgaacacatggagatccctggagggtggtgtgcccagggagtcatggcagctctgagccccttcgcccataccttgttctatgggtctcttcatttgtattctttgcaatatccttcataataaaccagcagatataagtaagtgtttccctcagttctgtgagccacttcagcaaattaattgaacccacagaggggatcatggtaaccccaacttgaagccagtcagtcagaagctccagaggcccagagttgtgactgatatctagggatatgggggacaatcttggagctctcaagatgaggcccgaggctctcttttaaggggtgttctggataagtcatagcagttaacaagaatgctaggacatacagggacacataattcatcagtcctgtcaaagtacatcacaaaaatccagtatcatgattccaacagcatttcagtcttggggttagggttgaagttagacaaaacaaaaacaaaaacaacccacatttggtcacagagaagtcttctgtgttgatgattattgtagtatgagagtagtggaaaaacacgaggttggaaagagtctttccctacacactcccccaccctggaggatcatcttgcctacctcctggcatgtgcacaccctgctttggaaaccaccttgcctcacacaagggatgaaaatgcattgtggcagaattgagttctttgtcttttctcattttctctccagatttcatatattgtggaaaagcagttgaatgagaaaactaatctttcaaacaagcatagccagtgtaatgcagacttcgtagactgtagagcatgtccctctaaaactgagtgtataattgagtctgtacctaggacttccagggcttttagtaattaaatgatagattttatagaacgcagacattgtttagctaaaaagagatatttccatctcaattctatttagaagatattatggagctagaggtggagatctatgactaagggcatgttgaatttttttatgaaagaaggggactctggtaattaattttttatgataatgtattctttcaatttggaaatggttcgagtacgaactcaattattttcaaatataaattttggaaatgggatatttttagatctaattgccgatgactaatataatgaatctttataaaaatactattttgtatcttggaggttgggggacatgtagatgttgcttaaaatcattgaaaaagtattctttttgcagcatcctgcttgcctggcttgtggatttcaccttgtttctgctggggatattagtttgtttcttaaataaggatttttgtctatttaaagactcagttgtctagtttcaaaggtaaagcttaaagcaggtccttcttccgcttccctactccacaaaatacatagtcacagactgactagtaatgagtaaaacaaaagcaaactgcctcttaatctaggaacagagaagaaataaagaagtccctatttcagagagagtaagggttaaaattcttagcagtcggggcagggtataacactcttgagaagagtgataagggctttcccagtagcctgcagttccctgtagagtagtacatggctagacttgtcagattagggcaagaatagcaatttgaccagtgagttccagcaggtgtagcagcaaaagcacagatttcttacacatacatgtaatgcatgtctgcttatagcggacagcccttgagatgaggtctgaggtgttctgaatgagtcatagcagttaccaagaatgctaggacatgcatgcacagataattcaccaatcctgtcaacatgcatcacaaaaatccagtctcacatgattccaacagcagtagcgcctaaattcacgttattgcactgtaacaaaattgtatcatcttgtgtatagcctaggatctactggcttcagctaatgtagaagtcattatcactaggtggcatttgcttggggagttgaggcctcacacagagggattttcctgaggtttcctaccaatacagcaaactctaaggaaagaagaaggtagggttggagagagatggggttttgtatattatttcaacccattccgttggtttaattttcgtgtgagagtctagccaggcaggctaggataggaaattattttgtctgactctttgccccccttttttcccaacaccctctgtgctgctgttcttcctcccttgactgtaagtagtgtaaccctcccttttgctccagctgctttattttcattattattgtctaggagttcctcattttcctgagtgtggaaaagattctaaagaaaagaccttgatccagtaattaattttgctcttaacatttacagacccttcctctccttaataaaaatggctaaaatacaaattgttaaattgttatttcagaatttgaaataacagtggatttttttctttaaaaaatgaacttaaaatgatcatgctatgaaagatcttagatttatttttggttctcaggtttgattaataaattatatttttcagttcattgcatactacaaaatttattaaattatctcagctgtgattaaaattaaaatgtatcttgttacattagtatgtgaaaattagttctatcctgtaaaaatactaccatattatgaataatcttttacatgcctgtaggggactaatgggaaatttagtaatatttgcatattttttccttaaatagtagtaatatttccatgttttgtttgtaagcgacaaatatgtatatatatattcataggtattttttatatgatgggagaaggttttgtatttttgttttttgcctcagcttttcccagctctagggagaggtttttaatatatctttgtagttgatcaaagttataagggatctgaacttattgatttaagctattaaagataacctttgcatacacaaagttctgttatagcgaatactggtacaacaaagagtcataacaatagagttctttaaaaaaacacactgtctttgctctcatttcccaacatgatggacctagtaatggatatggtgatctagtagccagaatattttaaaatttttatactgccaattagaataatgcttttctttaatttttgtcaatgaatgtgagtttttataaatgctcattttatactgtaaaagtagttgaactttatgaatttctgcaagattctgccactatgcgaaaacttgaatgggaggtgaagatttttttttttttttttttggtagagacatggtctcactgtgttgcccaggctggtctcgagcgaggtaaagattttaaatggagttcagctagtattaagcccactactcacttgttctgtggtactcttaacaaataatgttggattacgacagcaaaatatgtggtatagaactattttcatttttgatctacttaggacaggtattaatggacactttctcatagctcataatcatgttggtattgctgtctcttgtttgtgaaagtctgtggaaacatcagtcactactaacggtagacagtctttagatttcagcagatattcgtcagggtttgttgatgtttgtttttacatgatgaaagtccctatcaaagtaattctatctccaaaagattttttttttttttttgagacagagtctcactctgtcacccaggctagagtgcagtggcatgatcttggctcaccggaacctccgcctcccggattcaagcaattctcctgcctcagcctccaaagtaactgggattacaggcatctgccacctcgcctggctaatttttggtatttttagtagagacgaggtttcaccatgttggccaggttggtctcaaagtcctgaccacaggtgatccactcgcctcggcctcccaaagtgctgagattacaggcatgagccactgcgcccagcctgtccaaaagattttaaagttgggtgttatgttattgaaataaaattcttatataaattctcttatttactttgttagtggggaaatccagtatccttaagaatacaatcctaaaataaagttgttacatattgcagaaaggcagagtgattgtgttgttatggcaactcaaatggggaaaatgaaaacagcccagataagctgcatcctgttgtcatggcaaccacagttgtggaaatgattaaagctagcctagaaaggatgtattgcagctttagtccactgaaagtaaatagtgtaagaaaagacagggagaattggtttttgacaaaagttaaatccctctggtgccacaagttgctagtaccaccatgtgtagacagatctctgtcctttctaattgtgtttcaactcaattttattgcctcagatcataattgtgctatggaggaaagaaatgtaataactatgaaaagcttgtgaataatgatttttttggtagcaaatttagaaagcaaagttaggaaatttatttattgaaaatgacttttaaaaaatagggtgttttcctttcctctttcccccatttctcacccagtgcttaattttcatttttttcataccctgttactgtatcattttagtcttaagtgttgaattgtaatgtaaatatctaataccatggcaattggtaaggcatcacatgcagcattatgattgcctatgaacagatggatttgatgataaatgataaacatcctgtaagtgtgaataaatttattttagctctatctttcaaactttctctgtaatcaaagcttcttaagtgtttttaaaaatgccattatttccttcccaaattccacttgctcatcacagcaagatatttcatcctagtggagtggagacatgttaggaataaacctgatgaaaaccgtggtctttgttcagcagctggctgcttgcacaggtttttgtggtaatggcattggcatctctgtattagagtattgatctgctgcttggtaggtactgtgtaaaataagtcttctagtaaagatgtattaagtggtttaagagcagtttatattacaaataaggtggaagaaggtggagttctgtaagaccggacacatgctataaatatccataaaattaagtattttatctaaaaatgtgtgttgaaaatttctttttttctttttttctttttttgtttttttgagacggactcttgctctgtcgctggagtacagtggcgcgatctcagctcgctgcaagctctgccttccgggttcacaccattctcctgcctcagcctcccgagtagctgggactacaggtgcccgacactgtgcccagataatgttttgtattttttagtagagactgggtttcatcgtgttagccaggatgttctcaatctcctgacctcgtgatctgcctgccttgacctcccaaagtgctgggattataggcatgagcaactgcgcccagctgaaattttcttattttaattcatatttaattgcacatagttgaacattatctgagtgtgagttgcgtacactaataccatcatcctttgccctttagtggaggattttatatttgatgttcctgtgttgtggttgaaaactgtgttgtaaactcgtcagttataagaaataatattgaccataggaacagtgttttaaagtaatccgttgaatattttcatgaaaatccaggttgattttgcctgagcataagttggtcttcatcaataacctcttcactgtatacattgcctggttttgcctggctaaccgaaatctggcctttcatgtaggtatagagaagaaaccttttttgttttttttcttttgagatagagtctcactctgttgcccagactggaatgcagtggtgccatcttggctcactgcaacgtccgcctcctgggctcaagcgattctcctgcatcagcctcctgagtaactgggactacaggcatgcgccaccatccccggctaatttttttgtatttttagtagagatggggtttcaccatgttggccaagctggtcttgaattcctgacctcaaatgatccacccacctcggcctcccaaagtgctgggattacaggcgtgagccatcatgcctatccagaaacctatttttaaaaagaagaaaaagatggaggaggagaagggagaactataactagaatcacctttttttttttttttttttttttagaatttttaaaaagctcattcccttttgctgttatttaatggtagcaggtcatgtatgactcatgacttaggtcatacaacttaggatattaaatggttcagatacccagcaaacagttcaaagattgcattaacaagctagctaacattttgtaaaggagttcaaaatgaaagactgtcagtacctatattccgtgtgcctagctgttgttgccccactggaatgtcacaatgcaaggatgtgaatctccctttctcctaacagaagtttttaaagctaacagattttaatagatttgcaaacagaagtttgcaagcagaagtttgtaaatctgttaaaatgttttacattaaaatttgatgcactgatttttagattggtgtctaaagtaggcaatatcatcaggttgtgcatttgagatttaccagtttacatcttggcttatgataaattggattggaagatcaggtactttattttcctggaagaaaaaaaaattaggtatattcatcattcccatttcacaatttcttgtcatatctcacttgcttcagaaatactcattttggatccttcttgtgaatatgtaactcttaatactaatgtcctgagagaaaggagaatttcttgtctaacctcagtaataaccataccatcacaaaagaaggcctcacaatgtatcaggcaatcaaatagccaataacctattctcctgctaaattccataaactggatggggagggtagataatgttcatttttgttacttaccagggaacatgacacttggtctttgaaattgttatttatttcatatattgtagctgccaatcagtcagtgatttgcaaatagcaaagtaaatacactgctgaaaatgagtttcttctttgtgctgatctgtgatgtgcgggaaatcagatgtaatatggttgcatttatttatgtaggcatctattctctttcttaatgagcaagtaattttcttttctctacttctacacaaaagttaaattaaggagtacccaagagggctgggaaacttggtttgcagtcattgaaatactgctgagtatcgggatcctttcatgagtggagtttccctctccttaagaagaaagctccagatagctcccttttgaactcattgttagagcaaacacatctgtagaggaagatgatccataagtctaatgctaaggatttgcctcctctccctatcaatgagaagggtttgcctcctctccctgtcaaaggattttactctggcttatttggctgtttttgcctgggaagtgaggggcaagagctctgatctttcctatgacggccagcctggccttaatatgtagattattaacatgataccagcctctgttgagtcatagcaactgctatgaacaaacatgtaaatccatctaggggaagaaaagagtgttgcaaatgcctttcatcaaaatggaagactacttcaacttctatttgctcttcttgttataaccaagctttttcttttttcattttcctctgcctttctttccctccttttttccgtccccactatcctccatctttcagaaatatcaaaagctgaatcttcccaccgaacactgcaatcatttgaaatttgtgtataggccagcttcacatcatcagaaattgtgtaaccccatgattcccaggcctcagctggtagtgtagttatttcaaataatatttaatacaataaattctatggcaataaaagaatttggacagtcccttcgaacttattgcaatgagatttgacttgaatttaatacaatgaagtttcagaatagccaagtaattttgttgtggcatgatttaaagggtatttaagtacaggtataggtgattgagtttgtaaaacctaatcagaggtaaattgcagttttactcttatcacgtgaatgagcattcaaaaatacagaaattctttacttagcataaggtgatttttaacagtgtggcaaagagtgtaagtgaacatccttaactttttgttctgtcaaggggagaataaagataccacctggctgtatgtataaatttgcttactaagatggttgattgatttcttttaggtgggtattaaaagtggcttttttggtatagaaaacatgtagcatcaaagcagtgttgtgatgccctgctgtcttctgatgttgaatattttatgggattaaaaacaattgtttttatcttactctttcagattcaacaatcttatagtaaaagcagccatagactaaatatttagaatttattatgctgatacaaatgaaagaaacataaaatacaaatattgagtgaattaagaaaaagaggctgcttgcagtggctcacacgtgtaatcctggcactttctgaggctgagtcgggaggatctcttgaggccaggagtttgaggctgcagtgagctatgattatgccactgcactccagcctgggtgacagagcgagacctcatctcaaaaaaaaaaaaaaaaagaaaaagaaaaacaatgtttctttctagagtgcttagcagggcaaaaaaagaaggaaaaaagaaaaacagaatgttgatgttagaaaaatttggttattgtcttatgctctggagttcttacctcaagccagtgacttttaagatctgttgttttctgtactgaagcagaatagtgaaaatgtttttataggaagttatgaaaaaaagtctatattaatttgctttgggtcattctagtctctctggtaaattcataattaggaaggcctttttaaggctgtatgctagtctcacaggtacacagctacttcatatctgataaatctaaattcatatgtgaggaggttatgtttttttaaagcatattatttacacaattcactggaatggctcctttggaagttgggtgactctcttatgtaattatatacttagtaaccctgctctacaaagcagtagaaattcaagtaagaataatttactgcttatgcatagttattagaattttaaagcatttgtttgttcaaaattctagtttatcagtgttgtatttgactaattgcctacttaataaataatgaatataatttattttagaaggcacccaaattttaacaattgtaaataaacattaggagctgctccccctcttcgctttcttgtttaaagggattctcatccctttagtccaagtttcgtggagaaaataattcctatcttaaaaattctatattagaagtattatagatggacttaaattacagaattgtggaattttattgctgtaaggtagttagaaatatcttattctatccattttaccagcaaagaaggtgaagtgtatagaaattaagtgaacttctcaaagtcatacaattggtttgaggacaagtctgttccacaacctgatatgtcatgccttctcagttgtcatgataattcagcagttcatttcaccagggattccttgaacactgctgtgtgtacaacagtgggctaagcatccagaggttgtaacaatagtgtgagtttatatggtctaacaataatgatatcagactagtaatattttacatttgaatctcagttttatctggtgttttctaatgtttataaatgttaatgtgtggtggctaaacctttaaatctctttttctctactagattataacctctttaaaagcagggactcatttagcttttgtaaagtcaatccagtttcatttttaaagacttaaattaaaatttctaagcattgatggcattgttggaataaatgtagcttcctgaggtgtcttctctggggacgatacacattttaaaattgtatttctgttttcatcaagtactttccatttcaagtaacagattgcttcattccccctttaagcaagaagggagagtattttaagggtacagagatagctcatggaactaaagggaaaaagatggccagtaaggccccataaggacttggaaccaggcattggaatacctttaggacacaaggcagccgcccttgcattcctaagataaatcctacttagtcatggtgtatattcctttttctgtgttgctggattttatttgccattattttgttgaggatttttgcctatatggccataagggatattggtctgtaatctccattctgctgttgagaccatccagtgagtttaaaaattttattttcagttttctcattcccatttagttcttcccctgaccccctttttttacttccccactttgagacaggtctagctctgttgcccaaaccagagtgcagtagcatgatcatggctcactgcagcctcgacctctcaggctcaagagatcttcccacctcagcccctcaagtagctgggactacaggaatgtgccaccaggcttggctaattttgtaagaaattttctgtagagacagggtcttaccctgtttttcaggcttgtctggaactcctgggctgaagcaatcctcctgccttggcttcccaaagtgctgggattataggtgtgagctactgcacctggcccatttagttctttatatctgttgtttctttgctggtactctctttctttcaagagtgtttttagttattggaacattttaatcctatctatgtgtatgtgtgtgtgtgtatatatatatatatatatatatatatatttttttttttttttttttgagacagagtctcgctctgtcacccaggctggagtgcagtggcgcatctcagctcactgcaagctccgcctaccgggttcacgccattctcctgcctcagcctctcgagtagctgggactacaggtgcccgccatcatgcctgactaattttttgtatttttggtagagacggggtttcaccgtgttagccaggagggtctcaatctcctgaccttatgatccgccctcctcggcctcccaaagtgctgggattacaggtgtgagccaccgcgcccagccaatcctagctatattacagtctttgcctttaaagttaatttcaccgtctgtgccatcttggtattggcatctgttgataccagttgaagttttcccctttttagtataccaagtaatttttgcgttatatccttggcttttttaatattatgcaactcagttttgtttaaattgtattgaaaatgttgatatttttgtcaggcattcaacccagttggcttcagtctacaagttgagatttctgtaggattgtgggttcaatgtctgttacattttgaaagcctttgcagttctattgagatatattccatgcgtgtgccacttgatggccattgtggaatctggatgatagtccatcttgtagttcagttctcaaagtctatgcctggccgagtgcagtggctcacgcctgtaatcccagcactttgggaggccgaggtgggcggatcacgaggtcaggagatcgagaccatcctggctaatatggtgaaactccatctctactaaaaatacaaaaaattagccgggcgtggtggcgggtgcctgtagtcccagctactcaggaggctgaggcaggagaatgggatgaacccaggagacagagcttgcagtgagcctagatggtgccactgcactccagcctgggtaacagagctagaatccatcttaaaaaaaaaaaaaaaaaaaaagtctatgccttactgttttgggttatatccacccatgtgcagcttgggggtgaacataggagttcattaaccactttatggggccattttcttgagttcctccctctgtacaatctccccagtactatctggttccctggggccgcctttttcagtcctccagccagaaagctaggactttatttaatcctgcatctgttactgcatatggggctacgcaatgggaggctagaggaaaaaaaaaaagcaatgaggttttgtctcacccttttaggatcacaactcctctgatcagagaggaaggtttccttacttcagagttttagccttctttgggtctctgcttctgctgtggctttcctcatggaattgctttgagagaatagcaagaactttaaagaaaaatgggagatttttgccattctctctgagtgttacgatactccttctgcactccttaagctagaactagagggcttttcctggagctctctttactgacaccaatacccacttgtgggtttcaggcagcagtccaggctggtggatactggaggaataataaaaagataaattcattattggttcagtgttatgtaaaagtcttctccaattacctgctagtatttaattttttgagtcttcaaatagttgttctatatgttctgtccatttcttagtggttgccttcagtgggaaatacaggatggagtgcacttactccatcttacatggaactagaaccccttctagttaattatccttttgatattgatttatgctagtcaacaacatacactgcaagttcagtcctttgaacttccttcatggcccatcttaaggtctgttttggtaaagtgtagcaagtgtgcttgaaaagaatgtgtgtgtatactgcagttgttgggtgaagtgttctagataaatcattacatcaagtttattattactgtgcttgtcacttctttgttgcttattctatcaatagctgagagagttatgttaggctctcaaactatgtagatttgtgtattttccctttagttctgagttttttgcttattttgaaattgttagtagtggtacatatacttttaggattattctcgatgaattaacctttttataattatgaaatagtcctctttattactgcttatacttttttttttttttgagatggagtctcgctctgtctcccaggctggagtgcagtggcgctatctcagctcactgcaagctccgcctcccgggttcatgccattctcctgcctcagcctcccgagtagctgggactacaggcgcccgccactacgcccggctaacattttgtatttttagtagagacggggtttcaccgtggtcttgatctcctgacctcgtgatccgcccgcctcagcctcccaaagtgctgggattacaggcgtgagccactgcacccggcctactgcttatactctttgttccgaggtaaactttcatgttaacatagccatctcaggtttcttttttttttttttttttttttttttttgagacggagtctcactctttcacccaggctggagtgcagtggtgtgatcttggctcactgcacctccacctcctgggttcaagtgattctcctgcctcagcctcccaagtagctggagttacaggcacgtgccatcacagctagctaatttttgtgtttttaatatagacagggttttgccatgttggccaggctggtcttgaactcctgacctcaggtgatccacccacctcagcctcgcaaagtgctgggattacaggcgtgagccaccgtgcccggcctcagctttcttatgactgtttttatgatacagcttctttaagctttttacttttaatttattggtatacattaatagataattgtgtcggtttttaaattaatcatctgtcctgatcatctgtcctgatcatctgtccttctttgtttatacttgcactgtccaatagaaacatttaccacagatgccaaccaagtatatacttttaaattttcttgtagccacattgaaaatgtgaaatgaagctgggcaaggtggctcatgcttgtaatcccagcgttttaggaggccgaggtgggaggatcagttgaggccaggagtatgagacctgcctgggtaatatagcaagaacttgtctgtaccaaaaaaattaggcgtagtggtatacacctgtagtcccatctacttggaaggctgaggcaggaggatctcttgagctcaggagtttgaggttctagggagctgtgatcataccactgcactccatcctggttgacaatgagaccatgtctcttacaaaaaagtgaaaagaaagttgaaattttcataatgtattttatttaacacaccgtaattttttatttttgtttttatttctttggaaacagtctcgctttgttgcccaggctggagtgaagtggcgtgatcttggctcactgcaaactccgcctctggcttcaagtgattctcgtggactacaggtatgcgccactacacccagctaatttctgtatttttagtagagatggggttttgccatgttgcccaagctggtcttgaactcccgagctcaggcaatccgcccaccttggcctcccaaagtgcaagatgacaggcctgagccactgtgcccagcctaacacagtgtagtttaaacattaatttttttctttttctttttttttttttgtgagacagtctcgttctgtcgccaggctggagtgcagtggcgcaatctcggctcattgcaacctccacctcccaggttcaagcaattttcctgcctcagcctcccaagaagctgggactacaggtgcgtaccaccatgcccagctaattttttgtatttttagtagagacagggttttaccatgttggccaggatggcctcgatctcttgacctcatgatctgcccacctcggcctcccaaagtgctgggattacaggcgtgagccactgcgcctggcctaaacattatttcaaaatataattaatatagaattatgaattagatatttcacttttttgtattaagtttttaaaaatcaatgggtattttaaagttgtaacatatttcaatttggactagccaccattcaagtgctcagtagccgtatgtgactagtggttattgtattggagagtatgtttagaccatacatttagtgtagtgatcagtatggttaaatttaaattgatcattttgctatttatttgttttttcccatctgttctttttcttctttttttttaaatttattttctttttctgagacagggtctcactctgtcacccaggctgaaatgcagtggagtgatctctgttcactgcagccttgccctcccagcctcaagtgatcctctcatctcagcctcctgagtagctgggactataggcatgcaccactatgcctggctaatttttgtattttttacagagacagagttttgccatgttgcccaggctggtctccaactcatggacgcaagcgatctgccacctgggcctcccaaagtgttagaattacagttatgagtcactgggcctggccctttttgcctttaaaaaaattttcctgctttcttttggatttattttttgttactatttaagtattccattttatgccttctattggcttactaggtacctttgttttgttttaatgattgctttagaggtgacaatttgcatggtaaaatattgaggttggccgggcacagtggcccacccctgtaatcccagcatttgggaggctgaggcaggtggatcatctgaggtcaggagttcaagaccagcctagccaacacggtgaaaccctgactctactaaaaatacaaaaaaattagctgggcgtggtggtgggcgcatgaaagcccagctatttgggaggctgaggcagggcaatcgcttgaaccggggagacggaggttgcagtgaaccaagattgtgccactgcactccagcctgggcgacaagagcaaaactccatctcaaaacaaaaacaaaaaacaaaaaaagccacacaaaacattgaggtaaagttcacataatataaaattaaccattttaaagtgaacaattctgtgtagtttagcaactactacctctatgtagttgaaagacatttacatcattccaagtaaaagcttttatccagtaagcagtttctttctattcccttccttcagcccttggcaatcaccaatctgcattctgcccatatgaatttatctattctggacatttcatataaatggaagcatacaatatgtgactttttgtgtatgacttctttcacttaccatatttttgaggtttagtcatgttatagcatttattagtagtttatttttatggctgaataatattccattgtatgtacatacagtcatgtgtcacttgatggggatacattctgagaaatgtgccattaggtgagttcaacattgtgtgaacgtcatctagtgtacttacacaaacctaggtagtatagcctactatatacctgggctatatgttatagcttgttgctcccaggctacctggacagcatgttactgtactgaatattgtaggcagttgttacacaatagggagtatttgtgtatctaaacatacttagacatagaaaagatgtagttaaaatgttggtattatcatctgtgggaccaccatggtatatgcagttcattgttgactaaaaatgtcattgtgcagtgcgtgagttaccagaatttgtttatctgtttattcgttgataagtatttttgggctgttttcaaccttttgccaattttgaataatgctactatgaacatgtgtatacatgtatttgtttacctgtttttaattctttggatatatacctagaagtaggtatataccaaaattgctatggtagttctgtgttttattttttgagacactgccaaattgtttcccgtggttactgaactattttatattcccaccagcaatgtatgaaggttccagtttctccacatccttgtcagcacttgttattttctgttgtgggttttcttgttttaattgtaacttcaaaagcttttgagactggacaggagtttactgataaagcttcttctagtacatctggatttcctggtatgcttctctcctaatatatctggatggctgctttttagctttctttagttctttttttaaacttaccatactagtgggtgtgaagggtacattatcgtggttttgattttcattttcccaatgaccgctgatgtcaagaagagtaccctggctgcgcagggtggctcacacctgtaattccagcacttttggaggccaaggtgggcggatcatgaggtcaggagttggagaccagcctggccaacatggtgaaaccccgtctctactaaaaatacaaatattagccaggcacgatgatgcgtgcctgtaatcccagctgcttggaggctgaggcaggagaattgcttgaatctgggagtcggagattgcagtgagccgagatcatgccactgcactccaacctgggtgacagagcaagactctgtcttggacaaaaaaaaggaagagtacccttttaatgtgctgttgagagtaatatcttttcagttattttgcccattttttaattgagttgtctttttttatttttttgagttgtaaaagtatattctggatagtcaactgttcttagagatatgatttacaaaacaatatgcatctttaacttaacacagcctggaaatatttcacttcacatatactgtattttcagttttctacattcctatcctttgtgttattattgtcatacgttttgttttcatgtatattatgaacactgtaacttattatttttgcttaaattgcttactttttaaaaaaattttaaatgaaacaattttaaaaatattgacatttgtatttctggcactttttttttttttttttttgagacagtgtcactctgtcgcccaggctaaagtgcactggggcaatctcagctcactgcaacctctgcctcctgggttcaagcagttctcctgcttcagcctcctgagtagctggcattacaggtgcaggcccctacgcctggctattttgttttttcagtagagatgggatttcaccatgttggccaggctggtctcgaactcctgacctcaagaaatctacctgcctcggcctcccaaagtgctgggattacaggcatgagccactgcacctggccatttctggcactttttatagttttgtatgggttggtctattatcattcttcagatatatttggaaatatgcattttccaaatatattttctgcttctgcccatccctgttctctaattttcttttgagacaccagatatgcatgtgttagaccacttacaatttcctataggtcactgaagctttgttcagtttgtttccttagtcttttttctcttagtgctttatttttgcttcctcgggttcactgatcttctacagagtttaaatgtgctgctagtcctatttcatgaaattatcatttcaaacattgtatttttcattctggaactttttatttcattctttttttataccctacatcactatgttcatgttattatagctgttttaatttttaggtctgctaatttcattgtcagtttttttctgggtctgcttccattgactgatagtcctcctagttatgaatcatattttgtgcctcttgtcttgtaattttagatttagttgtagacattgtgatattacatttttgaatatttgtattttaaaaatctttttaaaaggatgttgagtttattttggtgctcttaagttttttgcagatcaacttgatgctcttgtggctgattttaagctttattctgatagttttagtgtagcttttattctagtgtagttcatcccagcaactgagatgtgagctttctaaggctcctagtgaatgtcataagtattcattaggcttctgaaatctgaccagtcagaacagaaatgtgccccaggtctgtgtagtttctagttgctgagcttatagttctgttgtagttttttgcctagtgttgtggaatttcactgtatgtatacaggacttagtattcaggaactgagtcaggggtgtcctattcaggtatttggaacctttttctacataattcattcttcagtattctgcctcactaattctttttagccttcatgtattttgtttcctcaagtaagtggtcccattgtactctgtttgagttcccctttcttgtgcagcagcctggacagtaccttcgggtagaagactaggataattttaagggtcaccttatttgtttcccgtcattcagggattacattctggcattgtttgttgttcagtgtcttgaaatatatgtttcacatattttgttcagtttcttgatggtaggaagataagtttgataccaattattgccttatggtagaatctaaagtctagtgcttgtttttactttagagtttaattttatttaaacttaatgtactagaagtcctcatattacatatttctaatgtgcataaatttcagttagcacaatttagttaagtgacactagtcacccaataccatggttccaatttcagttaccatagtatattaactatgagtaactatgtaaagtacaaacttcattgctagtactccagtccacacatgactatgtgaaaaacagatacacactagtctatttacttcaaggtctgttggcgattaagtttatatacagacaataaagtgtctagttgtattgtctttcccaatgttaagcccacatgatattttatagaaatagataatcaaaagtggaaattggccaacagatatgaaacaaagtaacaaaaaatgataaccctttcattgaaatttgagagaaatgtaaatgaagttatagaagaaatagttgaccataggaaaattgacactgtcaccatttgatagactctagatatgcagccagaggaacttattgaaggtgaacttattaacataaatgagggaagtggtttttttgtttgtttgttttgggtttgtttttgagatggagtcttgctctgtcgcccaggctagagtgcagtggtgcaatctcggctcactgcaacctctgcctctcactgcaacctctgcctcctgtgttcaggcaattctcctgcctcagcctcctgagtagctgggattataggtgcccaccaccacgcctggctaatttttgttttgttttgtttttttgacagagtctcgctctgttgcccaggctggagtgcagtggtgcaatctcggctcactgcaggctccgcctccagggtttacaccattctcctggctcagcctcccgagtagctgggactacaggcacctgccaccacgcctggctaatttttgtatttttagtagagatggggtttcaccatcttggccaggctggtctcaaacacctggcctcaggtgatccacccgccttggcctcccaaagtactgggattacaggtgtgagccactgcacccagcctgagggaagtggttttgatgcaaaagatgaagatgtcccagaggaaatctttacattaaaggaaaaaaaaactttatattaaaagaccttgagatatttcacaaaattgaaagtacaaaggataaaatgttagattgtgaccttgctttgtttctaatcttctcttaaaccaatctaatgaattcttaatttcaactttcgtgtttttttatatacaggattttcatgttatatattttaaattttagattccaattttctggtgtaactttttaatctgttttgttgaatatcttaaatatggttattttaaagtctgtgattacttatcacattgggggctgttgtttttaactgtgttaatatgtacataccataaaattgaccatcttaaccatttttaagtgtacaattcagtagttttagcacattcacatcattgtgcaaccagtcttcagaactttttcctcttgcaaaactgaaattctatactcattaaataacaactccccattacccatcacctctcagctcctggcaaccaccatcctactttctgaatttgactactctaggtaactcatataagtggatttatacagtacaggcatgcactgtataatgacatttcagtcagtgatggactgtgtacacgatggtggtcccttgagattataatggagctgaaaaattcctatcacctagtgacattgtagccaatgtaacgtcatataatgcaaggcattattcaggtgtttgtgttgatactggtgtaaatgaacctgctgcactgctagtcataaaaaagtgtagtacatactattatgtacagtacataatacttgataataaacaactatgttactggtttatgtacttactgtacagtattttttattgttattttagagtgggctacttctacttattaaaaaaaattaactgtaaaacagcgttaggcaggtccttcaggaggtattccagaaaaaggcattgatgtcataggagatgacaggtccatagatgttaattgctcccaaagaccttccagtgccataagctatgaaggtagaagacagtgatattgatgatccttgctctctgtgggcctaggctaatgtaatgtgtgtgttcatgtgttggttttcaacaaagatgtttaaataatatatataatatatattttttaaataggaaacaacttataaagatgtaaggaaaaatatttttgtactgctgtacaatatgtttgtgttttgagctaaatgttattacaaaagagtcaaaaagtttttaaaaactaaaaaaatttataaagtgaaaaagtcacagtaagctaagtttattactaaagagacaaaagtatgttttaataaatttagtctagcctaagtgcacagagtttattggccatcttaaccattataaagtctatagtagtgtacaataatgtcctagaccttcacgtttattgaccactcattcagtaactcacccagagcaacttgcaatcctgcaacctccattcatggttaagtgccctatataggtgtaccattttttatctttttgtctttttttttgagacaaggtcttctgttgcctgggctggagtgcagtggtgagatctcggcttacttcagcctccacattccaggctgaaatgatcctcctgctgcagtctcccgagtagctgggactacaggcatgtgccaccatgcctggctaatttaagtattttttgtagagatggggtttcaccatgttgcccaggctggtcttgaactcctggactcaagggatctgcccacctcagcctcccaaagccaccacacccagccaccacttttattttattttattttattttattttatgttatgttatgttatgttatgttatgttatgttatgttatgttatgttatgttatgttatgttattttgagacagagtttcactcttgttgcccatgctggagtgcaatggcgtgatctcggctcactgcaacctctgcctcctgagttcaagcgattctcctgcctcaaccttctgagtagctgggattacaggcatgcgccaccatgcctggctaattttgtatttttagtagagacagggtttcatcatgttggccaggctggtctgggactcctgacctcaggcgatctgcccgcctcagcctcccaaagtgctgggattacaggcatgagccactgcgcctggcccttttaatcttttatactgtatttttactgtactttttctgtttagatacacaaatactttccactatattgcagttgcctacagtattcggtacagtaacatgctgtccctgcttgtagcacaggagcaatatgctctacctatagtctaggcgtgtggtagtaccttctagatttgtgtaagtacactgtgatcacacagccgagaaatcacctagtgatgcatttctcagaatgtatcccctttgttaagtgtcacatgactgtatttgtctttttgtgactggcttatttcactcagcataatgtcctcaaggttcatccatgttgcagcatgtgtcagattttccatcctttattaggctgaataatattccattgtatgcatatactagattttagttatctacccatctgttgatggccatttgaatctgtctactttattgtttgccttttcccctggtttttgtttgttttttaatttggccatttgatccctttgctttgaatgcttcgtaattattcattgagagctagatattttttaatgaaaatgttagagactctgaaatcattcttcacagggtgttgaatattcttttcacagacatatccctttggttcagttgaggcatctctgtttttggtgcccttcattgttctggttcatgtgactcttccatggtgtcaattgaaagcctgagttgttgttgttgttattgttgttgttgttttttaccagggtaccttgtcctatatgcaccctatactccagtctttggctccacagcatcatgagactgctgaaatacacttcagacttagtttttcagcatcttactctctgcgtgtaaaatttaggagtcaggaaatgccgtaggggaaaaattatacccagaatatcaggttaaccgtaatgcatttcccttctgcctaggatctttgcccctaaagttttggctgtattagttgttctctctctcatggcttccattttctatattttatttagcttctataattttctgcatgaaatttagtctgataataattactacattatgaccaaaagcaaaatcccagtatgtatttttattaatttatattccatgttttatttttaaacattctcaaactacagaagagttgtaagtaaaatgcaaattgttttttttttcataaaccacttgagaataaggttctgacatgatgtcccatcacctctgaattctctgtgtatttcctgcaaaccagaacattctcccatataacccaataacaaccatcagaattaaggaaattattattggcatattattttgtcatctaatccacagatcccattcaagtttctctagtaatctcagtcaatgtcctttatataatagaataaatatctagttcaggatcacatgatacatttagtagtcatacctctttagtctcgtttactctggaacagttcttcagtctttccttggctttcataacattgacatttttgaggattacacgccagtatcttgcagaacatttttcaaattgggtttttctgatgtattctcatgattagatccaaattaggtatcttcgacaggaatatcacagaggtgatgttgtgtttttattgaatagtatcaggtgacacataatgtgaatttcttccaatattagtgatattaatgttgattacttgattaagatatcagggtttttttcccactatagaattaactttatatttttccaattaaaacgaagtagtattttgtggggaggtattttgagactatttaagtatcctcctccttatcaaacttacagtttatattttgtttcattttattttatttcattttagagatagggtcttgttctttcactcagggtggagtgcagtggcgtgatcctcattgtaactcctgggctcaagtgatcttcctgctcagtctcccaagtagctggaactacagatgcgtgtcaccatggcttctttttttcctgttaattctttttgtagaggcaggatctcaaaatgttgctctgactggtctctaattcttggcctcaggcaatctgctgggttacaggtgtgacccaccacacttgtccccagtttattttttatgtcattaatggagtcatagatttcaactttattcagtggcttattttattagttatctattattacataacaaattacctcaaattgagtggcttataataacacatacatttaggctgggcacagtggctcacaccagtaatcccagcactttgagaggccgaggcaggtgggtcatttgaggccaggagttcaagaccagcctggccaatatggtgaaactccatctctactaaaaatacaaaaaattagctgggtgtggtggcgggtgcctgtagtcccagctactcaggaggctgaggcaggagaatcgcttgaacctgagaggcggaggttgcagtgagccaatattgtgccactgcactccagcctgggtgacagagcaagactctgtctcaaaaaaaaacaaaaacacagacatttatatttttttgggggggtgatttacaagtgagttgtatttaaactttaaatggcgaatagttattacaatattaaatttttcaaaaatatatagaaaaatgaatacttaatacttattttcaataaatttttatgagctccagtatttcagagtgccacctcccaaaatgacagcatgatataccttggcaatagtttagacctcttctagaattttctcacatctgctttttttttgccaaacatatatatgtttatattttttctccctggctgtattgctgtataattggcaaacaaaaattattattattattatttttttattctggggtacatgtgcaggatgtgcaggtttggtacgtaggtaaacatgccatggtgttttgttgcacctatcaacccatcacctaggtatcaagcccagcatgcatcagctcttttccctaatgctctcccctgacccgccctcctggcaaacaaaaattacatttaaggtgtacaacatgttgttttcatatacatattcattgtaaaatgcttgtctcaatcaagctaattaacatatctgtaacctagcatacatgtaacatctcacagtttcttttctttctttctttcttttttttttttttgatacagagtctcgctctgtcacccaggctggagtgcagtggcacgatcttggctcactgcaacctctgcctcccaggttctggcaattctcctgcctcagcctctggagtagctggaattataggcacacaccaccatgcctggctaatttttatatttttagtagagacagggtttcaccatgttgaccaggctggtctcgaactcctgacctcaggtgatccacccacgtcggcctcccaaagtgctgggattacaggtgtgaaccacttcgtctggccagtacctcacagtttctttcaatcaggagtctgggcacagctgacctgggccttctgctttagaatctctctcacaaggccataatcaaggtggtgtctagggctgaggtctcatttgaaggttttatttcgagaaaaagccacttccaagcttattgttgttggtggtggtggaattcttttcttcaagggctgttggactgagcctcaattcttagttgtttgttgactgggtcaccgccaggtctgtgccatggggacatctacagtatgactgcttgtttcatcaaagcgtgcaaaccaagaaggcaatagagtctgttagcaagatggaagttgcagtcttaacctaattaggaaaatggcatcacatcacctttaccaagggcatgcataccaagcggtgggaaacatcggggggcatgttagagtttgcctgctaccgttatccattattatcattatttagtttgatattctaattttctcaaatgtagcctgcctcagtctttcactctggcccctgtattattttgacatgtctctgtcattcattgagcacctcaagaagatattccaagctcctcttaaactttcctgtccaagccctcgcattgttctaaggagctctggttccttttagtggagagtgatattttgaatcattaaatgtgtttgttgctattaggttgctcctaggccctctcagttggtagtcagtctgtgtgtgtctgtgggtatatgtgtacatatatatatatatcatgaatatattatttacctaggaatttctcggtgtaatacattgtaagatttcagcttacaacaacatcctcaattctagttcagcaatgtaatattcattctagttttctttctttctatacttgtaacttgtttttctgattatgagaaacctagctcttattatcctttgtatttgatctgccacctttatttgatcaatcttcctgtataatccatctcctgttgctgacatatctctcgctccatttctcaccccatacttcatatgcatgcctccctcacccttttgggatccgacagcttgcacttggctgccccttccaccctcctcactccactgggtctgaaactcactgctggaccactgcctctccctctcttaatgcatgccttcttctgccgacatgggcaaccctcactgccatccccccaccctccactgccctgtgtggatgtggacatcctcatcattctgctcactgctgttacagttcctacgtggtagccttccttgttccattagggctctgtcacctcatgctgggtccccctcccagcagattttttcctatcactctgcttagtccctgaaactctgtgccctgtccttttccctctcgggaatacccttttcctactacttggactccaaaagcctgttttgggccactgtagtcaactctctgccacttagcttgatgcctcctttgcctgtactcacctattgaactgttcaggtaggaaaggagaagagggagaggtatcagttaaattttatttttgaaaaactcactggtatttttacaacaaatgcttttaacttagtttgttattacttacatagaagtcagttactcccacatctctgtaatcgctacaggtttatactcatattttcatgccatatttttcttacatactagatagaggtttactatcacatcagattcatgatttctgaacttggttactccctgcaccctccaaacgagtttcagtttaccagtgtctgtcactaccactactgttcttctagtcattcaagtttgaaatgttgaagttaattcatttttccttatgatcagttatccagtcctgttgatccttcttttgatgtacgttatcttctccatggccattactttaatgaatataataacctcttgggtgcgatttctttatttagtttgtgtagtcattcctgtgcccctaaaccattttggcttcccatttcttaatgagtgaagtaactccatgtttaacttttaaagtgccattttaatgtaacactattctagatagtcagaatatctagttttgactcccatctttgttgcttactaactactcatcaacgtgtaatttatttaacctccctgggtctgtttatttttattttattatactttaagttctagggtacatgtgcacaacgtgcaggtttgttacatatgtatacatgtgccatgttggtgtgctgcacccattaactcgtcatttacattaggtatatctcctaatgctatccctcccccctcccccctccccccaccccacaacaggccctgatgtgtgatgttcctcttctgtgtccaagtgttttcattgttcaattcccaccaagagtgagaacgtgcagtgtttggttttttgtccttgtgatagtttgctgagaatgatggtttccagcttcatccatgtccctacaaagggcatgaacttatccttttttatggctggctactattccatggtgtatatgtgccacattttcttaatccagtctatcattgttggacatttgggttggttccaagtctttgctattgtgaatagtgccacagtaaacatacgtgtgcatgtgtctttagagcagcatgatttataatcctctgggtatatacccagtaatgggatggctgggtcaaatggtatttctagttctagatccctgaggaattgccacactgtcttccacaatggttgaactagtttacagtcccaccaacagtgtaaaagtgttcctcttctccacatcctctccagcacctgttgtttcctgactttttaatgatcaccattctaactggcgtgagatggtatctcattgtggttttgatttgcatttctctgatggccagtgatgatgagcattttttcatgtgtctgttggctgcataaatgtcttcttctgagaagtgtctgttcatatccttcacccacttgttgatggggttgtttgtttttttcttgtaaatttgtttgagttctttgtagattctggatattagccctttgtcagaggagtagattgcaaaaattttcttccattctgtaggttgcctgttcactctgatggtagtttcttttgctgtgcagctctttagtttaattagatcccatttgtcaattttggcttttgttgctatggcttttggtgttttagacatgaagtccttgcccatgcctatgtcctgaatggtattgcctaggttttcttctagggtttttatggttttaggtctaacatttaagtctttactccaccttgaattaatttttgtgtaaggtgtaaggaagagatccagtttcagctttctatatatggctagccagttttcccagcaccatttattaaatagggaatcctttccccatttcttgtttttgtcaggtttgtcaaagatcagatagttgtagatgtgtgttattatttctgagggctctgttctgttccattggtctatatctctgttttggtaccagtaccatgccgttttggttactgttgccttgtagtatagtttgaagtcaggtagcatgatgcctccagctttgttcttttggcttaggattgacttggcaatgcgggctcttttttggttccatatgaactttaaagtagttttttccaattctgtgaagaaagtcattggtattgatattgattcttcctatccatgagttttttttaattaagttaaattttttttattttccagtttttcataaaaatagagatggggtctagttatgttgaccaggctggtcttgaactcctggtctcaagcagtcctcccaccttggcctcccaaagtggtgggattatacacatgagccaccttgcctgaccctctctgggtcttatttaccttactagtttattatacaggtgaatgaattggggaagagcttgttccgcaattcattgccaaacaatgaattgttagactgacaaagctaactaacaaagcttgttagtttgttatacagagaatgttatacagatgcagcttgttagtttgttatacatatagtaacaagtgctacaataaaattaaagtctgtgactgagcttttctaaatatttgaaaatttacctaaacttatagtagctgttgtctaatgcaatttagtacattgttaaattttttcttgtagttactatttgttagtagtttatctccttgaaatagagtgtaaactacttgagtctgtggatttgtggagacaaacacatttgagtattatttctgccattgtcatttaggcactataacttcactgaacttgagtgtactctcttgttaaggcaaaagtactaataattctttgacaagaaggtaatgcttaaatgaaataatgtacttaagggatctagtacaatgcctggcagacagtttattcccggtaaactttacttatcctctttttgtactccacctgtgcccactttggtaatgaaaaaataaatggcttcccagaacagtttgaaatgcaagtggcattcacagaagcctattcctggtgatgatgccatttatatttttttcttttgcactttgcagcttttagaatccttattttagccgggtgaggtggctcgtgcctgtaatcccagcactttgggaggccaaggcaggtggatcacctgagttcaggagttcgagaccagcctggctaacatggagaaaccctgcctgtctctaccaaaaatacaaaaattagtcaggcgtggtggtgcatgccggcagtcccagctactcaggaggcttagtcaggaaaatcacttgaacctgggaggcggaggttgcagtgagccgagatcatggcattgcactccaacctgggcaacaaaagtaaaactctgtctcaaagaaaaaaaaagaatccttgttttagttttaccacaaccttgtgcaataaggctgggcagatatgattatcctatctgacaggtgggagttttgtttttggagtgaactaaattgggattcttaagaggcaatcattggatttgtaggtaaagtctgaatgtattacatgattatggtatactgcatttctctgaatttcttagttgatatagtagtgaaaagggaattcttctattccatggcttaaggatacgtaaactctcagtacagcaatctttttattgttgattattatagcttctgttactcctagaagttgaccaacagggaccttaatttaggagattttgtcattcagctttcgtatagtaaatgctgaggctagccctttgcctgcagggctatcagtgaagaggatctgtgacattactccagacagccaagtgtagggggaagagttgagattttcagtgttctctgtgtaaatgaattgtgccattgaacctgatgggcactagatactatattcttcttgaagcactggaggcccttcattgcaatcttgttttttcaacttttattttaaaattggggtatatgtgcaggtttgttacagagatatactgcacgatgctgaggtttggagtctgagtgaatctcacccaggtagagagtgcaaagtacccataggtagttttttcaagctttaccccctttgtcctcccaccttttgtattcctcagtgtctgttcccttctttatgtccatgtgtactcaaggttttgttcctatgtataagtgagaaaatgtggcatttggttttctgtttctgcattagttcgcttaggataatggcttctagctgcatccatgttctgcagaggacatgatttcattattttttatggctacttagtattccatggtatatgtgtactgcattttctttatccagtcttccgttgatgggtacctgggttgattctgtgtctttactatcgcattgcagcatttcaattttttttctgattcaggtagtagaaaacatgttcagtcttatttttttctgtgctgtgtatgctttttaaaggctagtgaagtcattcagttggataacaacaattataatacattgttatactcttcaactttctttgattttgcaaaggagagtcaattggggtgacgttaggtgggaactgagctgaagaaactaatatgtgctgtgcagggctggatttgtgtaggatgcagtcattatctgttaactttgtcatagcttttgagactgcatgtaaggagtaggtgatttgcaagttatttaacagttaacagaaggtaaatatttaaacaggagaatgcgtagttgctgcttagtttaaaacctgcttttttttttttttttaattaaaaaaaatgttttttagccaggcgtggtggtgcacgcctgtagtcccagctactgggcaggctgaggcagaaggattgcttaagtccaggaggtcaagggtgcagtgagctgtgatcgtgccactgcactccagcctgggcaagagagtgagactctgtctcaataaaaggaaagaaagggaaaaaaaattaagtatagaaagaaaattttaggaatttaaatataatttgcaaggaaaaacaacaaaaacagtccaaactttaagtagaaaactatgtgcttttcaggtattttaaaggtaaattttaaagggcattatttattaaatgttgaaggacagaaaacatcttacatatttgtcagaaactgaccaatcagaatggccctgaaatgtatagacttaataaggatagtaaccaaaatgacagtcctttccactttgttcctcattgcccaaatttgctattttctccttcttttacgaaatgcttctaaatgtgaagatagaagggaaacaggtagagtaaaagttatagcccactccatttattttgtaataatattttttctcagtgttaagtggcatttaccagtatagataagattaattgttacaaaacaaaccaatttgaagattagtttttaaattgagccataatatataaaatcttatggtaatgtgcagatctgactatattcaagtatagttttcatacccataccaattgtcttgtaataatcgggaatgcatcctctgtgtggtgtttgcaaattaatgctattttggaaatcacaccggtatatctagtggctttcctgggtgtatgtggctcattactgattataattttctttgggaattttagtttaaggggatggggtaagcactttcaaattctttgttgttagtagttttgatggaggatagggataaatgaatgaggaagtgtgttagaacgagtaagtaaactcagataatttatcaagtacatactacaaaaataacgcagatttttatgtaaaacggaggagacaaatcattcacaagaggaaagccttaaaaacttaccaaggagcattcacaaaaataaatatgtatattttaattttaaaaagagccccaagtctgtgaatgaaagggttctggttggtttctagacccagctgtgcttgctgtatgccatgcaggtggctttagtatggttaaaagtgtcgcctgccctcttgtgaagggaagcaggagaagcgacaagctaccttccagtgcctcctcgattttcttccactatttcctttgtccttttcctgtgttttcatgctctatttatttacacccacttctgacttctcttttttctcagattcaatctttccttccgaatgactgtgagatttttttctacccagcacacacagaaacttaaccaattgcgtatgtacagcatttccatttcttttttctttctttttttttttttttttttttttgagacggagtcttgttctgtcgccaggctggagtgcagtggcacaatctcagctcactgcaacctccgccttccgggttcaagcgattctcctgcctcagcctcctgagtagctgggactataggcgtgcaccaccatacccagcttatttttgtatttttagtagagatggggtttcaccgtgttggccaggatggtcttgatctcttgaccttgtgttccacccaccttggcctcccaaagtgctgggattacaggcgtgagccaccgtgcccagcctgtgtacagcatttcttataacaatgagttacttttatgttaaggatttttttttttttttttgagacgggtcccttccttccttccttcttctctttcttctcttactttcttttctttcttctttctttccacagggtcttgctttgttgcccaggctggtgtgcagtggcatgatcaccgctcattgctgccctgatatccctggctcaagcagtcctcccatctcagcctccccaagtagctaggaccacaggcatgtgccaccatgcccagctattttttaaattttttgtagagatggggtctcccacattactgaggctggtcttgaacttctaggctcaagggatccacctgcctcgccctcccaaagtgctgggattataggattgagccaccacatctggctccaggacagtgtctactaccagaacagcatttaataagtatttattgaataaatgattaaaatattagccttaagaaaattttagtatcatttacttaaaaaattagcaaagcattcttaatacgtataaagaagtaatatgagtagaatgtgattctcaacagcaaggaagctttttttaccctattttctccattctctttctgttgccttctccttccaatgtgagaatctctgctattaagaaccgctggcagagactgaaattagtatacataattctaaggagatattgatgtaaatggtcgatatggattggcaggatgacagggagaaggaaattataagtttaaagacaggggtaagatgagtatttgaacaaaatatcaaggtaggtagttagctagagtgccagggccaattagaagattagagaaggtgagttgatgttggcagtgggggaaatgtcagattgacagagtgcttggatttcatacagtagatatctcatcatgaattattgatgagagtgacatgataacaaagtgaagacaattatttttctatttagctgctgtttataaaatggatcgtagcttgaggtgaggaaacgttgaaaacagtgaacaaagttcagagattgttggagtaattcaaagcagtttagctgttttgcttggtatgttatctggtgatgcctttagcagatacccttcttttgaagcccagtgtccactttatgactgagggatggatggaggcaggaggaagaattctgcactagaaagcaacaggccaagattctagtccctacttccctactttgtaaattcataatcatggataaatacttaatttttcctgggcatcagtcaccttacctataaaatgaggataatgtattaagcgtagtcctatgggtggtaaataaaatgaggataataatctaaaatcaggggatatacatagatctcctttggatttatttgcagcccattatctatctatctttatttagataagagacgggatcttgctgtgctgcccaggctggatttgaactcctgggctcaagcgatccacccatctcagtcttctgagtagcttggaccacaggcacaaacctcttgcatggctctcattgtccatttatcaattttagatggtgtaaacagtgaataccatattttgtttcccaatattactttctacaactatattgttttaaggagaaaaaagtctatgacaatataaaatatttcaaagtctgtaattttaaggtttaatgttacctatattgactactatattttaaaatatgtatccctgtttttatatgtgccatgattaggtatttagttttttagttattattagactgtaatagcactcaagttgatggataaaatttcatcctgggatacttttagagaaacatgaagaatataaaaatagttttgaaaagtatggtttctttcttacaaagctgtagctgcaataatactaatgtcagttacttagagctactagaaatgtgtaatttctaccttttttgactactgaatataccatatgtattatatatatgtacattcttaggtatttttgtttgtttgtttagaaggttttaataccaacagctttctaggtgtcgtcttcttcctcttcctctcccctccccccctcccctccctcccttcctcctcctcctcctcctcctttttcttcttcttctctctctctcctttctctctcttttctctctcctttttctctgtctctcctttctctctctctgtgtccctgtctctctttgttgttgttttcccttctgtttgggttgtttcttcccctcgccttataccccccaccccccacagaccccaatccatctggaaagatgaagaggcagctgctatggtaactgtgcattttggttaatgaatagcagactaacaagatacataaaacatacgcaaactgtgcagagtttgttgctgtcaaagccgtagggatacaatactttttcttttccttctaaaaaaaaaaaaaaactctcttaactgtggtgttttgttttctaatttaccattcctaatattgtaatgtttctgtgaactcctcctctttctgcttagtctgcacagtattacaccctgtggtgagtttatgggagctgagttgaggtgcatagaggaaaataattgatcaactggattaagaagtagatttcctttagactgatacatagaagaatagggacaaaatgtttttgactaaatgtttggttttttgaacgataacttctttttttacctcctttccttttggccactactgccccttttgggattctctctggggttaaagccagtaagtagtgtgtttcttaaagatgtttctatcataaaggtcagctgcaactggaatattgcgttcagccaagccttaaaaattcctgtaatctgtgccatcctgtctcatactgtcccatctcatagttgtcctctctctgcagtgctctatgcccaggtctctgtggctgggctgctccagcctggcggacagcatgccttcgctgcgatgcctgtataacccagggactggcgcactcacagctttccaggtactttctctgtctctgtgggttatttgcgggcattagtgtatgtgtctaattcattagtatgtgcctcctcctttcccatactttacttatattcatcttttctccttcatattgcctgtatctcacatcactcagtactcctttaatgattagtttataatgtagacccagactgatccactcttaagacaatgtcatcatgattggttacaaaaattgacatagtacagcttgactgttggctttcagatcaagtagaagtatgatagtagattttaaagtaatctcaataaatagcagttcaatacgtaatatttgctctggacctacataaagccaattagtataatcaatcaattaattacaatcagtttcctgaacattttcttattttttttaaatgattactcaaagtataaagtgccctcttcagagtatctcctggtaattatactactaagtatatattttttataactgttttatttatatcttgattaacatttctaatttctaggtggaaaaacctttgagacctttaggtacagtattcaccttgagacactctagctagtgtttcatgaattaacagattccagttcccctcagcctttcttttttttttttttttttttttttgagacggagtcttgcttcatggcgcaagctggagtgcagtggcgtgatctcagctcactgcatcctgcgcctcctgggttcaagcaattctcctgcctcagcctcctgagtagttgggattacagttacgcgccaccacgcctggctaatttttgtatttttagtagagactgggtttcaccatgttggccaggctggtctcgaactcctgacctcaggtaatccacccatctcggcttcccaaagtgctggaattacaggcaagaaccaccgcacacagacccctcagcctttcttagaggccaggatgtcagttccaggatgtgcgagaaacttatagagaaataatgtggaaaattgtagacaaaaacgtaggaaagagtttggtgctcattgcttacagattagggtaccatacatgattgttttcttgactgagtcttatctgcgtacctcaggtatttggaatttgtgtttagcattttatagtaatacacaacaaattagtttttatattaatatttgcctgcttttaacctgttgttcatatctatttagaagaatttcaaagataggctgtaagtgtcagaaggcttgtgactaaattttagctaaaagaggggaacttaggttttccacattcctaacctatgctaagagttgttaatttttaatgatactatttagtgatcataaagctggatattttcatttttcctttacaaaatttaatatcttaagattttcagttttcctttacaaaatttaatattaaacttccttggcttatactatgagatacaatatagtaaagcatgcaggttctaaaattagctaaatcaagtcttgaatattgtctttgtcactagtggtatgatcctgaacttatttccttatctgtaaatggatactatagtaagggcatgcagtgatggtagctgcttttatcatgatcgttataaacattattgctattattggagagtaattgatatcctgagactgcttatttatttcaaagtgaaatatcttttttttcctttttttttttttgagacagtcttgctctgttgtccaggctagagtgcagtggcacaatctcgactcacagcaacctctgcctactgggctctagttgccctcctacctcaaacttccgggtagctgagactacaggcacacgaccacacttggctcatttttctattttttttgtggagatagggtttcaccatgttgtccaggctggtatcgaactccccagctcaagtgatctgcctgcctcagcctcccaaagtgctgggattacagatgtgagccactgcacttggctatatcctatatttttaactacatatcatactgacaaggttctgccattgaagaatccatagtctagtttgttggtttttttgttttgttttgttttttaaccttttcggggttgcagttagtttaggcgatctgcaaagtctgagggaattgtagtgcctaaaaggctgctcctacttcagaaactagtttcatgtttagaggcccccacaaccactcttaggtttgataacttgctagaaaggacttagaattcactgaaaacaattatactcacagtttattacaggaaaaggacacaggttaaaattagccaaaagaagagacacatagggcagaatctcggaaggatccaattgtagaacttcctgtcatcctctccccatggagtcatggatggcattactgcctcccagccgcagtgtgtgacaatactcacagagtattaccaaccatgaaattgacctgagcctttggtgtccaggtattcactggggctctatcacatactgctcacatggctgacttctagtctcttatttcctcctggtgttgaaacttataggtatggtttagtgcccccaacatgaatcacatttgtccagtcgctaaatctctcaggcaagcagagatactctcaccagacaagaagttccaggggcccagagaccgctttccagtagccaagaggaaaggccattcctttctttggtgaagagtaattcttcactacacaggggtcatggatctctttgggaatctgatgagaactattgatcttgggtatttggcaacattgtgttgaatactttacatacatatatagatgtttattatatttctattttgtgaaatgattgagagctattaaatcacataattctgaaagtgtaatctcccaagctgataaattctaggaagggaatgttcaaggagctgtaagaatatataaaagggggacccaatctaacctgaagtttgaggtaaagaagatcaggtaatcaatgtttaagagctgaaggatgaataggaattaactcgataacagggaggaatggaggagaaggaggacatttcaggcctaaggaagagtcagtgcaaaggccccaagagccagtgaggcttggtgcatttaaggaccctactgaaaacaagactgttgtttcagagaataaagagaaaggggagaatagagtgagaaaagactggggaagcttgatcactgaggtcttatgggccattcaaagtgtgtagtttagtcttgattctaagaatagtaagtcactgaaaggatttaagcacaagttttacctgatctgatttgcattactctggctataagaagatgcatttagatatgttactctggctataaaaaggataatttcagtagttgaagagagagatgatggcagcttggttttggacccaggatctttaaattcttaaaaaattattgaggaccccaaagtgcttttgtttatatggcttatatctattgatattcactatatttgtaataggaattaagaaaaaaaaattaaatattctttaattcacctaaagactataataaacctgtggcatataatgcaaataacatttttatgaaaaatatatttttcaaaaaaaattaagactagtgtattacatttttatgaatctctttaatgtctggattaagaaaagacagctggattctcatgtctgcttctgcactcaatctattgtggtttgttattttggttgacatatgtgagtaatatctgacctggcataggtatatagtttgaaagggaaagatattttaataccattttcaggtagttgcagtttcttgaagattagttgcagtatggtatctgaagccttatcaatgaacttcctctgttattgtattaaaatccattggtctcagtttttttcaataaattatgctggaacaattggatatccttgtgcaaaacaatgaacctcaacggttatactgcactatatacataaattaatttgaaatggatcatagacctaaatcggagttaacatgtataaaactaatagaaaatgtggcaaaaataatcattgtgactttgggttaggcagagatttcttagctaagatacaaaaaatatgaaccataaaagaaataactgataaattggacttcatcactgtttaaaaattctgcttttcaaaagacactttaaaaaaatgagcaggaaccaggtacagcagtgcatgcctgtagtcccagctactcaggaagctgaggcgggaggattgcttaagcccaggagttcagggctatagtgcctgtgaaaaaccactgcttaagaacagcctgaccaacatggtagttttcaaaccatctcaatgctgtggtttcaatttgagctactgggaataatccaacaaattcagcaatgactccatagcttctccttctttattgccataagaattttgacttaagatgcttcaaacttactaaaagaatccaatgatcaaaaaaaaaaagtcatgaagccattacattaaatgagacatttcattaacatatttgtcaatattagtaaaaatgggtattcnnnnnnnnnnnnnnnnnnnncctgtcttcaggtgatctgcccacctcggcctcctaaagtcctgggattactggcatgagccactgcacctggcctcaacaagattattattatgtcttatgtagcaaaaatgggcttatgtactggttttaccctatcaattcaataatttgttctatgtcaggttcagcacacacaggtgcttgataatactggttgactaataggcagaaactggatttgaatctagtatcttctctgcccacctactggaattacagcagtcttagtgcatttgcatccttctggtttaggttttattttatttacctagatttttatttaggtaaattatttacttagatttttatttaggtaaaatttacatacagtgagatacatggatcataagtgtactcttaggtgagttttgacaaatgcatacttttgtgtaaccttcaatttcaagatacacaacagtttcataatctgagtttcctcatactcctttccagtctgtacccatcccccatatgcaattactgttctgatttgtcaccaagaatttgtgttgcctattcttgaacttacttcatataaatgccatcatatagtgtacattctttgtgtctgttttctttcaatcagtatgatgtttttaagatttatccatgttacgtatatcagtagttctcttttattgttaaatatatttcattatattagtacaccacaatttgtttatccattcatttattgataggtatttggattgtttccaattttggcctattattaataaagctactataaacagttttgtataagtcttttttttggcatgtatttttatttctcttaggtacatgtctaagaatggaatttgttgggtcatagagtaagtgtatttttaactttaaaagagacagtgaagcaattcttcaaagtggttgtcacaggaatacccatttttactaatattgacaaatatgttaatgaaatgtctcatttaatgtaatggcttcatgactttttttttttgatcattggattcttttagtaagtttgaagcatcttaagtcaaaattcttatggcaataaagaaggagaagctatggagtcattgctgaatttgttggattattcccagtagctcaaattgaaaccacagcattgagatggtttgaaaactagtgacagggaagatgctgaaaaaagttgttagaataaattctatggggatatgtttagtttgaggatatttttattttcatcattccattgatttatcctggaaagtgtatgagtgattagaagatttctgttgattaccagtagatatatttgatggaatcatttgctcattcccagcaaatggtgatcctataatctataatattaaatgagaatgagcaatagagttaaagtaattaaaaatagctgagtaattaagattctttattttgctttagatattgaaagagaagagaaatgaaattctgactgtaagaatataagtaaggggccgggcacggtgatgcacgcttataatctcagcactttggaaggccagggctggcggatcacatgagcccaggagttcgagaccagcctgggcaacatagtgagaccctgtctctacaaaaaattagctgggtgtggtggtactcacctgtcccagctatctggaaggccaaggtgggaggtcaaggctgcagtgagccatgattgcgacactgcattctagcctgggtgacagagtgagaccctgtttcaattaaaaaaaatagatagatagatagatagatagatagatagatagatagatagatttatatggccctagaatactttagctatcaagtgtaaccagtaattttaggaaaatcttgagctaagtgaaacgtgatattttaacattagctagggttccatgtcaaaggttgaaattgtattgaattcaggagagatgttgtattttattccttaagaatgcttacaagtctactgaattttaccatgtacaaagtgaaatgttaaaatggaacaatacaggaaaattaggcattattcattatatatatggaaaacttaattttacatttgagattttagaggaatatggattatcgaattgaatatacattaacattcaaattctattacaaaacaataccataaggaaaattatcctgtgacagaaatgcttctcattctgtagctgataccctctctattgtatatgaataatttctgtgtagcacaatttctgtataataaatgtagttattttttatgtatatgttaacatttgacttgtatttatcccagctacacccttcaccttaggggtttgcagggaatgacaaatcaaacatgtttttgtttgtttgtgcagaaatgttttgttctcctaataaaatgaattattgtttattatggaatatgtacattatttggtaaatatataaacaagagtatcacccatatgccttccactttaagataattattgctagattaacatgttagtgtcctttgatctgaaatgacttatccatccatgtgtgcctgtgcgtgcacacacacacacgcccaaataatggtttcatttttaagtattttattacatttaattaaattatgagatatacagttaaaacatttaatattcattgtagaaaatagaagtagaaagaaggaaggattttaaatgtcctcccagagattaccgtttcagtgatactagtaatttctgaatttcacctatatcatattgctcaaattctacattcatcatctggtaatactgattttggtcactgtttatctcatagatagctgctcacatgtttttgaattgaacaaagtttgaatttggcttatatctgaccaccacctccctctcatgtaattgttagtcatttcaaattttgcagttccccaaaggtgcagtgtgttcttttatatatctgtgtctttgcatataccgttctgcttacctgaaaaaacccctccacaaacacctattgtcccttacccactctctgcctttgtctacctaatcttcaagattcagctcaagctgagctagaattaaagtcttccctgatctttatctttgctctcttaaactagtcagaggatctgtacccagagcatgcatggaattctgtgccctgtaaaattgacatgaagaaaaggagtattcattttcgtacttgattctttaacaaaaaattcctgattgggtctaactttttacgtgtgttggattagatggtcatatacagaagggaaagaatagcaatataagtcttctcacgtctgtaatcccagcactttgggaggccaaggaaggcagatcacaaagtcaggagattgagaccatcctggctaatgcggtgaaaccccgtctttactaaaaatacaaaaattagccgggcgtggtggtgggcgcctgtagtcccagctcctcgggaggctgaggcaggagaatggcatgaacccgggaggcagagcttgcagtgagccgagatcgcgccactacactccagcctgggcgacagagcgagactgcctcaaaaaaaaaaaaaaaaaaaaaaaaaaaagtcttctcattagcaatataagtaatctaattttatgtttttatgtctcacacatacacatacatatatactacattgtgtcaaattagtaagtacaaaacttttgtgtatgaatttcagttttctatttaaaagaaagtacataattagttttaccaaaatatagttgctactgttcattgtagtttctaccctttatatgagccattgtttgggggagtacttgttttgttactggtaataaactacaagggaaatttgtaatataatattagtatatttcccctagatttttaaaaagcaggtcattatttttttaagcacttcaactgcagcacagtgcaatcttttggggagaattggtaaaatgaggataaaattagtacaggattccagcagcttgaaaataacacaatatttgaccaaaatctcttttgtattccctactctggttcaattccagtagtcctggaaatgtgcctatggactatttacagtgagattataaaactgaatcatgattttggtgaatagaagccagagcatgtggctacagcaccccagctggcagtaagctctccctaggtttatgaatgtagttagatggtccccaactgtttacaagacagcagaggtgagatatttgattgacaagtcagaaatgcattagatcattctctctgccagtctctggttcatgctgttaaaaatgtcagcctccaagtttgaatggcagcctgagggccttagaagctttttgttttctgagatggaaacacaaattggatgtgtgcctgagcgcttcatcctgggctgtaatttcatcttttagctaagaaccacaaggtacacgagcaaagcaccctgtaaacaataatactgtggaaaaaaaataaacaaggtcgtgtttctggtacgttgatccgatggtgtcctgacctctatcacgttgaacatctccactctgattgctgttccctttggcattacaatgagagaaagagagactgacatactatgaagaaaagatttaaagttgcagtatcgttgcacattccttgtattggctatgaaatattgaactgtcagaatgtgacacttggttttttaagcaacctttcttgtttgaggtgtttgcagttcattcctttctcccccatttgtctgctttcattgatagggttggaagtagttgccttaaatgcatgaaaagggacagtgttaaagagaagtggtgctgatggagccaaacaaacttaacactagaaaataaatgcaggctgtggggcaaaggagataaagttgggttagtgtattattaatagtggaatttatggaacaccctattgtaaggaagaatcaggttaggtcccatttctgtttttgtggaggcaggaagttgggaaggtggtattgggtaaagagatgcagtgacatagtttgttaaactgatagcctactatatggcagtattgccaggccaatcagaattcacccagctattttatttattgctcttattatccagtgtctttaacaagtggtgaaattatagaagactttaaaatttggggaagaaaaatatttttttaatgtggaaaatgtgtatttatagtaagaaagctcattaggtaatatggaagaaacattatgcttatattagtccagcttatgccaaatgaatagaaaatcttccttataaaaccaccatatatttcttggaaaatattttgtagtaataaaatgagttttctattatgttttaaattacatcttttttttcaagctatgagtaggagtttataaattacaatacatcttaaaacaacatatatattttttcttctaaggaagcactattgatgtatgctttcattttcatcccttttggggcattgaatttacaagtaaagttttaactgagaatgaatggccttttgcagttcttctggagtatggaaaagagtttgtattgaaagttcctcaatggctgggcactgtggctcatacctataatctcaatactttgggaagctgaggtgggtggatcacttgagctcagaaattcgagaccagcctgggaaacatggtgaaaccccatctttaccaaaaatacaaaaaattagccagtcatggtggtgccagtctgtggtcccagctactcgggaggctgaggtgggaggatcgcttaagccttggaggtggtggttgcagtgagccgaaatcatatcactacactccagcctgggttgacagagtgagactccatctaaaaaagaaaaaaaaaggcaactatttagcttagccctctcctctgaaaatgtgaaaggcaagagctgttctgcatcagtctagtgaaatgcactggaaaaatggtgttggtaattcctgctttgaggtcatgctagaaagagagaagataatacttgtaaaatataagtcctgctcctttgtagccagatttttgtccttacttaaaaatattgtgctcagaaagtaataccaaaaggagggatattaagaactagttattgttgtttttaagtattgctctgaatttttaaagcataaacattgatgtagatttgcatttaagctatgagaacccactgtcttgactcagtgggggagttttcaaaaatcattcttgtagaaattgatttctcattggctgatttctacaggatgaatgaaaacaaaccattttttgcagtcttagaagaataagaggaatgcaagtgtttaagaaatgagactgaaatatgctttatggagttttctaaatctggtacaaagaaactacaaaatttcttcttatgtattatgcatcaatacagtgaaaatgcctcacagcttatgggctttttacaaccacaccttcacaattaatgattagctttattatttaaactccaggcttgcctcatgagcaaacatcagtgtattcatagaaccatagaatttcagcattggaccagacatcagaggccatctagtcacatacgtctcataatgtagaaatcctttatgaaatgtgtttggaagggagtcatctaatctctccctgatcactaccattattggtgaatcaaacttcttgaagcatcttgcttttactttgttggttctactagaaagttttttcttggccgggcgtggtggctcatgcctataatcccagcactgtgggaggctgaggcgggcggattgcctgagctcacgaatttgagaccagcctgggtagcatggtgaaacccagtcactactaaaaatccaaaaaattagccaggcgtggtagtacatgcctgtgatcccagctgcttgggaggctaaggcacgcgaatcgcttgaacctgggaggcggagatagcagtcagccgagatcacacccactgcactgcagcctgggtgacagagtgagactgtctcaaaaaaaaaaaaaaaaaaaaaagtgtaataagtcagaatacaatgtagacacgtcttgttttgaacacaatttaaataatgtaatttaattactgcctaagattgcatatacttctttgatttgaatgatggaaaaatttctaggaacttagcctgggtttgtttcctcatcttttctttgaagccagaaaagcatagaaaagcatatgtaagcactttgacaaatgacataatgtagcggcatatcagagtggcacaggtattttaaacctagctccagttcctgaagatggtgaacatctgcttagaggtactgtagagctccacaatgcactaattgaattactcttttctggagttgcgactgcactaattgaattagaatctctctctctctctctctctgtctctgtgtgtatgtgtgtgtgtgtgtgtgtgtgtaaatgagataattccaaccttaacgggagagactatgagagacatgactgatggtgtgtactgtgctgctatctaatggcagcctatggaactactacgtggtctccagggaagagaaaatacagcgtgacctcagtctaaccccatccagtttagttcagaaggtcccaggatgtaattttgtaattctaaattgaaaaggaaagaatgtgataaatttctgtattaaaaattaagatatattttattaggcataaagtttttaagtactaagttacaaatattcaactgaattaaaaatttcctttaactggtgaaaaaaaatcgagttggtgggtcatcttttttctcattttgtccttcagtgacataaacgtaaaaaggaattaacgtttttgaaatgtcttagcatcatagaaaggataaatgatacagggcttgttcatatttttaaatacaatttttttcctggttgttagaaataaggtgttaccagattttgcttgtatgtgattatgcttatattaattatagcagtatcaaagtaagttgtacagatctcacttgctcttttttttttttttttttttgagacggagtctcgctctgtcacccagggtggtgccatctcggctcactgcaagctctgcctctcgggttcacaccattcccctgcctcagcctctcgagtagctgggactacaggcacccgccaccatgcccggctaatttttttgtatttttagtagagacggggtttcaccatgttagccaggatggtctggatctcctgacctcgtgatccgcctgcctcggcctcccaaagtgctgggattacgagcatgagccaccgtgcctggcctctgttgttctacttaatagtttaaaaattaagtttaccacaaatttgggcaagttttaaaccctcctaagtgaagtcagttattttgttcctttaaaagaaaaaaagaatcttagtcacaatttactgatttttgtaaaacatgcaaatgtagtcctgcgcaacattaaaagcaaataaatacactgaggacaactcaacatgaaatatattttgattcagtttaactctaggcattctaacttgtaaaaatggcccttaacagaaaaatacatatgtataatcacttgatttatagaatgtgtatgtgtgcatacaaaaccacttcagtaaaagtgctgttggttaccattctgagcatttaaaacgatcactttccatttgatcatattaaagatatagaaacaagtatatagcatagaaaagttttaatttcttctatgtaatcttcattattaaaatatgtttgaatatgccattattttgtaggctaatttgttcttcattgtgagattgaggtacttagatttcttgtatgaatagctctcactaaaatgactataatttgtactttttatattgtccttagggacattttactgatttagaaaatccttttgacatcaagtagatgtaaggctttacaaataacatggccattcacaactagccacaactccgattcgattcacagagtaccttttatttgccaattactgtacaaagtcttaggcataaattaagattcagaacctatcctcaaggagcttatagttatttgttatacatgtattaagtacttatataccagtcactgtgcatataattactagtgttaaccattagtcatatgtatttttttctgatttattgagctagaggtctggcttagtagcagtcctaaggaaatggtatacttatgttcatatcagatatatctcatctcagcaaaaaagtgataatgtatatttcagactagtctgtgtcttaaatggttttctcttgcctttacataccttctaagggaacagtgatgtttgtgatagctgtacatgtagcttaaaaagagatgataatatttgttacaatgcctcctactggttgatcatagattttcaatccttgttgtcttcagaactggtagttcccactggtgatttgatagtttggggcttctactgaggctataactgagaaagagtctattgcatacaaggtataaagtgcttctttaaacagtctgtttctagaacctaaattgtcctgggaccagctcttgatataaaaattcatagaaacctgtttttcacagagtgtggtaactccttgccatagtgctgtagtgttaaaattcacattggccaggttgttctgtaaattaaacactgacagctaccctcaggggaacagccaatgtatttatgatgatgtgctgattacacaaaatacactgcaagcagaaaacagctgcagagaataaacctcttaaaaagaatacaattacaaatagcaccctcagtatttctagtggtgagtgtagaatacagcatgctaatgcaagtttcttactagtccgcctgaaaacaaaaaatctgaaggagataaattatggttgaatgcacatgcggtgccagcatagcagtgaacaaatttcctttctcaagagcatggctgtaagtgcacagatttcaggtgtggagtagtctaaccaccctccctcattttgttaggttttattagtggttttctcatatatagtagggcatggccttgaggttataggggctctagacatttgaaagatattacacaatgaatggggcaggagggtaactaaattgtggttacaaatttctggtagaaactcgatatgttagggtttagttatcgacatttcatttgaagatacgactatatattttcagtgttattaatggcattgaagatggtgcccttggaattaataaaaggagtcatgactctctggtaagatctttctgatttcttagattctgtttttcaagaataatggtgttttaggacattggaatagctgattgtatatttgtaggagtatcagctctcaaatatgtcccttttcattcctgcatcttactggtcacatgcatacaggtaagaagattagaaaaaaaattttgttttccctatttgagattctctctgttagagcttagggtcagtatctataaaatatatttcaactgctgagcatgctagcttctgtttaaatcagtagaaaatatgttgatctttcaagacataaatttactcaagccaactgtaaggtatagcgcagggacatagtgattggagacagttcacttcacccgcctgaaactaagaatcaactcttcagtgtatggatcactggtatgtaataatcgactattatcggtctgtctattggtctctttttaaatcagtttggaacctcctggagttattttcttgctctactgacatcaatcccatgtggcagaggagttgtgtataatcgctttggtttaatcaatagaataattgataaaccagataagatttaaactgattatagccccagcagaattccccagaggccttggactctcttaattttgacatgtgtgttgtgtaccctgaggatgaagtgcagtttgaattatctgcttttatttgcttaatgacggggagggtgttaaagtcaaatgtttaattaacccagcaatgggctgcgttgtcacttacacacagctgattgagatatctcatggagaatactgaataggaatgataatgtggcactgggacggaagattgctttttcaatccatttgctgggtcactgctttgaatgtcttattggatgaaaggcattcagcctggagaaaaaattcagcatttaagtacattttgttctcttccccccccacccccccaaccccctccgtgctcagaagttaactaaaacagatatgttctaggtttattaagccatccatgtactagtaagagatcaggatagccagtagcctcaagctacataatttcctgtggaaacggaaaaatcctactagcctctaaggtattctaaatgtgagctcttttgtccctcacatcctgtgtcccttgccattattgtgaggttgtctttggttacttgtctcttgcctttttctgtagtgtttgctagatgtgcagctacctctagggccaaaggcagaccttttcctcccaaagaagcaaattatccagtacattttttgctatttgatatacctggcttctatttggttgtaattgtgactaagaattataatgagactgttgaactattcagagagatgaaaatttgaggcattacaaattcttgcttttttggctactgctattgtaaaaacagttgatgctgtgtatatttcattttgttgagaggcactttgctttctatatggactaaaaaattaggccaggaaagattgcaatattcaacaccatcaaaaatgaagtctaggcaactggagttttaatgacttgctgcccacaaaatatccctgactagctttataatggaatgtaaaaactcattgaaggcatatgagcaaaactttaaaaaaaattaaccatgactttccttctctgtagttcttatgtttcttccctctatcccccaaagatctaaaccaggaatttactaatttttttctttgctttagtcatttgtattccagagagcacaatagggagaaggatacaagattgatttttttatgtgtgtcctcttgaaagcagagtctggggcatgaatactgtggggggtggtgggggggccggttacaaagcaatagaagcatgcagctagtgttcgcgtgcaggttggactttttgcgggtcaaggcagaccagacgagtagcttatcttgagggacgcaagtaatagaccaaatatagagcagctatttcaggaatcatgtaggtcatttaattatccattatgattgagtggctaatgctcttttggcaattacatgacctctgttattcttgaaacctatccaggccctcgtgggtcaagtgacccacaagtcagtgctctcagacttgattccactcagaaagaaaggagatgttgggaaccactggcatttagaaatggccatgttttctttactgaccactacccagaatgtcctttgtacagcagtgataggcaactggttttgaagtcaactattccttcattgtatataggagcaaaagatgcattatacattggtttccacaagagggtattttggcaggagatactttaataccacaattagctattatggtattcactaattctgtactgtaagaacaactactatgatattaaaattaatgtttgatatctgtcaaaccaattatctattaccaaactctgtagtggtattttccattccataacgcaacaagtgctattgatgatagctaataacagatattagtatattattaattactaatagtaattatagtaacagattagtaataataacaaaatgccattgatgatagctaataacagattttaaaatatcattcattaaaattagcctaatttgaatttcagtgctacaacgattattaaattaaaaggccactttaaaattaggttctggtcaaagacagaataagttggaaacatcttgattgtttatcactttttttctttaatcaaccaagtattattaatatttccaaaaaaaaccaatttctgctaaatgatagtaaaattttctataattcagtgacttgtggggtaattttgagaacagaaaatgtacatttcttgtgattctttaaatcgaagatagttacggtgtggaaagcaatggcagcataatcaaattaattgtaggatttgtcagaaatgcacaaaattctgcatagttagcaaagtggtagattagaggtatacagccattctctagcattccagtaacttaagaccttaggcttaagagaaataattttggtattctttaagtagaaactatttgcattgctatagaaaaaggcagttccttctattggagaaaaaacatcttttaaaaatttgttacttacacatcaaagagcattgctttaaaacaacaacaacaacaaaaactcaacaaggttgtttatccctggagcagtaaaattagccatccttcccaataaatttattaaattacccctggtagaactccaagctaatctgttttggttttattttcattttgttgtttggtgatgttaacaaatgaaaaattgaagacatgaattggtgtgtataacctttgacccttcagaaatagaagacttctcactcaaattttaaatccttaagccaatactaccttagggtctggctacttagagacccatgagaatgcagttaatctgagttatatttgctgttttctgtttaaaaacatattttctctcattctagttttttcatttctgtggtggagatgaacagaaaatggaaagcaggatttacagcagaagttacagattaaactcaagtatcccaaataaggagtataattagtctgcttaccattttaagaggaaagcaagggatataatgtatggtgtataattttttttttctccctatatattacttttctttaaggcatacccttcaatatctatgctgagacatgtttttcagccttgggaaccaaaaatttatagaaataagtgagaggaatggtatttgtaattttaaagacccgaagagacattaaggcagtatcattagttgggaaggacacagtataataataagcctatataataatttcttaattaggaaaaaaaataatgattaaacaagaccagtccatattagagacatacacctaaacacagatcttaatctagcccagtctagctttcagaaatgtagtttatttacttgggatggttttacgtctcgggatattagcttttatcaagtttaaaggaatcttaaatttctttcaagatattgttgaattgtaataaaatggtaataccaaagcaaggaagatatccaaggggatgaaagtcatttagcaaaaagaaacaaaaaaccaggaaacaaggatgacagaaaaaaaaaattcatcagagagaaagaattttgtcatacgtcctaagggttctatagttctcagtcctattttgataaaaaaactacttaagaaaatctacagaggtcgagttacaaaaataaccagatgtccttattagtggaagcaaatgtttgcctcttaatttacacaaaactatatgcagaggatctctggatgaaatatttttgtaaatatggcagcaaagaaaatcatggcacaaaaaaatctgtccaaaacacataatcgtgaaggtaatgtcttaaagaggaaagcagttttttaaaagattcctatagatttaaaggtaaaaggtaagttaagctagttatattttggtttacatgatacgtattcttggctttttattatgtatgtctttctatctgaaatccccctggtgaattttaattcattttgccttgcttatttctctactttgtacattgttgttgcattttgaacagtgtaaacgtatgtgtggattgcttttttttttccctgaaagaatggttgtccttttagttccatcacgaaaaacacaacctacagtggtataagatgcctgctttgcaagcctgtttgggattttaaaatattaacccacattttaataagtagatgtagttttgtaattgcattcgtacattaagcaggataaaaatgtaaaaaaaaaaaactacttgaaagggtaaggtaggaagtgtttttttttgtttgtttttaaattaaggctttagagccaaaaaaaaaaacctgtaaagtttaaatggactattacttctgatgtggagcatattagcataattacaaactcttttatatactcatagtcattgctaagttgatgttcaaacctttgattaagaagtcacaaagctgactgtgttcagacagctgtgtaatatcgctcctattcacaaaacagataactgttttagccccctcccttttttggtccccatatttattgctacaaatttgtctttctcctatagctagacttttaattaatggtgaaacattaaaatgttgtattgtgatattttcggtgacttgaaagttaagagaaagcagcactgctcattcatgcccttgccttgtcactccctggtgcagttcatctcttctatccttcttatcagagtatctcagtgcttagttgagcttgtttatcttaaaagagcaggaggcaggcttttagggaataagctacatgttccagtataacaggcaccaatgctgtttgacttgaaaaacatttgatctcttacattaacagcccatgtcactgtaataggtagtacagccgagttgttcagttttctattattttagctttgaaataactgttagtgctgccccaaaatcttcgtgtataaaattgtatattggctgccccccaggactcgtaagtaaacaaggtgatatgtgtggccagaggggagggtatttgttggctttgttttagataataactgatcctatctaaagatgttttctgtctgatccctgatagtgggtgctgcatgacgttgtgtaaattcgcagacctagcaatattttaaggcagatttctgtttgttattaatatatgtgctcagtaactattaattatgaactttcatttttttctctgataatgaaacatttagtttttatgaagcttaatgtcaaagatcctgcacaatttgcctaagtatagcagtttgcacagcagtttttgaaaatgggcaagcaagaatttaaagggaatgtttgttagacttaaaatattactttatttaaaaataattcagttgtgggtataatttctgtgccaggaatagtttgacagttgtaatcaggtagcagtattaaaagaacagaaaacaaaattcgtataatcaggttgatgttttcttcctctttaagagcacttctccttttaatagtggtagaatggcagcaaataattttaatccttcctttcttccttcctctattttcaagaatctgatttttctcattcttatttttttctgttacagcattaccaggccacccagttactttcttagaatttaacctaaattagatacatcagccagaacaagcataattggttgaaaggcagccatctatctagggagttcttctaaatactgaatgtgtcatgcgctttgacataacatatctgtaatctctgaatacagaaagcactttctgtgttagctgtaggtgttaaagcagtagtgtgttttaagaatgtgtgctgtgcaaattctggcttgtgaggtaatgacaagtgtttgcctgcatagacaatatattttttcccccctgaggtccccacacacctagtttccctcaagctcatcatctctgtcaggttaatcaataggcaccgtatggcagagggtcagtaatcagtgtcatcgtgcctttaaatcgtgttgaaaatttgcttaaagcctgggccaattaacatcgagatgatgaatggatgggaagatgggaagagcctgccgctcaggggctttgtgaggaggagatgctcagctgttgagcagcagacaccagcgaataaaatcagccattcatgtgagctcagtccacccactcttaatgataatgtcaatctagcaaaatatatacacattggagttgtcacgagttcataaatcaaaggagtttgtcaaaggcattcagattaacgaggcagcagcaataacaagtcaaatttgcatagagaattgctcgaatctcagtaaattatgatcctgtttttcatttgattatttgctaatgtctcaagagggagaatgattatattagcatgcaaaatctactccagaagtagaaatctgaggtgtagaagaccagtgcactatgacaattaatcagtttctgcatactagcataaatgcacaaggcccagaaatgaacttcttttttattattatttctctttgctactgatccaaatggttcagcttgacagagactttatattgctttaacagtgttctgaattgtgcctgcaggcaagacatagttatgcagctataaccaacctatccatctgccaaccagattggaattctcctatccaaggcttccattaacccccactgacagctccaaacaggattaagaatttggaagcataaaaaatagttgttctttgcaaatatacacaatccctctgcattttgagaaaggatgcatctgtagtgttatatgattagtgtcggacagtgtggcggggagaaagcctgcttggcagttttttgacttctgtcacagggagtaaggcagtgctaatggaagtcctctttggttgtcccagagaatgttgtccattctatctagttgttagcactgtgcttggaattggtatattactagaaaagagcactccttgaaagccttaactggtgaatctgttgagtttagcagtatagggaggccttgatgtggttgtggtttaatagagtatgtcaaatgataaacatgctggagaagcaatgtgcatgaaaacatgccagagaatatcttaggaggacactttaggtcctccctaaaatgagtccttgaataggattttccgaacagcttctgaacttaaatgacctaagttttccccattgtatcctaaaaggattaattaaaatttgtttaaacacacacacagtgtttttttttaatgtcacctttcatacaagagtttgagtgattttgtccatgtagctaaaatatctgttaaccttgtaaaataataatttctgtttttgtaaattgtaaatttatatttggaagctaaattagctccaagtcacataataagttaatgggaaaaagtattaatccaattactaatttaccattgaagttcactatactgtgtttgcaattagttactagaaatcggtctcaggattttttccttcaggtgggttgtcattctatacgatgatgagcagatgatttcatttttaaaatgtgttcaaaatcagttataatccaccacaatttacctgctttgctaaaatgatagaattatcccagttacagagtccttcaaatcctccaatggtaaattagtgaagtatgtggcattggtgtgaaatgttcgcttgtagctttggagctggttattttatttataacagatgtctcttcaaacaggttcaggctctgttgcaccatccaaccttgagcaagatgcttactcaaagattattgtaagtcattatgagtggcttgacttttcatcactgtgtaaattagtttaattttttatttgattatataatcaactcttaattatccattttatcaggagttgtgtgttcaaatagataactgaaaatagtaaataagccacttactaggtcatggggaatattgccccagctatgaacctgctgtgtgctgccatcaaaacatctttacttcttgaattggacagtcaaaaatacaaacagcctcaaagttaggaatgctttggttaagggttgccaaactttgtctgtaaaggggcagataataaacatttgaggctttgtgggagataggatctttcttgtggccacttacctcttccgttgtagtgtgaaagcagccacagacaaatcgtaaatggatgggcatggctatgggccagttaaactttatttgcaaaaatatgtgtcaggccagagcttgtaagtgctgttaactgatcatactggcattataagtagtgggacagtaggactgcagttgggctgccactgaagttcctctgctattaaaaacaaaacaaaacaaaacttttttttaagctagctggacagtctgggtttagggtttcaattattcattgagcatctgttatctgtatacttacgtaatgtgttagtgggtagagggagctacaaagacttttcccagtaatctttcaatcttactggttagtcgaaagtaacagtgcagacatttatctaattaagtgcctgttgtgtggatcaagattaaaatttagttagggaatttccagtagagtaaggtggagtagttttatggtttcttggagaagatgacagttaaacctcattttaagaatgtgtaagacttgaatagatgagataatcttgtgtttataattgttgagtgaactagactggagttaagaatccttccaggccagactctgtggctcatgcctgtaatcccagcactttgggaaacggaggtgggaggattgcttgaggctgtgagtttgagaccagctgggtaatatagtgagaacccctgtatctacaaaaaaacagaaaaattagcctggtgtagtggcgtatacctgtagtcttagctagtagggagcctgaggcaggaggattacttgagcccaggagttggaggttacaaggagctatgatcatgtcattacactccagcctgatgtgatagagcaagaccctgtctttaaaaaacaatcctttcaaccccgaaatttcaagatcatatcacctgttggtgagactatgaagaaacttgcttaactggggcagaaaagatgtgttgtgggaaataacttggtgtaatatagtagggaattctggatggtcctgaaaaccaggcctagaacttcatatttgatttcatagaaataaagagccactaaaaatattttagggaaagaccattacgacagtagcagtgttaagaaagattaacctggcaataatattcaatccaagaaactttttttttttttttctttgagacagggtctcactctgtcgcccaggctagagcacaatggcatgattacaccccaaactcctgggcttaagcgatcctcccgccttagcctcctgagtagctaggacgacaagcatgtgccactatgcccagctaattttttttttttttttttatgtagaggtagggtcttgctatgttacccaggctggtcttgaactcctggccccaagcaatcctcctgtctctacctcccgacaagaaaacattttaaaattcacattatattctctagctttgtgctgaacctctgaaatataagatgaaacagaaactggccctgccttgaaggaatttacagtagtgtggggtgggaagcatgttcatgtagagatataaagagatataaagaattaagtgccaattggaagtgaagtttttcttcggagtaattaattctaactgcaggttaggcgtaaggggataaaggcttctcagagaaggtatcattttagctgactcttgaatcaggatttttagtagataaagagattgggaaagaagcctgttacatgttaagggactagaattaacaaaaacacagagatgaaagagtggtttccttattttggtgaatgataaataatgtcatgtaaatggtacagagactttgatgaagtgttaagttggctgtcttatggatgctgtactaagaagtttgggtttatcctgttattgccaaaaagctataaaaggcttttgaacaggaaagtaacctttttagaatgatgattctaatggccgggcatggtggcttacgcctgtaatcccaggactttgggaggccgaggtgggtggatcacttgaggttaggagttcgaggctagcctggccaacatggtgaaactctgtctctactaaaaacacacacacacacacacacacacacacacacacaaaattagctgggcatggtggcgcatgcctgtaatcccagctactcgggaggctgaggcaggagaatcacttgaacccaggaggcagaagttgtaatgagccgaggtcgccactgtcctccagcctgggtgacagaacgagactctgtttcaaaaaaaaaaaaagaatgatgattgccactctagtgtatagaatatatcatttggatttaggcaaggatgtcaatgtcagaaggctgtctcaatagtaatagcactggtaagaggtgttgtgggtctggactagagtagaagcagtggaaatgcaaaagtagggtcagatgtattaaaatagatgattcaaagaaaaagtttatagactgaaaattagctagatatgttcaaagaaaaaaaaggaatgagtaaaaactgactctgaggatttaagtctaggataaaaagaaaagttgggaggaaaagagctgacctagaaatgagtggagatggtaaaagagtgctttaaatttagatgtgttgattttgagacagtttaagcttatcacctgaatacttttttaatataattactttcttttttattcgcccagtttggttgtggaaacattttatccaaaatgcatccctgaggtctaatgcaggagctttagcagtatttcctttattgaccttttcctacccaaatctctgttactgtatctgcaggtgttacagcccaaatgcatctagtttggagttaaattcaaagttgacagggagactttcattctgccctttcaattctaagctagtaagcactgagctaagaaataaatatttgagttaatataaaaggtaacaagttgtgcactgggctaagaaataaatatttgagttaatataaaaggtaacaagttgtgtagaatcttttacaaaaatattttaatatactatagtccccacttattcatagggggtatgttccccagtggatgcctaaaccacagatagttctgaactccatgtatactatgttttttcctatggacacatacctatgataaagtttaatttataaattagtcatagtaagagattaacaacaataagaataaaatagaacagttataactatactgtaataaaagttacatgaatatgctctctcaaaatatcttactgtactgtactcacccttcttatgatgatgtgagacagtaaaatgtctatgtgatgagatgaagtgaggtaaatgacctaggcattgtgacacagcattaggttactactgaccctttgacagcatgctacctgctttaggtgatcctggattattgagccatgaagatgttggtggtgggatgtcaggagcagacaatgtcaatgactcatggtcaagtagcatgtacagtgtggatacactggaccaagggataattcacatcctgggcaggacagagctaccagaaaggtgcacaattgaaaactatttctaaaaatttccattcaatattttaggacctcagttgactgtagtaactgaaattgcgtgagtgaaactgtggataagggaggactactgtaatgctattcatagactattattactcaaggactacaaacacattctgcaatttatttactataatgaaactttccatctgagtattgggaatctgttgttctgagcagtcaagtttgcttagggttggtttaaagttaagcagtagaatataacgttaattacatttgatggaattttccccctaaaatttatttttcacttaacttttctcccatttcttaacattttattatggatttaattaattaattttttattttgacataacttcagatttatagacaagtgaaaagaatagcacaaagaatctccttacaccctttcacatagatttacctaatgttaacatgttaccatatttgtattatatctgcttataaatacatatacacacgcacatacatccatttatgtattattttttctgaacaatttgaaagttacagacgtaatgttccatcccccctaaatgtttcagtgcgtgtttccagaaaaacaaagacattttaataaaaataatcacagtacaaattatcaaaaccaggaaattgaatggataaacaaaactgtggcacatccatacagtagataatactacttggcaataaaaggaaaagaaatactagtatttacaacaacatgagtagatctcagatattttatgctaagtgataaaagccagattcaaaggttacgtacgatataattccatttatatgacattctgaaaatggcacaaattattgagccaacaaatcagtgattttcagtggggagagggttgactattaaggagaatttcaagagaattttgggagtggtggaatttttcattttttaatggcggtgttatacaactgtatgtttttgtcaaaacttacagagctgtataccaaaaagggtaaatttttctgtatgtaaattttaatggtggggaaacaatcaggaaattaatattgatacagtgttattagttcacctacagaacttactaaaaagtttccaattgcctcaacagtgtgtgctatacctctttagtttcctttaatctgaaacaattccttagtctatttcatggccttgacatttcttaggtacaaactagtaactttatggaatgaaatactcatttttgggttagcctgatgttttcttataagtagatttaagttttgtggttttgacaaggatacctcacaagtgatgtgctgttttcagtacatcatattaaaaggcacataatcttaaggtggcatctgctggatttctccactatgaggttactcttttttcattgtaactatcaagtatcttatagaaaaaatattttgagattatgtgaccatcctgttaacttgtcaaactttcactcacttattgtagttttaaattttacttaggtttttgagatggtgtcttgctgtgatgcccagactgctctcaaactcctggactcaggcagtccctctgcctccacctcctgagcagctgggattacacgcatatgccaaagtactaggctcacttgctaattttagcacccaatgatgattcttccttatattaatcacttatccttaaatagaatttattggatataatttagcctgatgatctaggaaaattatgcacatagcttattgggaatcctcatagataaagatgcaaggaataactgtgttgctgagctttcctgggtgatgttggacaggctttgagaactgttgaggtgactacttaggtatacatggctatttcatcattaccccttaccctcaagactgtagacctagtaatctcattcactggcattctgcttctactctttagtattaggagggttcctaatccttgttcctgatatcatgactgtttaatgtccctacctctatttttttgtaacaacattataagttggattttttgtttgatttgatttctcatgatggatggcccagagtaaaagtgttgggttaatctgtattaaaagaacataccaatgtttatgggtttcccccattttttgtttaagagttatttttaacaataccatttaaatattctttgccctagtgggatagaaaggggaaaggaactcctaagaagctctgtgttctatgttaggttagtaacaccctttaagctccctttgtgttttcattctttagacattttcataatacccacccagtggttatccatctaaatctgataaaatagagggtcagtaaaaagaaaattgtgagtatgggctagtcaatactcaggctgttaaggttgagatgactatttttcactttataattcagtatagaggagtttgccagcaattgtgtatcagcccaagtacctgtataataaaaatgtgatttatagtatctttggtatgacaaacttccagcaaaaagtaattaggctccaagttatatgataacatttcaaaaaacataattaattttgaaatacaggatcttacactgaattaaacaggtttagtttatctgatctttttatttatttatttaaaggaggaatttcatgacctgaaagagagttacttgcaaattctaagtttataattggatactggcttaagcttctattatataaggcatttaattttggtatttaaaacattgatctttacatttaaaaaaaaaaagttaaacatacaacttgatgttatggggtaaataaatgttgacctttccctttctttgtttgatactcttacatagcatgtattgccagtcgcctcatttgtcaagctttgtagtcattaattcaattatatccttcctccattttttggtagatgatctccattcctttttttccaaacagggaggaaaagaagttagaactctgaagttcttgagtctctgtccctttctttgtaatatagcatgctttttctttaattttagggacttttacaagggatcatcacaaatgtaaaatatcaagttaaacctcataagatatttctgcccaaaagaaacacattagggtactggcctgtcaggcttactaaaggtgacacacaggtgtcagccacagaggtgaaagggcctcagaatgacacagtacgttttttatctctcagtatctttcaaaatgtaatatctaatagaaaccaaaaaagtgaaatttacatgtaggtttagaacacagtaatgattgtatattaataatttcatgcttgtatgaaaattttcagataaactctcatgttaaaaataatttctgaacctacaaataaactaaccctcctgttagaacgttatgactatatgtaatgtaaggaatatattaactgtaagttttttgttgttgttgttttgagacggaaccttgctctgtcactcaggctggagtgcagtggtgtgatctcggctcactgcaacctcggcctcctgggttcaggcgattctcctgcctcagactctcgagtagctgggattacaggcacccaccaccacacttggctaattttgtatttttagtagagacacagtttcagcatgttggccaggctggtctcaaactcctgacctcagatgatctgcccgccttggcctcccaaagtgctgggattacaagtgtgagccaccgcacctagcacaactgcagggttttaaatattaatgttattaatgttactaatgttgttgctgaaaatggaactcaaataatatgtaatttggattttctgtattttgccttgtagatagtgatttacatatattgactagcagatttttagtacttatgaactcattttcagttggattgttgtttttttccccctcctaagtatataaaaaccccactgacattttagggcctctagctgctgtttgaggtgacagtgccaaggaatggactctaatcctaaactactgagtaaatgtttttttaagtcctatgctacttttatcaaagaaaataaaatcaaatctgagaagagggggaagagaaataactatttttaggacccagacttggagatctgtgccaaccaaacatctactataatcgagagaaggtaataatcatggttttagttgtcatcagctaagtgtgggctggaactttcttgtatccagtgtcaacctgtgtcaaagtgcaagctagagatctaatgaatatgatctcctacacaatgcttaaagatacatgaaatacttcccatctaaatccttacataatttatttatatacatgggcatatgttttcttttacatatgtgtatatctgtatgtatacaaatcttcaagtgaataattgtataaatatatgtatgttctaacttacagaattagaaatgtaattcagtttactcccaaaggataagattgaagataatgagaactgaattaaagcttactttctttcacagaattcctcagagagagaagactgtaataatggcgaaccccctaggaagataataccagagaagaattcacttagacaggtatgaaattcagccttacttaaaataaaaagctaccaacagcaaaacaaaagacaggaggaaacccttgatttgccattctttaagcactggagcttatattaagagtactcggacgttggcctggccatagccatcactttcaatcaggtgacatggttttcccagttatttaaaaaacattctaggtatacatgtacaggacagctggttggcatttttaaaaaagtataaaaacagatctgcctgtaataaagttagcccttttagtatgagcaatattttgtttgctttttctagaagaaaaggccattgttaataataacttaaaaaaacagcagccgggcaaggtggctaacgcctataatcccaccactttgggaggctgaggcaggcgaatacctgaagtcgggagttcgagaccagcctgaccaacatggagaaacccagtctctactaaaaatacaaaaatttgctgggcatgctggcgcatgcctgtaatcccagctactcaggaggctgaggcaggagaatcacttgaaccccagaggcagaggttgcggtgagctgagattgcgccattgcactccagcctgggcaacaagagcaaaactccgtctcaaaaaaaaaaaaaaaaaatagctcaccactgtgccccaatagaaggtaacacattttacttgtgaaagttcaataccattgtgttcttgtaaaaattagaatgtccttggcaaaaacaagaaacgcaagttcttatgatgttgccagagaataagtgtgccacctattcatttttatttttattattttattttatttttatttttgagacaaagcctcactctgtcgcccaggctggagtgcagtggcgtgatctcggctcactgcaacctctgccttctgggttcaagcgattctcctgcctcagcctcctgagtagctggaattacaggtgcctgccaccatgcctggctaatttttgtattttggggtttttttttttttgagacacagtcttgctctatcgcccaggctggagtgcagtggtgtgatcttggctcaccacaacctccacctccagggttcaagcgactcttctgcctcagcctcctgcgtaactgggactacaggtgcccactaccacaccgggctaatttttgtatttttagtagaaacggggtttcaccatgttggccaggctggtcgcaaactcttgaccttgtgatctgcccacctaagcctcccaaagtgctgggattacaggcatgagccactgttcccgacctaatttttgtatttttagtagagacagggtttcaccatgttggccaggctgttctcagacccctgacctcaggtgatctgcccagcttggcctcccaaagtgctgggattacagacatgagccaccacacctggccctgtattcatttttaatataaaattggatacaatgagcctgagcagcagtaaaaataattctaatttacttggatttatagcattgttctaggaaataggagatctaatatttgttgagcacccaccgtgaacatgatgcttatttgatttaaccctcacaataaccctgtaaagtttttagatatgatgtgacttccaatttatagatgaagaaaatggagggttagagaggttagatgacttgtctagctaattagtgatttgatactcagatctcagtgtttccaaagcgtttctacttgtgccttctgacttcagtttatatatagtgtttagagggaaagtacttgaaactgtgacacattcattttttaatttactatatgttaaatgttttttggatgaacacttcttttttttataaaaataattgtttagtaaatagaattgaatcatccaggaagctttaaaaaaaaaaacaaacaaaaatccacaaatgatcagtaattgatgttgagacagttacaattttaactgtttggagaatcaacacctgatctgttcatctaaaccaataggacaatactgaataagataaattgggaagtaggaacactctgcccactatacagaaacaactgtcggaaaacaatgacacaacaaaagttttggcaactttatttaagctaacaaacgaattttctctctgcaaagttataaattaattttaataggctgatccagatggtccatttggaaaatggataggctgatctgttgaaaattaaactaaatttatctctctcatacttcaaactgaagcaagagagagaatcatgcctattaagtccagcacatacagatggaccagcaggtcacacatgggactaatctgattcattttaaaaataaatgcatacattattgaatcattttctacttgcaagatctgttgtgtgcaatattcgaaagagatttaatgttgtttttttcattgccgttttagcaggttctcttccccactccccctgcccactttaatttaacaaccttcccccccaccccccccatggtgctttgaaatgatttttctaatatctgtcattcagtgttgagatccaagctctggagattaattaggtcatgaggctttttctcctcccttctttgtaaagggttttatctccattctctttgtgaagagcatgaactcaatgttcttggaaagagaaatggcctttagaaacagggaagtaggagatcctcctggggccctcagagtcttttagcttctgggtgttttagcagccccatgaatgcagatttgtaaatttattgcagtgccatctggttttttgctcgaaccagattactgttggcttgtgtctgtctattgtggtggtcactccctaggagcttgccctctctatcttagggaagagtgatgaatagcaggggtcaatagaagcgggtcacagggcagctgtccaggactgccctgaacttgattaccccattgctgattttttttaaggtaggacatagtatataagctgtttaaactccctcttttctctattgcatatgacaataatgaagtgccatttgctattttgtttttttgtttttgttttgttttgtttttcctgtagtcaacttctgtagacaaaaagatgtcaaggccgccttatacctagtattgatacaagtaggatttgcatctcattaacttgagattcttttgcagatatttctaatgggatttcagaaactcactattgattataaaaagttcagttatcttctagcaatttaacattgtttttaactaatattatagttgacatatattattcaaaaatagcgttttgccattgttgataggacataactactgcatgttaatttggagagctatttaaatattggaggagcaaacaactttataccaaaaatttggcaagttgaacaaattccttgaaaaatacaacttaccaaaactcttaacacagggtgaagcaaaatttgaatagcctgatgtctattaaataaatttaattaatcatcagaagggacatgtggttttactggtgaattcaacaaatatttaaggaagaaatgatacgaattttatgccagaccctttcacagaatagagaaggaaagaacactccttgacttaaaaatccaccataacagtaattccaaaacccgacaaagatattaccagaacaagaaataatgaaggtggaaattaagagacactgttccctgtgtctgtcaccaagtcattttgtatacctgctttttcgtttcatttccagcatctgaagatggaagagtttggggtagggagaggaagtagagcagtgtatccttgtaaagaaagttaattttcttagtttcagaataatctcatttcttggcattaaatatgaacttttatttaaaggatgtacaaaatagctacaatttttgttttactcctaaaaatgtgaagtcaaggaaaggatagccactgttttcctaccttttattcctatctgcaatcaagggcaaaggcctgggaggatacatgaaagtactcattactttttgaaaattgtggcattacaacgttcaactctttgcttctcattggtgctaataggatctgtcagccctgcctttctctgtaattgagtaaattgtgaccgttgtctaatccctctcccatcccccatttcctttgtgtatgtgtccacttaccatcctgagaacgtgggcagtgataaataaagcattgagtagagctctctcaactctctgaaagcagcatgatgccagccctctagttatatttctttaagtgtttaggtttttctgtattctttctcttgtgtagctggaaccctggggatgcaaagccatgagagaggccaagaagctaacaaagtagctgtctcccttgttagcttgttcctttattctttaaaaacaagataaaaaccatctggctcagggcattacattttcctcccccatgcacctctatagatggagacttcacctgcagtgagggtttacattgattagggagggagcagtaattcaagcttccatcctcttcaaggatactttgcagtctttaaaggtgctgacccactgagttagactgtcaagggaggataaaaaagtatcttcatcccaggaggtaacagctgccaggttttcaacaccttgcacgctgctggaaaaatgtcacaattgtcagctgaaagaaaaatgactgtgttgtcatcttctgttaatgactgggccttataaaaggaactacataagtcttttagaaggaataagtagctgttttccttttctaccatattcccctcccctgaaaaaattcctgcgttctaaacattgccttggagtagatccacaaaaaacagcagtgaagaacttaaatcagccagtataagcatggaagtctgatgggcatagctcctttatacagttggatgagtaggaggaaaaagcacatcactgacacagaaaatgacattatagtgtgtattaacaaaacaaccacaacaacaaaaagtcattcataagccagtgaactgagagaaaacatactgtatttctgttctttggaggacaatttattttcaagcagcatccagatgggtaaataccaagacatttcttttttcaagagagctccttttcttcctttaaaaaaaaaaaaaacacagaatttgcttcctttaatagctctgtaatgttcatatatgatggcattcccttctttctgatttgattgatgagggaaaaaggtttaatgaagtccctgatatcaggcaggcagggttttttttttttttttctctctatttgttttaggttagtcactttaattgtattgagtaattagaaggtacacacagccaagggagctttgttctgataattgctcgagaaaacccattccctatctgccgttgctttgtgttaagacacttctccctctagtggcaatagtaagcactttggcttggcagtaggcaaggtgtaattgcaatatgacaaactatgcttaagggactgtcttgtaaatactttcgtttggggtttgcattatttcattatatatgtgtggttggttgttgttggttttttttactctataaaacttgctacctctttttgccctcctaaagtgctttgggctttgggtaaaaaaaaaattgcctgagatgtttattaataaaaaaaatcacaatgcattctgggtaatgttttgcagcttgacttaattttagtcatctgttttaattacctatttataaaaatgcctttgcatttgtagacattatttaatactttggaagaagcacctcatttgaaataaataaataaattgtacttattttaaatagtccatgtaaaagatcttaaaggtaattaatgtaggtctcttaagtaagacaaaagtgatctttccaaatctgacgaagtgatttgtttatataacttcccacttctgttgaatcctttagagtctaataacttttttaagaaaacacggtttggcaatttgtgcctagctacaaaaacccttcttcaaaaaggagcaatttaataaccggctttcttaaaattactttgaggaaggaagaccgtatggggggttggtgctttgttttatttgtattttaatgtaatcattctttgataaattgtgtaatcactgacttagtaggaaaaatattattgaactcctgggttgcaatgaccataaagagtgtattttcatatagagagttgtgatactgggaataaattataaaggaaacagtttatatgctggtcaaagtccatatgggcccaattcattttgttttcagtgcttactctggatgtaccattaaaaaaggcggggggtggggtgggaggaagcctgttgtgctcatctgcatgagccctaaaaaaaaaatctgccctaaaaacaacacggaatgatagcagatgcagctttgcatctattgaacaagattcagtagcatctgtgtggcatttttaaaacccacttccagcttccttagatattgctttttggtttgctttttctataccatattcttgtgtgggacatgatttgatgttaccatgtatctggaagtccctgtcttcctatacccccactcccagtcactaacgattttcattatactatatcttgttatgctatagggctgctgaacagatttctaagcagctttttgcaaggttaaaacaatgcagcccagtaacaagtttgtgtaattttaaatatataccttctagtaaataagggcaagtctggcaatcaatcccttttagtgtgttatatgtttcacctgacaactaaaccttctattgattagccattactttgttagataatcctatgtcattgaatccattgtaaaaaattaaactctttaaaatgttttaccctagcagcagtgtgaaaattgaaaacttgttcagaattacagcctgctttcacaaagaaggtagttttcagcaaggcatcttactagtttatgcttatgtgctttatatgcgatataaaaacgtattaaagtactccaacgcaaaactctctgcctctggttcagcaatgaagctaccttttcaagtgttgcatggggacagaacctatcttgcctgtggctattatattcactagttggatttcaaactggagagagtcttacaggaaaatattgaatggaaaatattgaatgttttagccttttaattgcagagtggtaaaggaactatgacaaattttagtttattgatctgtgttacttccttgggagatcagcaaagtcatttacccattttacagatggaatgtctagaaaataaagtcctatatatagccctactctggaaactccctcaggcctggcacagagtttctgaatctatctaatggtcccctaaatatgttattacatattcattcatgaagggaaaagagggtaattttgaaggaaaataaattttctttttataacttagtattttcagaaaaatagcatgatacatttattgatgactggacaaacctctgtaaaaaatttactcctaagatacttctattggaagttttcatacagtgaattttacagatattaattgtataagtctgaatttttgataaatctaaccacctgtgtaaccaccaccctaattaaactatagaatattttcataacctaggaatgtctcttgttctcctttctacttattttctgcaccaccaatggatcaaatactgatcagcttactgtcactgtaattttgccttttctagaattttgtgtaatggaatgctatatttttggggtctgacattcactttgcataatgtttgtgagattcctctatgttgctgtgtatatcagtagtttattctctttcattgagttgaataaatatatcgcagtttgttttctgtctccttttggtggatatctgagccatttccatcattataagtgaagttactatgaacgttcttctataaaggtttttggtgagcatatgttaagtactttttcatgtgcttattggttattcagacattttctttgtgaagtatcttttaagtttttagccatttttaaaaattgcattgtttgcctttttattattgagttgtagactcaactgtattgaattctggataccattcatttgtcagatatatgtactctgattatatctcacagtctatggtttgcctgtttatggtatgttttgatgagaagtttctaatagttggatgaaatccagtttaccaatttttctttctttttttttttttttttttttgagacggagtctcgctgtgtcgcccaggctggagtgcagtgacacaatctcggctcactgcaacctctgcctcccaggttcaagcaattcttgtgcctcagcctcctgagtagatgggattacaggcatgcgccaccacatgctaatttttgtatttttagtagagacggggtttcaccatgttggctaggctggtctcgaactccagacctcaggtgatccgaccgcctcagcctcccaaagtgctgggattacaggcgcgagccaccgcgcctagccggttttttcttttagaagggatacttcctttggtcctacctaagaaatctttgtctaccccatgattgtgaagatattcttctaagttttcttctgggagctttataagtttactatttatacttaattctatgatccatctcaaattaattcttatacgtgccatgaagtagagtttgggcttcattatttttgccgtaatttcattcagttgtttcagcaccattgttgaaaagactttcttttcccccattgaattacatgaattcatttgtccaaaccatttagttatataagagttatattctcaaacctcctgaagaaaacgttgctgctggacccagagcagtgggtgacagtgcctaaggtactgacccatccctattttatgtccctgtagacaaggcggacaagaaaaatgataggtgtctatccttgcaccaaataccatagtgtcttgattattgtcattttatataatgggccatgaaatcaggtagtgtgagttctctagatttgttgttttattttttgttattccagatagttcacatttctatataaattttagaatcaaccttgcactttctattaaaaagcagtctgtgaggggctgggtgtggtggctccctcctgtaatcccaacactttgggaggccgaagtgggaggatcgctggagcccactgagttggaggctacagtgagttatgatcacaccactgcactccagcctgggcaacagaaagagaaactatctccaaaaatagacagacagatagataactactttttttttcatctgagatatataggattttgcccccgttattctgttaatacgacaaattaccttgatttttgttaagagtttttgtgtctgtttcatgtgaggtactggtttgcagttttcttttttaagtgtttgccaggttttggtatcagagttatgctggtcttataaaatgaattgggaaatcttcctcccatcctcctctgttttctaaaagcacttgtgtataatcctggtggtgtttcttccttcagatttcatagaattcacaaaccacttgggcctgtagttttctttgtgaaagattttttaaacttattatttaaatttatgtggcaagatgttttagagcaatttgaatttcttttagaggtatagagctgttcagattttctgtttcatgtgtcaattttggtaatttgtgtttttgaagaaatgtttcctgtttattcaacagattataatatgttaatatcttttattttaatactgtgattgtttcatattgggctactgaaagcctctttcggcaggcttccatgccccctttgacgtatcttcatcgttctgagtatttccatcttatagtttccctggtcagtcctggagtcaaccatatttccatgaatgtatgattccctttagtgcagaatggtatttaaaaaccaagattcaaacactgacttttcttttacatctatatttatatactttgaaaccattagttcacattgataactccaattctaattcaaccccacagggtttgttctagatttctttctttccatatttcatttttctcccttccttccttccttccccttccttcctttttcttttcttttcttttcctctcttctcttctcttctcttctcttctcttctcttctcttctcttctctctcttctttctttcttgtttttggtagagaggggtctctccctatgttgtccaggctggtcttgaattccagagctcaagcaatcctcctgcattggcttcccaaaatgttgggattataggcatgagccaccccacccctttcctaacataggaaacctggtttaagatttttttcctttcagcactttaaaaatattgttcccagctgggcgtggtggctcatgcctataatcccagcactttgggaggccaaggttgggtggatcacctgaggtcaggagttcgagaccagcctggccaatatggtgaaaccctgtctctactaaaaatacaaaaattatctgggcatggtggcgcacacctgtagtcccagctacttgggaggctgaggcaggagaattgcttgaacccgggagacggaggttgcggtgaaataaaaatattattcgcttgtctcctagccttcatttttttatgaaaagcctgacattatttatatcgttactcctagatacctaacatcccctttttccttggctccgttcaaggttttatctttatcactcgttttcagcagttctgactgtgatgggcctatatgtgttgttttctttgtatttttaacatgactggggtttgctgatctgaaatcagaaagccgctagttttcacaaaatttggggaagtatttgatcactatttttataacttctttgctgtaccgttctcttctcccttccttggactccagccacgcatatattctagataatccagaattgtcccacacagtgactaagaccgatcttttttttttcttttcttaatctcctttttttctctctgttcttcagtttatatgatttcagtttatctatctttttttttttcggtttatctgtcttcattgaccttttcttctgtcacttccagtctgctttttaagcctctccagtaaattttttgatttttttgagatagggtctcactctgttgctcaggctgaagtgcagtggcatgaacatggctcactgcagccttgaccttctgggctcaagcaaccgcccaccccagcctcctgagtagctgggactacaggtgtgcaccactatacccaactaatttttcttttttctctttttttttttttttttttttttgagacagaatctcaatctgttgcccaggctggagaacagtggtgcaatctcagcttactgcaacctccgtctcccgggttcaagcgattctcctccctctgcctcccaagtagctgggattacaggcacttgccaccatgcccagctaatttttgtatttttggtagagatggggtttcaccatgtttgctaggctggtctcaaactcctgacctcaggtgatctgcccgcctcggcctccaaagtgctaggtgtaagtcactgggcctggccaattttttctattttttgtagagacaggatctcactacgttgcccaggctggtcctgaactcctgagctcaagctatcctcctgcctcggcttcccaaagtgctgggattacaggcatgagccaccatgcgcagcctgaatttttcatttcagataatgcacttttcagttctagaatttctatttagtttatttttggtttttcattttctggtagaatttttcatctgtttattcattgtgatcatatcttttattgctatgttcaagtttgaacatatctattatagcttctttagagctataatatgtgctaatttctacaactaggtcttctcagggttggtttttggttcatttttctcttgacaatggatcccatttatctcctttttctcatttttagtaatttttgatcatataaccaacattataaatggtacattgcagaaactctgaattcattttttcttcctctgattaaattactggctgatcactatgaccttgtggaggcttggttttgtatttgttaaggtcaggtgtattttggttttgcccttagtcctaagacatactcttgaatctaaactcatggtctctttgaatttttaatggaaagcctaagatgttattacatccctctaacttgatagaagtcaaactctaaactctttctccccccatgagcagcagctggaatatctgcacaggcctttcaaccctccagctgttgctctccattgaaatccttggaatctccccttcatgtacgtagtttgggtgttagccatagatttgaggggaatttatatgtaattttttagtcttcctccttcccctgtggttctctttcatttctgggatttctgttttctattgccagccactatggcagttttgaactcttatcacttgatatctcaagccaatagactgtggctttcagattgaattctagtcaccctgcaccaagtggactcgtgagtgccttcaggggaaaagcacataaacacacatctcacccagtgtggttctcttctttcaagatcaggccactccttccccattttccgtcttttttaagtcgatctccagtgcctttatgtagctttaaaatgtttttcctatctgcaagagggtttatctgatacaaacatttctgccattactggaagcggaactctttgagtcaagttatatttttttcagcaaatactgattacttcataaatttatctttaaaacatagtgaattttattttaaaaatatttatgtttgtgtgtgtatgaatagtaaatgtttgtggaattagacaatgcaaaagaaataacaaatctagagcccagaatttacatgcaccaatatttaaatctgtacactaatttctaatgctctattttttcatatatattttgaaataatttttacttaaattataagaataaaacaagttggtaaattttttaaggtttagcctgtttaaaagaaaaacagctgggcgtggtggctcacgcctgcaatcccagcactttgggaggccaaggcaggtggatcaattaaggtcaggagttcaagaccagcctggccaacatggtaaaaccctgtctctactaaaaatacaaaaattagccggccgtggtggcacatgtctgtaatcccagctacttggtaggctgaggcaggagaatcactcgaacctgggaggtgcaggttacagtgagccgagattgcaccactgtactccagcctgggagacagagtgagactccgtctcaaaacaaaaacaaaaacaaaaacagaactgactttataatatcgatggggagttatatatctctactattttccccattttttcttaaattttatctattttctttccaaagaatgatagttgaccaaaatcagattctttaaaatatctcttcatgctgatataaacaaatgagtaaataaataaatgaggggtgaaatcacatcttttccttacagaagaattccagttaatgtggaaggaaagacaaaaataataaattcactattagaatacacagtaaaaattaccataggcatgattagcacccaatggatgctaaaattagcaagctgagatgcaagtagaaacagaatatttgcatagtctccaagtattttgccatatatatatatatatatatatatatatatattcagtaattcctaaggggaaaataatgtttatactggagaatcttggcagacatgtccttagctgtataatcaaggctaacatcaccagaaataccagcataccttctgatttgatgcagtgagaggggcacatcacctctaaagtatctttccccaaaataacctcaatctgatcatgagaaaatatcagacaaacccaacttgaggcacagtctgtagattaactgatcagtgctgtttagcagtgtcagtcatgaaagacaaggaaagactgagggattgttgaaaataagaggagccctaagagacatgacaaataaatgccatgtgggatcctagattagatgctgaacagaaaaaggacattagtggaaaaactggtgaaacctgagtaagttctgtactttatatagtaccaagttaatttcttagtttcgataaatgttctgtaattatgtaagatattaacatatggagaagctgggtgacaagtatataggaaatctttactttttctttctttctttttttaaagagatgatgtcttgatttgttgcccaggctggagtgcaatggcataatcatagctccctgcagtcttcaactccagggctcagtcagtcctcctgagtagccaggactacaggcctgtgctgccacgcccagttaatttttttttttttttaaatagaaatgtgggcttgtatggaactcccggtttcaagtagccctcctgcctctacctcccaaagtgctgggattataggcatgagccactgtgcttgaactttactatttttgtacttgttctataaatctaaaattatctcaaaatgttaaaaaattgaattctttgttactgttggttttgagtgtcttaagatttttcttcttaaatccaacacaagtatttatagcaatggttctcgaagagtgttcctggatcagcagcactaacgtcaactggggccttgttaaaaatgcaaatgttcagaagctctggggatggaaacctagcaatctgtgtttgttttgttttgagacagagtcttgctctgtcacccacgctggagtgccgtggcacgatctaggcttactgcagcctctgcctcccgggttcaagcgattcttctgcctcagcctcccgagtagctgggattacaggcatgcaccaccacgcctggctaaatttttttatttttttattttctttttttgtatttttagtagagacggggtttcaccatgttggtcaggctggtctcaaacttctgatctcaagtgatcctcctgccttcgccccccaaagtgctgggattacaggtgttagccaccaggccccaccgtgatctgtgttttaacaagccctccttccagatgattctgatgcgcactaaagtttgataaacataatttataccatcagtaaaaacttaagactaaaaggaaacatttctattaatatattgtccagtaattaataagtttgcttttcataaagtataactatagtattaccaatgttttgttttgtttttggtagagacagggcctcgctgtgctgcccaggctgatctcaaactcctaggctcaagtgattcccctgcctcggcctcccaaagtgctgggatcacaggcatgagccactgtgcccagctatcaccagtttttaaaatccatttcctatgatttttttctttcttttttatttggagacaatgtcttgctctgttgcccaggctggagtgcagtggcgtgatctcagctcactacaacctccatctcctgggctcaagcgattctcgtccctcagcctcctgagtagctggaactacaggcacccaccaccatgcctggctaatattttgtattttagtagagacagggtttcaccatgttgcccagggtggcctcaaactcctgagctcaggcgatcttcccacctcggcttcccaaagtgttaggattacaggtatgagccaccgcacctggcctgatttttctattttatctcttcaacattaccagatgtacttaagggataacttctaaggtctagataggcccagtgaggctgctcttgcctgtaatcccagcactttgggaggccgaggcgggtgggtcacctgaggtcagtagttcaagaccagcctggccaacatgatgaaaccccatctctactaaaaatacaaaaaattagctgggcatggtggcaggcgcctgtaagcccagctactcgggagactcaggtgggagaatcacttgaacctgggaggcggaggttgtagtgagccgagattgtgccactgcactccagcctgggcagcagagcaagactccatctcaaaaaaaaaaaaaataggtaagtgttggtttatcttttttcaatgttctttcaattttggtttatttctcttttctttttaaagccaaaagtcaaagcttgtattgagattcttttataaaaatatttcatgattagttttaaaataattttttttttctggatggtttaaaattttttcatttattgttctgaataagaaacatgtcagctgagcacaatggctcgtccctgtaatcccagcacattagaaggctgaggcaggaggatcacttgagctcaggagttcaagaccagtttaggcaacatggcaaaaccccatctctacaaaaaatacaaaaaattagctgggcgtggtagcgtgcccctgtagtcccccacctactctggaggatcacttgagtcccagaggcatagattgcagagagccaagatctcaccactgtacttccagctggggtgacagagtaagaccctatctcaaaaaaaaaaaaaaagaaaagaaaaaaagagaaagaaacatgtcctctgtgggaggctgaggcaggagaatcgcttgaaccccggtggcggaggttgcagtgagccgagatcacgccactgcaccccagcctgggtgacagagcaagactccatctggggaaaaaaaaaaaaaaaaaagaaacatgccctctaactaccttcagatcttgatggttttgaaagtttagaaggaaaaacaacaaaaataaatcttttctcagaacggtaactgctgttttaaacagaactaagctcttccaatttgcattttaaaatgctacataatcagtacccccagcttccattaatcattaatacagtgaagccactgctgcttacatacttgttcatgggcacatcagtggcttttgtagcctctatctttgccctccttttctaacttacctctcagttcccataagtcttaacttatagataaaatctatttgtgttttgacttgagaaatagagcagaatttgaaaacaggatatggcagtatttcaatattttaaaaacctgtttccaacaaattctctttacagacatacaacagctgtgccagactctgcttaaaccaagaaacagtatgtttagcaagcactgctatgaagactgagaattgtgtggccaaagtaagtaatattgctcatcaatgtatattacaccacaccataacagtgccatatctgtaggcatctttactcagtattgcttaaggattattacaggattatatagttaagaaaaaaatacaaacaggcatcattttatctagaacagattgcaagttagattctccacctcttaattgcaacagaatgttttgcttatgaattctggtcactctttagactgattcacatttgtttcttgacactagttgtagattatcacatatcagtaggatttgtataagataatgtacaattgttttgataagtttatggtttttaaatacagttacgtatagagtacatcacatcattgcaaggactgtgaaatatgctatagacaacccaattattatatcactattattatttattgagtggctaatgttggaaatactgcttttgttgatcttgatccacatggacaagtatgtttagtcatgtgtatgggctacctctttttcatgtatatatgtcatctctatagcctagatgtaaaattaatcttaaatattagagatctgatgctttttatatctatcataactcacattttccaaatatctgtaattactgaggaattttgactaaaattcaagtgtcagacattttaggaataagtactattaagtatgggctttgtttcttttacttgaattatctgcaaaaatattgcctttatatctattcatagatttgctactgttacaacattcccaacttgaactattttagtttaacctattttattatagatccaggccctcagtttcttactgttattattagagcttaggactggtgtcatgtcattgctatctttgctacaaaaatctaatgacagttgtcttagtccatgtgagctgctataacaaaaatactgtaagctgggtggcttataaacaaaactaatttttttcttataggggctgagaagtccaagatgagagcactagcagattcagtgtctggtgagggcttgctctctgcctcatagatggtgccttctcactgcatcctcacatgatagaagagactagctagatatccgaggtctcttttttttaagggcactaatcccacttacaaggggtctgccttcatgaattttggagaacacaaacgttcagaccatagcaaaagcagagtttttgtttatttttccttaaaacatgcagtagtctctgggcctgctctatcaactggaaatgtatcacacaaaatataaccatcgaaatcatacatataagaaatatcagaatttatttaaaattacagtttaaaaaggtagagttcatcagttaaatgtctcaaatccaaatatgttaatattttgctataaaatgtaattataaattacatatttttcagtcatttagtcacaactaacaagtgctaattgaccctattttattttgttttgttttattttatttttagagacagagtcttgctctgttgcccagggtagagtgcaatggcactaatcctagctcaatgcagcctttacctccagggctcaagccctgatcttcctgcctcagcctcccgagtagctgaaaacatgagtgcatgccaccacacccagctaatttttggttttcggttttttagagttgttttgttttgtagagatgaggtgtcgctgtattgcctaggctggtctcgaactcctggcctcgagtaatcctccccactaggcctgccaaagagttgggattacaagcgtgagccactgcacccagcccaagtctactttatatcctgcttttgtgcatggaaacagggatacacagttatttgggcctttaaaaatattctttctttctttttttcttttttttgtttttggccatgctgctcttagtttcatcacaagtgggtgacttctggctaaataaggtaaaattttagcatgagcaccaatccaaggacagggtgatgattttaatgagtttcactgag

SEQ ID NO: 766 - DNA, 28316 bp, Human
  misc_feature (1)...(28316): n = A,T,C or G
accaaccaccacccaccaccactaccacccctcaccacccaccaccaccgccacccaccacccaccaccatcacccaccaccaccaccatccaccaccaccacccaaccaccaccacccaccacccaccaccatcacccaccacccaccaccacccaccacccaccacccaccaccatcacccaccacctaccacccaccacccaccaccaccaccacccaccaccacccaccacccaccaccaccaccacccaccaccacccaccaccactaccacccctcaccacccaccaccaccgccacccaccacccaccaccatcacgcactaccaaatatgtgatcatcaaaggtagaagcttacaacttgtggaaagacagataccactctctggcctggggtgggaggacagagtatgactcgtcctcaggcaggttggcttcctggatgatcagagaagtagaatctagggtgaaatgaaacaaaagtagatggagaaatctcaacaggaccaagtagagagggagaatttaggaatttagttagactgcagcaaaagaattcactgggtctctggccctaggctaaaaactatagaactccaaacctttaatgggagggggtacttcatggggcatgtctaagaggagtgaggaatgaggttaatgtgattctacggaattagacagaagtctgtatggctgaatgtactgggtttaacagcaacgttttagttagtttttgatattattgcaatgatgcactccagcaggagacaaatcctggcaggatgcatggttcaaagaaataccaatctttcaagagtatgtttaaacaaatttcactataaaagactatatctctgggaatgtcaagcaattggttactttagcagaaaaaaaaaaactagccatgtgacaacatggggataaaggaaaataaacacagtggacatgttattttttctgaaagtaaaatcgagccattttctttcataatctagtacagtcatgtgagaaattctgcttcatggtgatctcaagcaacagtttattggtggtgtggtacccaatagattgtgggtatggttgtaaatatactaaaaaacattaaattgtatgcctttagtgggtaaattttatggcatgtaaattatatctcaataaagctgtttaaaaaagaaaaagtaggaaacaaaataaaccaaataaaagtactaaaatcacccataattaattccaccatacagagataactgttaacatttgtttaaggttttcttgtttgctttttctaatttgtaaaagtcatatacgttcattaggggaaaaagaccacttagaaatgtttgcttgggccgggcgcggtggctcatgcctgtaatcccagcactttgggaggccaaggcggggggatcacgaagtcaggagatcgagaccatggtgaaacccagtctctactaaaaaatacaaaaaagtagccaggcgtggtggagggcgcctgtagtcccagctactctggaggctgaggcaggagaatggcgtgaacccgggaggcagagcttgcagtgagccgagatcacgccactgcactccagcctgggcgacagagcgagactccatctcaaaaaaaaaaaaaagaaatgtttgcttgaagaagaaagtgaaagataattataatctcaccactgacagacaaacattttaacagcttgctgtgtatctttccagacttttaaaagacatagatttatatataaaccagttttgacaaaaatgggctaatactatgcatactgctttgtaacctttaaaagtacattgtgaatatattataaacattctttcacataaatgtttatgatagaaatataaatatattttaagtgaatgctttgctctcaagtcaaagatcaatattcctaactttaccggaacccactagaattatttgctgttgggtcagttggatgaaccctaagtatctttggctgcttttcaggttggctctgacacgttttattccttcaagtacgaaatcaaggagggggattgtcctgttcaaagtggcaaaacctggcaggactgtgagtacaaggatgctgcaaaagcagtaagtgtattggccattcttgggccttctgttttctccgttgaccctgccagatttttttactgatgcagaaatgatggctactggtgagcctgtttatgagaaatgcaaataaacattccaatgtgtagaaaagtcagatgctttatatctgtgttcttgtatagacagaaaaatcatggagaagccagcagttaaacatggagaaagcctttccatgagaagggggctctagtgtccagccagaacatgtggctcagactccagagagataacaaattgacatttgggccaagccaaagagctggcgaggggagggggtgggtgcttccattgcacaatgttaagtgcaaatcttgactctgccttccattagctgtgtgatagcaggggagctgtgacctctcagaactggcactttctgctgtatatgggagataatattgacctcatcaggttgttggaggatgaaatcagatgaattatgcaaataactttgataacaatggctatcttaaccaaatgcctaacatataggcctggcacaccgtagctggttgttttgcttttttttttttttttttttttttttttgagccagagtctcgctctgtcgctcaggctggagtgcagtggcgcgatctcagctcactgcaagctctgccttccgggttcacgccattgtcctgcctcagcctcctgagtagctgggactacaggcacccgtcaccacgcctggctaattttttgtgtttttagtagagaccgggtttcaccgtgttagccaggatggtctcaatctcctgacctggtgatctgcccgcctcagcctcccaaagtgctgggattacaggcgtgagccaccgcgcccagccatggttgttttgctttaattaagaaagatttcagacagtatctgcctcagaagcaagactctcttttcatggattgattcccttcttttatgtcagaacataaaagatgactgcccgtcatctgccattaccaaagagtactgaactccaagtcaggagtctaggattttgcagtgctggttctcccttctcagtcatctcatctgtaaggtggggataagtagctgctgtgctctgtactgcctgcttctaggggctgtgtggacaaagggaggtgtgctttatcctgatggaatagtatctgtcacttagaatccaatggatatgactgaagaatgaaaagacaaaacaaaacaaaaacactgttcaacaataacaattaaacagctgcctattattaagtgcctgctgtgtggcgggcctctagtaggcattttgtgtgtgtttgcacacatactgttcacaacaactctaagagatagatgtatcccatctcctacaagacgggtaaactgagactccaagagtcaaggggacatgacagagttaacagctagcaagtgacaaggctggaactgaataacattttgatgccaaggtccttgccctttctattaagttaaactgaagtttatgtgaacagtattaacttactgaagttgagtggtagataagaggagtgtttagcaggctggttctagacctctgcgtccatcttggttagaaagaaatagctccagggctcagccaggtgcagtggctcacacctgtaatcgtaacactttgggaggccgaggtgattggatcatttgaggtcaggagtttgagaccagcctgaccaacgtcgtgaaaccctgtctctaccaaaaatacaaaattagctgggtgtggtggcacgtgcatgtaatcccagctacttgggaggctgaggcagcagaatcacttgaatctgggaggcagagattgcagtgaaccgagagatcgcactgttgcactccagcctgggtaacaaaagcaacactctgtctcaaaaaaaaaaaaaaaaaataggaaacaaaagaaaaaagaaataccctccagggctcaaaacaaagactcaagctttaaaacctcaccatttacactgtctttcctccagcatctcatgaatatcagtggcttatataaagtaatcattaggctattaaaaaaatttattctcatgtctcaaaactcttttggtaaaatcttcacaagttttgttttgttttgctttttaaggaaagccacatttagcaacagtattaggtagactttcccatctgaaagattaagataaatgatctctttcttttctttttaggccactggagaatgcacggcaaccgtggggaagaggagcagtacgaaattctccgtggctacccagacctgccagattactccaggtggctggtttatcctctggcactgccctggtgggaaattaaccatttctgtgagccaggaacacaatcttgaccaggctctgcttgctcccagagggtggcagtagtaaagccatttgcagagttagggagcattgggtggagcggcagagcccggaggttgagccaggctcgtgaccatcatccccttaggactatcccaactcttcccgtgtgctgcattgtacccagtgtgtgcaagggctcaacagaaggaccagaagacataagacctgccctccattgcaggcagcatcccagattgaggagcgcataggctttgagggcagacctggcctggaatctttcagagctccttgccttcttgcctctccttttccttgtctagaaaagggaggtaagagtacttcccacttcacaggactgttgtgaggctgaaatgagatgatatgcctggaggtacaatcataataacatactaacatattaatcataataacatattagcaacaatcaggataaaagtaatagctaagatatattgagtccttatgtcccagccatgactcaaagcaccttacatgtattatcttctttttctttttttcttttactgatacataatattttacatatttatgaggtacatgtgagtgttttttacatgcattgaacgtgtaatgattaagtcagggtatttggggtatccatcacctggaatagttatcatttctatgaattggtaatatttcaagtcctctcttttagctactttgaaatatacaatatattgttgctaactatagacactctagtctgctatgtaacattagaacgtatttcttctatctaactataattcagtacctattcaccaacctcttcatttcccccttctacccgcttaccccgctcagcctctggtatctgtcattctcttcccttctctatctccatgtgatggttttagcttccacatgtgagtgagaacaatgtgaagtttgtctttctgtgcttgagttgtttcacttaacgacctctagttctgtccatgtggctttaaatgatatgatttcaattctttgtttacggccaaatactatttcattgtgagtatataccacaatttctttctttttttttttcattttgagacagagtctcgcactgtcgcccaggctggggtgcagtggcacgatctaggctcactgcaacctcccgggttcaagcaattctccagcctcagcctcagcctcctgaatagctgggattatgggcatcgccaccacgcccggataatttttgtgtttttagtagagatggggtttcaccatgttggccaggctggtctcgaactcctgacctcaggtgatccacccgcctcggcctcccaaagtgctgggattacaggtgtgagccactgtgcctggtcccccacattttctttattcattcaccttttgatggacatttaagttgatttcatatctttgctattgtgaatactgctgcgacaaacctgggagtggaagtacccctttgataggctgatttactttcctctgggtagatgcccagtagctggactactggatatatggtatttggtgttttcattttttgaggaatctccgcactattttccatagtggttgcactaatttacattcttaccaacagtgcattagagttctcttttctccatttcctcctggctgtgtttaccgcttacatggcaggcagcgagagctctgtggtgaagaagtccaggctcccagggggtccctccaggtgtgccactcactctgcagctacgttccctttttatggactttgcctctattgaccagtaggttagggctatctgttatgaacattacttgataatttaatacaaattctttttaataatagccattctaactggggtaagatgatatctcatctcataatggttttgatttgcatttccctaatgcttagtgatattgggcattttttcacatacctgttggccatttgtatgtcgtcttttgagaaatgcctactgagatcatttgcccactttttaatgggattacttggtttttttattggtgagttgattgaattccttgtatatgctggatgttagtcccttgtgggatgcatggtttgcaaatattgtttttctttctttttttttttcttttgagacacagtcttgctctgtcgcccaggctggagtgcagtcgcatgatctcggctcactgcaacctccgtctcctgagttcaagtgattctcctgcctcagcctcagcctcccgagtagctgggactatcacattcagctaatttttgtattttaaattttgtaattttgtatttttaggagagatggggtttcaccatgttggccaggctggtctcgaactcctgacctcaggcgatctgcccccctcagcctcccaaagtgctgggtttacaggcatgagccaccacgcccagcctcttctttgtttagggcagtgtatgcgaatgctcattgcgatcattaatgctgtgtttttgtctgctctttgttaagccgagggccctgtggtgacagcccagtacgactgcctcggctgtgtgcatcctatatcaacgcagagcccagacctggagcccattctgagacacggcattcagtactttaacaacaacactcaacattcctccctcttcacgcttaatgaagtaaaacgggcccaaagacaggtttgttctttaattctctaagtagcacagtattactaaaatttgttagatctttacatttaaaatgtatgattgcatggctggtggtgttttcatgtgactagcacaggaagcgaagagctttctccttagtcaaagtgagtcggatagtgcaatatgtaaagtgagaaaagatgtcgaatcagacccccttcctttgacgtttgattttaacaaatgggtaatcgtcattacaggctcttcctagagacagtgaaaaggaaaagtcataccggccttaggattttttttttttttttttttttttttttttttttttgagacagagtctctctctgtcgcccaggctggagtgcagtggcgcgatctcggctcactgcaagctccgcctcctgggttcatgccattctcctgcctcagcctcctgagtagctgggactacaggcgcccgccaccacactggctaattttttttattattattatttttagtagaggcggggtttcaccatgttagccaggatggtctcaatctcctggccttaggattttaagaaaactatattatcacctagccatcatgagttaaacacagctccaaaatattaaattgtgtctaaaatggtcggcatggctttctgggtacccactaattacagttcccatatcatcagaaaaaaaaaagtatatatccgtaattttttttttttgacagtctcgctgtgttgcctaggctggagcagtggcgcgatcttggctcactgcaacctctgcctcccaggttcaagcaattctcctgcctcagcctcccaaggaactgggattacaggcgctcatcaccatgtcttgctaatttttgtatttttagtagagacgaggtttcaccatggtggccaagcgggtggtctcaaactcccaacctcaagtcatcctcccacctcggcctcgcaaagtgctgggattacaggcctgagccactgcactcagctacaaatcttcttaatgattcagtacacccagacttttcttcttttttttttttttttttttgttttttgaggaagagtcttgttctgttgcccaggctggaggctggagtgcagtggtgccatcttggttcactgcaacttccacctcccaagtttaagagatctcctgcctcagtatcccaagtaactgggattacaggcacccaccaccacgcccggctaatttttgtatttttggtagagacaaggtttccccatgtcggccaggctggtcttaaattcctgacctcaggtgttcctcccgtctcggcctcccaaagtgctgggattacaggcatgagccaccacgcccgcccctcccagacttttctgatagttgactgggtctcttgtatttcagcctcttattatgagtgattccctttggttagtaacattctctgcatttaataaaccttacaacttgctttcatgcgagcatgctttactcaattatgtccgtatagtgctatcagggtgggagaggcccagaataaagtagaagaaatcttactacttggtaacctgggagcctgaggacccaacagtaaagaccactcccctctaaagttttctttatccgtctagaagggcattattattttatgaaattcagtaaacatttctctctgcagcctggcagaggaaatattgttaggattcacttaaggaaatccatgttccaaaactggctgaaaaatagaaaaatatatatattgcttgtcattttcagatggctagcggtgtatgtgtgtgtgtgtgtgtgtgtgtttgtgtgagagatatgagactcttaaggtgctcaatgtttattcagcatttttttgcctagtaataataatattttatatttcttgggcacttattatattgccacactgttttctaaactcctcataacattcatatcccacagcgaataatgtttaaactgccctttaaatattcaatctgaaattgtttcaggtggtggctggattgaactttcgaattacctactcaattgtgcaaacgaattgttccaaagagaattttctgttcttaactccagactgcaagtccctttggaatggtgtaagtaggcaaaaatttaatgataaagttcttagcattttgtttacattttgtggtaactatcaagctgggtgggaagactgtcacgaaaagtttagatgacattcagcaattcatattcacatttacttgggaagactaaagctcacgtcactggtcaagctgccttacctaactggccaaagaatctgcacagctagcaataagtatttttttataactttattttattttatttattttttgagacaggatctcaatctgttccccaggctggagcacagtggtgtgatctcatctcactgcagcctccacctcgcatgttcaagctattctcctgcctcagcctcccaagtagctaggactacaggcgccaaccaccacgcatggctaatttttgtatttatagtagagacagggttttaccgtgttagccagagtggtctcgaactcctgacctcaggtgatccgcccaccttggcctcctaaagtgctggtattacaggcatgagccaccgtgcctggccagcaataagtatttacagagcataaccagggactacgaatagataaaatgcttgaacggtcaactgtatctttgttatgtctccacactttcccatttccttttcttccccaggtgctcaatgcccatatggtgttcccttgctctacccagggttattcttcatgtcaaacttttctctgtttgttttctcatcttcccttccctacctttatctttaataaacagaccctgagtctctagcccttagtggtccttcttagcatcgtatcttgttatctgaaccaaaattatattaaaatggtatatctcaaggtagtagtagctagcgaatgttaagatggcgaagacatgatatgtgcccagggatgtttgcatttgagcagaagactgtgctttagccaaggaaatgctgcaagtcctttgatctagtaattctgcttctaattcatttatatgggaaatccagaccataagatgttaatgtcagttgttttttaatagaaaaatattgtaaacaaatagtttatgcaacattacagaatggttaagtaaattacagtatatccatacagtagaatatgatacagctatcaaaaatttttagtttttagtgacatagtaaaacggttacaatgttaagtaaaaaacaaaaaaagtgggatacaaaactatacatacggatttatttaaatatgtaaaataaatgtaaatacaaaaagtgatggaaaacaaattatgacaaaatatagaatgtagttaactttcagttggaattgtgggtgctttttcttttttgagaagaggtcttgctctgtcaccttggctggagtgcagtggtgcgatctcggctcactgcaacctctgcctcccaggtttaagcaattctcatgcctcagcctccctgagtagctgggattacaggcgcccgctgcaacgccaggctaatttttgtattttgggtacagatgggggttttgccacgttggccaggctgttttcgaattcttgatctcaggtgatccacccaccttggccttccaaagtgctggtattacaggtgtaagccactgcatccggccgctttttctgattctttatattttttggaagtttttgatatttcccgagttttctaattgagcatgcatttattttataattggagaaaaaagtaaaaaggacactatcaagagagtaaaaatacaacccacagaatgagagaaaatatttgcaaatcatgtatctgataagagtttaacatgcagaatatataaagaacctctttttgttcataaaataacaagtattagaaagggcatggagaaattagaacttttgtacattgctggtaggactgtaaaatgctgcagccattatagaaaatcatttggcaatttctgaaaaacttaactatagaattactatgtgacccagaagttgcactcttaggtatatgcccaaaagaactggaaatgcatattcaaacacgtgtttatacatgaatttctatagcagcaaaattcataatagccagaaagtcaaaacaacccaagtgtctatcaataggtgaatggataaacaaaatgtgctattatatatacacaatgaaacactgttcaccctttaaaaagaatgaaattctgatacatgctacaatgtggatgaagcttgaaaatattatgttaagtgaaataagccagacacacacaaaaaatattgtatgattccacttatataaaacacctagaataggcaaattcagtcagagactattggagttgctagaaatgtaatgtaggcttttcttttttttttttgagactgagttttgctcttgttgcccaggctggagtgcaatagcgcaatcttggctcactgcaacctccgcctcccgggttcaagtgattctcctgcctcagcttcccgagtagctgggattacaggcatgtgccaccacggccggctagttttgtatttttagtagagatgaggtttctccatgttggtcaggctggtctcgaactcccaacctcaggtgatccgcctgcctcagcctcccaaagtgacttatcacacagcacctggctatgtttgtttattattcttttttcccctcacttctggagacctaggcataggtctttctatttgtttgttctatttgtttgttctatttgtttttctccctctgtttttaaattatgaaatcatgtcgagtcaaaaattaacttagaatgctgttctaataacattatatggaattctcatttttgttattttgtttttttttccttatccaagaaagaccctaactttattggcaagcatgtttatatttccaagtatattgtttttgtttgtttaaacatgttatgaatttttagagattattttttctttttggtgctgaggtgaaagaacataccctgtattgtttctgctttgtaaaatgtattggatctttttgtgacctggtgtaaaaacaattaaaaatatttgtatgatactggccgggcacggtagctcatgcctgtaatcccagcattttggtgggtggatcacttgagatcaggagttcgagaccagcctggccaacatggcaaaacctcatctctactaaaaatacaaaaaaattagccgggtgtggtggcagacgcctgtaatcccagacacttgggaggctgaggcaggagaatcacttgaatccaggaggcagaggttgcagtgagctgagattgcgccactgcactccagccttggtgacaaagagagactccatcacaaaaaaaaaaaaaaatatatatatatatatatacacacatatatatatacacatatatatatacacacacacaaatacatacaaattagtatgatacttataaagtatcatttaaaatcatatgtagcatatgaaaataccatttaaataaatctttaatatgttattcaaatcttctatgttcttgtttattttttattcacttgccctgtcttagatttgtaattgcatactaaattttcccaccatattatttctatccatttctattcacgtgtaattttttctactttaggtattttgattccatgccttctggtctatgcttttgaaaaataaaatgatcatttttactacctttaggaatgagtgttttgttctcgtgaattttactttgtccaatattactaatactgtagttcctgctacgtttatatttgtctcacgtagctttgttcatctgttatttttaagctttatacattgtttttattataagatgattcttgaaactgtaatacattgatttggtgttttaacagtgtgaaagtcttaccttatttttttagaaatttacctttttacttacatggctgttatttctgtactagatcttcctgctttccacgtgctcatgtatatgcatgtatttgttgatgctattgatactattaccttagtatctcttttgcagtaaggctatgttttgcttctttcttttttttctatgcaatgatttggaaagtacacgtcctattcttcaattttactagttgtttacttttaagactctaaaaaatgtttttaactgagcacttatatgctttttaaaaaccaggataccggtgaatgtacagataatgcatacatcgatattcagctacgaattgcttccttctcacagaactgtgacatttatccaggtaaggaataacacatgttggcaccgcaatagaggaatagtggtcccagacaactggctgagtcttttcctataagttgggttttggttcccgtgatatactccaaagtctgtgtaacctgcagacacagatgcaccccttgatgagaacactgtaccccttccctgcccagttgtgctgcagctcagactgttcttgtcagaatggtttatgaagacagaagggaaatgtatgacccctgggcaaagttggcctttgggtacaatgccatctggtctctcttctctgtaagttgtccttaagtcagatgttgtaagttgaagagacctgtattttatttctaagcactcagaacaaaaccctttcaattaaggtggttttttcctgcatgttataatgggaagaaatggagatagtgtgagtttgtggtcaggtcagtgtttcttataacaagggtgtgcttttttcatacttggaaaacgtttgtatgcgttccacgagtagtctgaagctgcctgttcatcagaaccatagcacttaaacttttctcatgagagtcactcctttaaattaagcattgctttttacagtttccatcaaaaatgcaaaaattcaggaaaagtgtagcgttttgttggagttactcgcaccttcctattgaaaatgtttccctaagtacactgtgctctgaggaggagaaaagaagagaggcaggaagtgaaagtcagacagacaaccttcccccactcactactgggcctgggctcccatgtagccccttatacatgtggatgctggttcttgtgcaggagggatgctaggccaggctgctacttcagtgtacatgttgacttaaaacctgatcctttcagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtgtgtaaactatactacaaaagcagtaacactatagtctatgtgcaaattgctgactaattttgccactgatcttggctctggattgggaaaccatacatttgataatgtgatttggtgcattagatttggtaaattaagtgccaatctccctgtatgcttcatcccggacaagtattttacaacattctctctgttttctatatgtaaaggactgaggtgaggatcaaataagttaatatatgtcaaatcactttttcaaactctaaaatgctatataaatacaatagcagctgggcgcggtggctcacacctgcaataccagcactttgggaggccaaggcgggtggatcacaaggtcaagagatcaagaccatcctggccaacatggtgaaaccctgtctctactaaaaatacaaaaattagccgggcgtggtggtgcacacctgtagtcccagctactccagaggctgaggcaggagaatcgcttgaacctgggaggcagaggttgcagtgagccgagattgcgccactgcactccagcctggcaacagagcgagactctgtctaaataaataaataaataaataaataaatacaatagcaaccatgatataattaataaaattcagggctagggccaggaagacttacgctatgtctttctggactcatctctcattataacatcacataatgtcttgggctcagccatatcagtcaatccatcattgccaaggctccacgctttcttgcctccatgtctttcacccactgttctctctgcctgggatcccgctctcctgcaaatgtaccctctggggattcatctctcctttcatgccctatcaatagaagactgacaggagtgtcttctgggagtcaggagactcagttccaccatagcatctgccgctcacatcccagatcactctgggtggtcattcaaacgttctaagcctttgtggccccgtctgtaaaatgagtgactgtattagaagagcctacattttgccgggcagagtgcctcatgcctataatcccagcactttgggaggctgaggcaggcagatcacctgaggtcaggagttcgagaccagcctgaccaacatagagaaacctcatctctactaaaaatacaaaactagccaggtatggtggtacatgcctgtaatcccagctactcggaaggctgaggcaggagaatcacttgaacccgggaggcggaggttgcaatgagccgagaccgtgtcattgcactccagcctgggcaacaagagcaaaactccttctcaaaaaaagagaagagcctacatgtctagcaactccaatagtctctgactgatgtcattatggacagacccctattttagagactaaaaattggcttccctaaatacaagctaaataaaaataatcaaaatagagccaaattgttacagcaagccaacataatcctcataatctggtgaaaaaattctcactaaaaagttcatacttttggctcagaattgaatttctaggaatctaaagtaggagtctttatatacaatgatattcactgcagttttaagtataacagcaaaaatagtaaactgtcaaaatgattaatatgagaatgattagatcatgtctggcatatcctcagaatagagtgttaagcagcaacttaaaagcatctttgtgcggagctcttgatatggggaatgtcttgtgttataatattcagtgaaaaaaaggaggcataaaattgaatatacatgatgttatcagttgtgttattttaaagtacagaaaataatgtgggaaaaaaaagtggctcacgcctgtaatcccagcactttgggaggccgaagtgggtggattgcttgaggtcaggagtttgagaccagcctgggcaacatggtgaaaccccatctataatattaggttggtgcaaaagtagttgtgggttttgccaaagtaatggcaaaatcacaattacttttgcagcaacctaataaaaattccaaaattagcagggtgtggtggtgcacacctgcaatcccagctactcaggaggctaaggcacaagaatggcttggacccgggaggcggaggttgcagtgagccgagattgtgccactgcacttcagcctgggcgacagagtcagactccacctggaaacaaacaaaaaaacgaatgcctcatagtcatagtggtgatttttaggtgatggaataacactactttaatctttctaattttctgtgttacttttgtaactgaaaaaaagtaaacaaactagattaaagtaaatcaaaactgatactttgatctctctgctacttgagcacttgtttctatcccagacacgaccaccctctctctctgatttcattgccatatgaccacgttaggtttacttgaaagggacgccagtctatgctattcatgcttttttcagctttaacttctcactttatatttctgctttcttgtgaaattattttattcttttttcgttgttgttttttaagagagacgggggccagacatggtagctcatgcctgtgatcccagtactttgggaggcagagacaggaggatcacttgagccccggagcgagaccagctggagcaacatagcaagaccctgtctctacaaaaaaagaattaaaggccaggcgtggtggctcatgcctgtaatcccagcactttgggaggccgaggcaggtggatcacctgaggtcaggagttcgagaccagcctgaccaacatggtgaaaaaccatctctactaaaaatacaaaaatcagctgggtgtggtggtgggtgcctataatcccagctactcgggaggctgaggcaggagaatcacttaaactcgggaggcggaggttgcagtgagcaaagatcatgccattgcactccagcctgggtgacaagagtgaaactccatctcaaaaaataattaaaaaaaaaaagaattaaaaaattagctgggtatggtggtatgtgcttgtagtcccaactactttgggaagctgaagtaggaggattgcttgagactgggaggtcgagactgcagtgagctgtgatcgtgccactgcactctagcctaggtgatagaacaagaccctttgggcaacagagcaaacaaaaagagagagagatgggggtctcactatgatgcccaggctggactcgaactcctgggagcaagcaatgtgcccatctcaacctcccaagtagctgggattacaggcgcacaccaatgcacccagctcccttattctttattctgaatgttgtaggaataggccaccatgtattgtatgtcagaggtttgccatcaaaaacagaaccactcattctcaagcatgaatatctagtcttcttagtagttacagttttctctgtggattaatgaatcaacattctagtatgcatatgtgtctacattaaggatgtcagggggacacaaagaggtaacccatcagatagctgccaagtcaatctgaatattgcaagaatttcaaacttactttagagagataaatctttactaatttttgcatttaaagagagcaatttggttgcttggacatagtcacccaaggcagccttgatggaagcagccaatttactggaaatcaattaaacatatgatgaatttgctaaaagctagtctccaaaatgaccaatttgccaaattgctaaatatttatagttttaatcttgccttgggtttgcacatttagtcctgtttggatgcatgttgattccacgttgggttcatatttcagatatgaaacacttcctgaatcttccattttcacacattagtgattacagtttcatataagttttattttgccctaccaccactgctgctgtccccaaggctgttgatgctcctgtctgcctctgctgagatgaataaacttccaagatctgtgtgtgcacatgcagaaatttttcctttgacaaagtcctaggaatgtcaaataatatgtagatatataagacttgatgcaaattgccagaatcaccaaatatttgcaatgatgccaatttacattcacatcacctgggtataagacaccagttgaggccaggcgtggtagctcatgcctgtaatcccagcactttggggggccgaggcgggcggatcacctgaggtcaggagtttgggaccagcccagccaacatggtgaaacctcatctctacaaaaaacacaaaaattagccaggtgtggtgacacttgcccgtaatctcagctacttgggggcgctgaggcaggagaatcacttgaatttaggaggcggaggttgcagtgtgtgtcactgcactccagcctgggtgacagagtgagactccgtctcaaaaaataaaagaaaaaagacaccagttgaggatcttaatttgaattctcttcctaccagcagtgactgaggctgcttgattcctatgcctggccaatgccacgtatcatcaatttttgttttcatctttgcctgcatggaaggctaacaatgatgtctcattgcttttttaatgtgcatgtttttgtttattaatgaagttaaacttttttttaggcttaatgaccgttttaacttctctgaaatacctgctcatggcttttgtccatttttagtgttgggctttacattcatacagacattgattctatatcatagttttcccagcttgcctttctactttgcttattgtgatttttcagaagcagttttcatttttctctagtcaagttttagtattttccccttccttcagatttctttcctctgcttttcacctaagaaaggccttcctcatcctgggttttggtgaatatttatttatttgtttagttgttttttgtttgtttgtttttgttttgttttgtttcccgaaacagagtctcactctgtcacccaggcttgagtgtagtggcgtgatcttggctcactgtaacctctgccacccaggttcaagcgattctcctgcctcagcctcccaagtagccgggattagagatgcttgcaaccatgtccggctaatttttagtatttttaatagagacagggattcattatatgttagccaggacggtctcgaacccctgacctcaggtgatctgcccgcctcaggcccccaaagtgctggaattacaggcaggagccactattcccggccaacacatttaaatactatgatttaatactaaataatttggttgagaaattgggccacaaaatatttaatggaagatagtgttgagtagtgattaaaactgttgctagagattaaaataatttttttttctttttgagacagagtctcactctgtcacccaggctggagtgcagtggcatgacctcagctcactgcaacctccgcctcctgggttcaggtaactcccctgcctcagcctgtcaaatagctgtcaaattacaggtgtgcatcacaaagcccatctaatttttatatttttagtagaggtggggtttcaccacgttggtcagattggtcttgaacagctggccttaagtgatccacccgcctcagcctcccaaagtgctggaattgcaggcatgaaccaccacgcccagcctaaaataatttcttaatattaaaaatagtaagagaacaataaaaaccccaaataatttttctaattacaaaatttaatccacataatttctatagtagtactaactcagtatttcaccaattcaagatttggcaggacaataaggcatatttaaaaacattttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaactcaataaatacataaataaataaaaattataggccaggcatggtggctcatgcctgtaatcccagcactttgggaggccgaggcaggtggatcacctgaggtcgggagttcgagaccagcctgaccaacatggagaaaccccatctctactaaaaatataaaattagccaggcgtggaggtgggcaactgtaatcccagctactcaggaggctgaggcaggagaattgcttgaatccaggaggcggaggttgtggtgagccgagatcgtgccactgcactccagcctgggcaacaagagcgaaactccatctcaaaaaaaaaaaataaagaaaattatagcttgcttatttcttcccccacttagaaaaggaaatgggaccaaccgatagccaaatattttaaatatgcatgccaagctttaatgccaaacgtgtacttttttgtatgtaactctctaagttggtcaattaaaatttcaagattctcccttaacatttcttaaagataaatgatttattatgcaaatatttttaagcgtttactttgtactaattaatttttcaggtggtggctggcaagaaatattttattgacttcgtggccagggaaaccacatgttccaaggaaagtaatgaagagttgaccgaaagctgtgagaccaaaaaacttggcgtgagtagtcatgcacctgtctactttttcactggaagcctatttgatgtttttagaatcatttgtttaaatgtctcgtgaataacactgtctctctttcgacttctgttttcatggatagcaaagcctagattgcaacgctgaagtttatgtggtaccctgggagaaaaaaatttaccctactgtcaactgtcaaccactgggaatggtatgattctaattacagtcagcgtggggtcagttctgctcattctgaaaatccatatttgggggctgaaaatgaaccattactgaaatgaattggggagctatcttttttaaatggggagtaactctcacacttctgtgctgatctctgtttaatggctagaaagaagagtaacaatcctcctgatcacttctcacacattgtcagtgtctcagtgaagcttctatagactctctcctagtgcactgcagtcctgctgtgggggagcaacattggctatgccaggtgtacctgaggccagatacagcactccactgcattctgctgacatgcaaggaccatgtgaaaaatgcatggctgggcgcggtggctcacgcctgttatcccagcactttgggaggctgaagcaggcagatcacctgaggtcaggagtttgagactagcctggccaacatggtgaaaccctgtctctactgaaaatacaacaattagctgggtgtggtggcgcctgtaatcccagctactcagggggctgaggcaggagaatcccttgaacccaggaggtggaggttgcagtgagccgagatcctgccactgcactccagcctgggcaacaaagagcgaaactttgtctcaaaaaaaaaaaaagaaaagaaaaattcagactcgcaaaccccacttcacagctaccgaattttaaccagatccccaggggattcatatgcatgaatcaagtttgaaaagcattcgttgatgtcatctttcttttttaagtcttaaaagaactctgggaggtagtaacactttccctattgtcaaggatgagacactaaaaattagaaagactctgaggtcctgagtgaataatgacattatcaaatgcttcctctgtcccaggcactatactgaaggtttcacccacattttcgagtcctccttataactctgtgaggcaggtgctgttattatttctattttacagaaaggaaaagtgaagctgatggcacttggattcaaatcttggtcaattcagagtctaccctttccatcacgatgctgattaccagtagggtctggccggactccaatgaccatgttctttgcatcaccagacactgcttccaattaacacattctcacaggtagcaaaagtgtaggtagaattaatccacagatcgacatatttgaagcaggttacctcttttccctcttttctgatttggtcttttgtcatgtgtaggtatgtagatggtgtaacacaaacattgtcctcaggttgcatttcaagcttgcgaatatgtcctaatgtgcttcagcacaacaaagtgatcatggatacatgctccctatatattcagttcataaagccacttagggccttttaggataaaagcagtgatggtggtaataacagtagtatcaataattaaatactgtgctcagtaaaaacataggctcagaagctaccctagagattagctagttcaaccatccagatgaagcaaaaacactccagcttattttacagttttttttgttgttgtttggctgggtttttttgtttttttttttgttgttgttgttgtttgttttttgttttttttgacagagtcactgtcgcctaggctggagtgcagtggcgccatctcagctcactgcaacctccacgtcctgggttcaagcaattctcctgcctcagcctcctgagtagctgggattacaggcatgtgccaccatgcccagctaatttttgtatttttagtagagatggggtttcagcatgttggccaggctggtctcaaactcctgacctcaagtgatctgctcgccttggtctcccaaagtgctgagattacaggtgtgagccaccatgcctggctattttatggtattattaacaacaataattaatgtccacaaattttaagatcaatcaaaagacaaaaaaaattattcatcctttctggaatgttaatatagcatttaaaatctggcaaacacctcccccattgtaaactaagatagcattgccagatctcagtgtttttttctatcatcaatagcatgatttttgcagtaatacattcatcttaatattttctgtttagatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccacacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtttactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaggtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggagattttaaattttctgtaataaaaacacttattgggttgggcatggtggctcacgcctgtaatcccagcactttgggaggccgaggtgggtggatgacctggcgtcaggagttcgagaccagcctggccacatgtcgaaactccatgtctaataaaaatacaaaattagccgggcgtggtggcacgcacctgtaatcccagctactccagaggctgaggcaggagaatcacttgagcctgagaggtggaggttgcagtgagctgagattgcaccactgcattccaggctgggtgacaaaatgaaattcagtctcaaaagaaaaaaaacatttatcgaacacctattacagccatttgctatgctagataatttacttttggcatataacttaatcctcacaaccactctaaggcccccatgaacatcattcttttacaaggaaactgtagttcacagtgccctgcccagggtcatatagttaataagtggcagggctggcattcagacttagaccttttgaactccattacaccatgtcatctgaaggctttattattaatgttgtcattacaaaagacacaccaagtcactgactacagtcacagagacccaataaattaaaaaaaaaaaaggcatgccaagataatgtctgactctgagaggatccttgtctcaatccaaaatatccttattaaatacctaattgtggctggtgctgttctgtgtattggtcaggataaactgagttaagcagcagtcactaactatttaccatatgcttcgcatgaggtcctgagaggaaaagaaagaaattttaaaagacataaatcctttccctcaaagatcttgcaatcccattggcaagtcaagatgaaagcatacggaacaaagatttgatccaggctgcagtcttttgtgcaacagtgagtgaatgcaaccaatgtgactggaagaagttgactaggtagagggatcagctgtgaaaggtagtatgaagcccagctgggagtctaggctgaaatatgcagtagagttccttctacagtctttgccatactcagagggagtttgagatagatgattctgaaggttctgggtagggtggatcagaatgggaagagaatggagtcagggttctgttctgggtatttcctgacaatcatgttttagcagaaaaataacgactcagggctgatatataaagcctatacctctcagcttactcaacaacatgaagtatttccacttcaggcctttgttaggtaacataaacatgagtttcccgtgacccagaaactaactttcttattttttaaatatctataccagccgggcgcagtggcttcacgtctgtaatcccagcactttgggaggccaaggcaggcggatcacttgaggtcaggagtgcgagaccagcctggccaacatggcgaaaccccgtctctactaaaaaataattaaaaaaaaaattagcttggtgtggcggtgggagcctgtaatcccagctactggggaggctgagacacgagaatcgcttgaacccgggaggtggagattgcagggagccgagatcatgccactgcactccagcctgggcaacagagtaagactctgcctcaaataaaaaaaaaaaaaaaaaaaaaaagacctaactaccaagccaaagtcacaccccaagtgtctggccctggctctggggccacacagctacatcgctccgtgcttctcttcagggcaggcatttcctgtcgtcgagtccaacccacattcctcacattgtctacgcctagttcctcaaacaggaggcccctattggctttttactccactctccacttcctgcttctaagcctggttccaagggagttaactcacagaaagacacatgcttttcggcctcaccccagtctgtccggcgcccatgctccccttctgctcatactctgtacattcacctcgcgggaaagcccagactcccaaggctcctctgagaagatttga

SEQ ID NO: 767 - DNA, 28316 bp, Human; identical to SEQ ID NO: 766
  misc_feature (1)...(28316): n = A,T,C or G

SEQ ID NO: 768 - DNA, 13715 bp, Human
gcccaccttgctgttctatgctaaataaacaaaatattttttctcaattatgttgctctccttaattacacgcaattttaaaactagctgtaactgacagccctttcctcacacttactgccaatgtatttaggtcaatcccacctccaattagagaaacttagaaaaaggaaatcctacggtgaaatgccatatgccttacaattttcagtaactaatcctcaaggatgacaacttggcaaaaaagagaactggaccagctccctgaaaggtccatcacttcggcccatgttaattgattgccttaaaatcacagtgcttccaggttgtagagacacactcaaaatggactattgccctcacattaaaggggataggttttcttttcccttttcccatccctgcttctctcaaagctgcacagaggtatatgaggtttggggaatatttgcagcacatgttggctggcaagaatgtgggtgaattcctgttaaggggcgcagacactccctcttctatgacctttcctttccacccagaacaactgaagtatcatgataagaggaagggctttgtgtttgagataagcagctcctatacctgtcagctttctctaataagaaagctctttcctgccaccgtataggtcaccttcttattggtaaagcatgatgaagtttggaaactgttgtccttgttttgttgaaagaagccaagttccaagaaatctgcagaggcattcctacaatccctcagccatggcagcatgaatcctgaaggggcagtgagtgctggtttctactctgtctgcacagctaagcctaggggagataatcttttcatacaagatgcattctgcttttgtgggcctcttgcagccctcaagcccccatctgatttgtacacaatgatccagtgggccagaggagcccagagccatgagcggcccatccctccaagaactatttctgactgtccagtatcatggagcaagtggaaagaagaaaaaaaaaacccaattacttttcgaagagcaagatgaatgctgtagaaggagaaggaaggggagggagatggatgggtgccgattccagaatcttcagatctgcttggatgaatcattacctatgatttgcgggacaagaatctgattttattcatcaaccagtagaaacttttctttctgcctcccaacatctgaaatccaacaaacatgtgccttaggaacataccggtcatcttttagaggcattttatatacatattgagtaactagaaaacactctttccgtaatacacacacacacacacacacacacacaccatcttgtcatacaacactcccacgcaagaaaagcgaaactgctgtttgatgaatgtaaacacttggctgtttgcagcagtcgggagtcctgccaggtttaagtgctaagatgggaggtgaaccccaggggtttccccctgcccgtgctgagatccttatttggtcaagcttctacctatgccctggcctcggagcgagcccgatagcgctggatcacagcagagggagcgaggcggctgacgtcccatcccgaagagatgaatggaattccaggaagctagagtcatgctggcttgggacagtggcttggagaccagacttcaatgacagaagcactaggcagcggcactcatggcaatgtgtgcacccacagaaatgtaacccacacctcgggttcaggagccgaaaaatgaaaagaacgtttagggaggaaaaagggaaatacaataataggcagagagtaatttattactctatgggtctgctctgtaaatagctgaagactctggagccagatggttctgcaaattctccaaacaggagtcacgttaagaagcacgagtgggcacaaaaactgtttttcaagacacaatttcaatttggcttgtggaaactggatacgagtaagtttccttaaaattcgagtagaaagcagctgtcctccccgggccccttgatgagaatacgcacaccgcccccaagcggccggccgagggagcgccgcggcagcgggagaggcgcctctgtgggccccctggcagccgcggcaggaaagggcccgaaggcagcgaaggcgaacgcggcgcaccaacctgccggccccgccgacgccgcgctcacctccctccggggcgggcgtggggccagctcaggacaggcgctcgggggacgcgtgtcctcaccccacggggacggtggaggagagtcagcgagggcccgaggggcaggtactttaacgaatggctctcttggtgtcccctgcgccccgtcggcccatttttctttttacaaaacgggcccagtctctagtatccacctctcgccatcaaccaggcattccgggagatcagctcgcccgaaagcccctgcgccaccccgcgggccctcctaggtggtctccccagccccgtcccttttcgggatgcttgctgatcaccccgagcccgcgtggcgcaagagtacgagcgccgagcccgtgcgcgccaaggctgcgtgggcgggcaccgacttttctgagaagttctagtgctcccaagccccgacccccgcccccttcactttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggtaagtcgcccccggcggccgccgaggaccaaagctgcccgggacatccacctggagcgctgaggcttcagtccctctggtggaccccggaacctacactctccccgctcgcctaccccagcccgctcctctcagccgctggaggactcttcagggcaaggctccagagccatcctctccagccttgaggttcacaaaccaactcatcaggacaccccaagatttccttactctctgaagtcctccttaagcctttgtatcagcactccagggaagagtctgtacttccccgtgccctccctgcaaccccaaactacagttcctgatcttgctcaccttcgacttcccaaaagcccccaaattgttggtcttgcgccccccacactttaaaaccagcatctctttcctccacctctctctctctctctctctctctctctcatgctctctggaaagtaatcctgttgtccttcatttcagcaaacgcggggtcaaagagggatggtcccggccctgtccccatgcccagccccgtttctgcgcaccgtccctccctgcctagctgatctctgaccctcggctcttgtgcttcctgctacaggatccctgctgggcaccaacagctccaccatggggctggcctggggactaggcgtcctgttcctgatgcatgtgtgtggcaccaaccgcattccaggtgagtttgtgtggcacctttaggggaaggagggacaaggaagaggtgctggctatcccaggtgtgccccctcacgtgctgtcctctccctcttgagcctgactggacatcaggacgcagcttcactctgatcctggtatttattcacctctttcagtggttgccaggagttttcaccccaaccctttgtctccacccctaaggactcagccccctactgctggtcccagcctagaaagctcactttgtgttctctcctgtctaacagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccaggtgaggcttcttctctgagccctgctccgtgggatcatctgctagacaggtgacctgccaggagggctacaggaaatcctgtctgtaaactaacgcagcagttctcagattttaggcagcatgagcatcacctggagggcttgtgaaagctcaccctgctgcaccccagccccagagtctgggattctgtaaaactgcaactctaacaagtaccaggtgatgctgatgccggtggtctgggaagcacactttgaaaactactcaaggaaacaagaaatggttttcctttagcagtcagcctgttcaagccttagatactccttaggctcttaagaaaagagcttatttcaaatgcattcccccaattttaatcttgtttgaaatggatactttctatgggcagaatcagtaccactttgctattggatttctcatggggatgcagctggtctcacataaaaggttaaaatagcagttagttgttgctgttacagcttcatctgtgccttaacttctagatctttgcaacggtggctttgaactcccacatttaactctttgacactggaaagtgtcattatatcctctaggcttaggatcagattccatttcctgtgtacccaagtaggctgataactgaattctttgtaaaatactcaagacttggcagaagtcacaattaagattttgaagttgtttggcgattaatgttgctgtgttattttgacatagtgatcttaagacagctctttgaagcttttagaacatctattgtatgcttttcctagcatacagacagtctcccccaaccccatccccaccccgctctgcattctacaagtaatgtgtgtcctctgcccacagggggtgctgcagaatgtgaggtttgtctttggaaccacaccagaagacatcctcaggaacaaaggctgctccagctgtgagtacccctctatttttagggcacatagggaatcagggggaattccaccaaaaacaaactgaggaatttagcaatagtggttatacataaattacccccagtgagatcatcaagaggcatacagaagtgactccaaggggtattatacacacacacgtatacacacgtgcgcatacacgcaacccctctacctgcatccttcacaccaaatgaaacgtcttctaccactaagaactcaagaggctggttggtaagagtatctatttgaagttttcattttgtttcttgccagctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtggtcagtggcctctgcacccagcccgttagcatgaaccctggaaggtttatcgcagatggtcccaaatgactgaaaatgcggggggacactaatgatattctctcccatttagactgaagagaacaaagagttggccaatgagctgaggcggcctcccctatgctatcacaacggagttcagtacagaaataacgaggaatggactgttgatagctgcactgagtgtcactgtcaggtaagggaccttcaccagccagaataagaatcgacggcttttgtttgaacctacatctttggggaaataccctaatcgccacagagattctttttatgttccatggcctgataacaaagtgttttttttttctttaagatgcaattatggcatctataagttcttctttaaactctcagatggtttatcaaagtattaattataccccaggctaagtatctaagagaatgaatctactaagacatctgaataatttacctaccttagttcaaagactaagtgttgaatgtcaggtaaataaaacctggttggaacattcatttttttttcccaaccctgatttatattcagctttggcataggttcttttagtacagtagcaattgtttttcaaatcacttagtctgacactgttaggatgttactgtctgctttgctcagatggcactgccaggtgtgtgattcactctagcatccccgcatgccagtggccagtgagtttggaggttcacctggcttatctattaatagcaaagtatttgaatttgcttaaatacaaatcacagatgactggctgtgggaaccaacttcattaaattccctttcttttccaatataaagacagatcacagatctatagatgaggaaaaagtgcttatagatcttccttcctccccccaaacacataatataaaaatgtaaaagtcctggctgaattttctgagtttgatttcagacatagatttgacccatgatgtttgttggttcctctgctataaattctttgtactgtaacttccacccttgactaagtagcaattaaaaagaactttccaaggaatggagtgacacgtaaactagcactagaactgtctctacgatagtggtggctgcaaatatgacagagacagatctatgaaaatcattccactagagcattgacagccctgaccatgttttggcttgtaaaggaaatgttacaggatgtagacttctgtatgcaacatgctcagcagcctgttcccctctcactctcttgccctgcagaactcagttaccatctgcaaaaaggtgtcctgccccatcatgccctgctccaatgccacagttcctgatggagaatgctgtcctcgctgttggcgtaagtttctcaaatggcatagctattcttcagtgactaggtcagttctacatacatcctagacagccgagcacaacactggaaccccacccccatctccatcatgcttccattcagtttcttgctgcagcagctggttaactgacagcttatctgctgtacagagccaaaactccattatgagtacatcgtaattacccatctggattgcagtaatggcagtgaagatcttggtatagctcattaattctgattttttgctttgaggaaaagagatgaagacgtggcagcaacagctctaagttgactgcttttagaatttgaccttagtggcacagagttaagaaaaatctgctcaccagagatattgacaggcttactgtgtaagcattggcctgatcgggcctggaagttttgcccctttcatctgtagggataagagggcctaagagaatagcagcaatctgagctctagagcaccaaaagaaataaggcacgatatcgttccatggcacgttatccctggcttttgttaccagtaaaatgaatgactttgctgagacaatacttagtgtagcaggtacaagttataaaagtgattcattacaactaagataaggaagaaaacaggaaaacagcacttgcccttcacacacacagaaacacacatgcacacacacacaaacacacccttgtcacagctcagaataaccaattccatccagggatcatattagcgatattggcactgtaatggtcgtttttacatttattttctgttccgcattcacttaacatgtgcgttaaaaggaacaaagctagctggaggtagcaaagttttgaacttgaatcagggattgctaagaaaacttacaactaatgaccacagaaagtaagttctttgtcttctgtctgatacagctagatgtgattgtagccgtggtgcctgggcagatggtaaacaaacatgctgtcctcttatgacaatatgtgcagagaaggccccaaacgctggggtgagaggaacaacaaactgactaactcacggccgagttggagccagaaccaacaacagctcggctgccttcacactcatctgtcaaacacatggtgtatggctcccctgacagaaatgactcctataagcttcctcatactcgcgcattcttggaagtctgagactggaaatgcctacccagatatgttaagtcagtaaaggaaaactcatttgcaatgctgagaggagaaagaaaatcaatgaataggagagcatacactgtgggaaggctcagctgtactgagccaggcaaagcatccgattaccccactgctgtacacatcatgacctgggataaacccctgggccgttggcctaagaaatatgttgcttttcatcctgtataactgcaactttgtgccggctcatattatgttctagagagctcatgtacaccatggtgaccatagttaataatactggattgtatgcttaaaatttgctaagagagtagatcttaagtcatcaccaaaaaaagtaactgtaagatgatggagatgtgttaattagcttgacggtggtaatcacaatatatgtgtatatcaaaacatcacattatacaccttaaatgtatataatatttgtcaattatacctcagtaaagccaaaaagaaataaatatattgcttttcaccctctggcaagtggagggccctgaacagagccctctaaagaacagcttgtcctaatcatcacgtacctgatgaacctctgtttcccctgcagccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatgtaagcatcttagcctctcagggacgtggagaactgacctgtccttgttgtcgtcaccaagggcagctccacagcatgtatattaagaacacgggttctaggatctctggatcccaatcccactgcttagctgtgcacccttgaacacaacttaccctctctgaggctctttcctcatttgcaacttggagataataatagttcttgataagtttatcttgagcattttatttagatactgcatgtaaagcagttagcactgagttttggtttatggtaagcaccctgtaaatgttaggatattaacagcaacccataaaaacagcgaacttatccgttctctggtagaaaacattccatgttgacatttgggcatgtggccaggagccaatttctaccgtacactgggtttagttgccattgaccatttcctggaaatacttctgcgtgctcctgatgggagcctctatttggctgtctctaagccaaaaccatttgtgaccatcaactctgtactttagttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccagtaagtgtgaggtccgctgcaagggtgagcatgggcagcagctctgcccagctggttgcctggcatctgcagcctgcagttcagtgggtcatagagcaggaaggttacctactagagaaacaaacagaagcaaagtcctgcaggctcagcaacttcttttaatgaaaaacaaactcaccctcttccccagcattctttccatgtgtcagagaagcagaggtttcttgaacgggcttaggagagtctatgacaagggagggatttgaaagttgatcttaattgttgcctgtggttcatcttcttacagtcaatggaggctggggtccttggtcaccatgggacatctgttctgtcacctgtggaggaggggtacagaaacgtagtcgtctctgcaacaaccccgcaccccagtttggaggcaaggactgcgttggtgatgtaacagaaaaccagatctgcaacaagcaggactgtccaattggtgagccacgcagcccaggatgaaacgacccaggagctttgctcttttactgaatgctgcagtcagcattcgaggagattccagcttggttagtcctgagcgatttgattgctctaagatgcaggtggacaacataatcccaacaagttatcggttccctataccctataatatcttacactgtgttaagtgcccagcatggcagtatggcagcttagaccaaccatttactgtgactgtctctctctccttgtctcagatggatgcctgtccaatccctgctttgccggcgtgaagtgtactagctaccctgatggcagctggaaatgtggtgcttgtccccctggttacagtggaaatggcatccagtgcacagatgttgatgaggtgaggaactgatggggctccgagtttctggatctaggaaagcagctaacctgtgcagtcgcttccttatggcagtgacttctaaacatgatgcacgctcttatttcctccatagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtacagtcaactagacgagtaaaccagaggacaggagagctgtccttgaccaaaataactgggagcgggaggaatgtaatttcatacccttcaccaaaaaaaaaagggcgaggagatgaatgtacggtctagttttagaaacgtgattagaaaatccatggtaaatcctgcaggggaaaaacagtcttccatatttaaaaatgctgctctggaataagttgtgagcagatggacttgtaaacgcctaggtgctgagcaaattcaagaaaaataaacataaagcaaagtttgcttatagcctcagggagaatggggagggacagaggtaacccacactcttccaaatggagcctctgtctactcagagatgacagggatctggattcttgtttccatgatatctgaggattctcaaaagctctgtgtaacagcagcatggtgtaccctcaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggtagagccaggtcctttgtgtgcctccagaaagagggcccatcaccttatcaaaacacaggctaaggaattttaaatacttaaagtttggacatgaaactgaaagattaaatctcccaaagggagaggggcactaattcctattaaaattaaatcacttggtgccaaaaacatgaacagggctagctctttttgggcaactgtgttccatagtcaactcttctgtccaaaaaaaagttcagtactctatccaaataccagcaaagcatgacttgtgttcacaacatctataaagcctagagcatttacacaaattctgtatgtatatcccccaagaaaagttttattttcttgtcttcccataaaaaaaatatgctgttactgagccaaattctgttctttttctatttggaattccaggtacactccctcgtgcatgagctcagcatgaggaaggcaactgaagcagtgatatatatcttctctttcctaggataattgccccaaccttcccaactcagggcaggaagactatgacaaggatggaattggtgatgcctgtgatgatgacgatgacaatgataaaattccagatgacagggtaaaaacagttttctatccctttttcatcttttcagttcagcaacagcctgaaacactttgggattcaaggaaattacatggctatagcaaaaaatataccaaatcaatacacaggataattagaaattattcattgtgttccagtagtttaaggatgtagatgttgccaagagaatttttaaatgagggttttgtttttcatcagaactgtttttctctgtacttgagaaattataatgcataaacaaatgccactttgttccctagattcatttcaaatgtcacatcgaaattacagtaaaattgactttgggcacactatgaactgagatgatgggattatattctacatctcactaacttctaacccacagggatccatttttttaactatgtccttttaacttttgtagtgatcgttttacactgagtgatcaattagcctatccactaggtagaaagtattgctgattttcacagttttagacatattatgcacatggtttgaggcttgagctgttttcaaggacaacattgttaagtgctccatttcttctctttgcaggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtaaggtgctgcctgatcagagggcccgcgggagacagggacatgcacagctttccaaacgtacttctgtctagtcctggctattagtatgcactttggtggaaacatccaaggctggagagcccagctcttatttgtcccttgttctcttcaggtatcctcaatgaacgggacaactgccagtacgtctacaatgtggaccagagagacactgatatggatggggttggagatcagtgtgacaattgccccttggaacacaatccggatcaggtaggtggatggactcctttcagagtctttcagtaaactgttggaatatccctttcatggcctttgaaaaatgagcttaacaaagttcaaacactttcattactgtggctccctggcttctcatagccaactggaatacgttcatgtaaataatttgcctgatgtgagctccttgcacagagtctcacagatctttagcatgaagatctggtaacttcagtcttaccttctgtaagaagggctactggacttgctcagcatcgtctaccattgttaagacaaattatacaaagcagacatctgtgactgacaactgtacaataatattaatcatatgtaatactaagagatggaaaaataaatgtgcataagcaaaataaccattttcatggctaatgatgtaatcta

SEQ ID NO: 769 - DNA, 19910 bp, Human; identical to SEQ ID NO: 638

SEQ ID NO: 770 - DNA, 40632 bp, Human
cccaaacctccatcagttttgactcttctctcgcacactactcagtcaacccattggcaaatccatcccactattaaaaacttagcaggcttctgtacctaatttgcttctagctttgtttttgggtccccagggaacaaacagtctccttcctctcccacaggatttcctttaggtagtcctagagactgtgactgtgtacttccatcacgtctcctttgctcactcttcaaggccccagctgctcactgttttggtcaccttgtctctactcgcttcactgtgtgtctttctctcctaacgcgtgagtctgtacttgaacatagcattggaggggtggtttcatgtaggtaggtagaatggagtaagtcccactgcttttgtaaaaactttcctgcctacttaaacctaagttttattatggaaaatgtcaagcatacaaaagtaaagagaacagaatagtgaactctctcaattatccctttccaggttcaacagttaccaactcatggccaattttggcatctacattgcctctggcccaactctgtgattattattaatttcttaatagactttattttttagcacagttttagtttcacaccaaaattgagtggaaggtacagagagttcccatatgtcccctgtccatgtgcccacagcttcctatcaacatccctcaccagagtggtacaatctttacaattgatgaacctacattgacacatcattgttatccaaagtccatagtctacattaggggttcacccttggtagtgtacattctatggatttggacaaacttataatgacatgtatctaccattatatcatacagaatagtttcactgccctaaaaatcctctgagctccacctatttatccttttctcccccaatcctcttaccccccatgtaactttttactgtctccttagatttgccttttccagaatgtcatagtgggaaacatacaagatgtccccttttcaggttggcttcttttacttagtaacatgtatgtaagtttcctccatgtctcttcatgactcatttctttttattgctgcataatattctactgtatggatgtcctacagtttatgtaaccattcatctcctgaaggacatctgggttgcttccaagttttgggaattatggtactattcttttaatatcgtccaatatagagttagatccagttttccatttttgggggtcatggtgagacatgaaacccaggtttaaaacatacataaacactcatgcacacaaatacacactccaaccattttcaagcagagatttatagagtttttaacggacataacctttttggagcctcgtatcagcccagcgccttaaatacggctgtttcttttgcagaatgagttcagattaggcgaggatatccatcaccatttttcagaccagctcgcagcctgggggcagtggttcaagcacaggctttggagccgaaatgactgcgcctgaagtactcttcttccacttccccgctgtgtgaccctgggcacgttacctagctcctctgagcctcactcttctcccccataacatagggcctataccaaagttcaagggctattgtcagtattcaggctactaactgaaggaatcaaaatctgaacctgggttcccccgactccaaaacccgtgctatattcaccacaaatgcgatcaacacacaaggcaccgggtcggacccaggcacatacgtggcgagaccgcagggagcagcgctcgctctgcgtcctcccttcctcccatatcccaggtctcacctgctccgggccccgaaggtctcaggatgctgtggctgcacgcggacgccagccgccctaaggtgaccgtcagggaagatgctgccatggccgccgccatcttcccgcagcctcggccggaaacggaaacgacgcgaaccgcgtgcgtaacgcacgggcccggcggggaacaccggtccgctgtaacaccggcccggcgcagaagcgggacgtcggcttctaggggcccaggccggcggcggcgatggcctcggcagctgtggagagcttcgtgaccaagcaactggacctgctggagctcgagagagacgcggaggtggaggagcgcaggtacgggaggccgccggcgccgctccctcgcggtcggtcccgccgtgtcccgggcagagtctccgaggggctcggcctcatagtctggggcgggaatttcgtctccgacccttcgagtcaggggcagggatcgtccgtcccctgcttggccacctcccgagttgtcagtctcatcacttcctgggcagcgcgttccgtttggggacccttaagaagcactttgatttcccgacccgagaccccccactaagcttacactcctgggccctggccccgaccccagttccacccgcagcgagttagcagccctttcccttattcattcagtaaacatggtttgcgcccattctcagtcaggccccggcagcatgagtcaggtgcactggctgcccccgatccggccagcggcgggctgggcataagcagagagtcccttcccctccagtgcgtccagggccggctgcgtgcgtgtcgcggggaaagagcctggaggaggaaggcccttccctggggagggtcatggtggcttcaaggagggagtggtgcctgaaggaaaattggagttaagctggtgggtgcggggtagggtggggagccgtcctgagaggtgtggggagccatgtgagagccgggcttgtttccgaatgggactatttacttgtccaaaacaatcagagctaacacttacgtactttccatgcgttaattcttttacacctcatcccatgccaaccctacagtgtaagtttcttttttttctttttcttttcttttttttttttagacagagtctctctctgtcgcccaggctggagtgcagtggcacgatctcggcttactgcagcttccatctcccgggttcaagcgattctcctgcctcagcctcctgagtggctgggactacaggcgcgccaccacgtcctgctaattttttgtatttttagtagagacagggtttcaccatgttggccaggatggtctcgatctcctgacctcgtggtctgcccgccttggcctcccaaagtgttgggattacaggcgtgagccaccgtgcccggccgcagtgtaggtttctgttactgtcattttccgtctaaggagatggagacagagaggggttaagtaacttgccccggggtgacacagtgtagcccgatttgctgtcaggcagtctgcttccagagtttgcagtcagccatatgtgggtaggatttgtctgagatgcttttgatcatggcaatggagagcttttgcagttatgttgagtttcttagaatcccagctgtttcatttatggctgtgtgactttgcaggttctgtctctgagccttacttacttcatctgtaaaactgggatgattcccacctcacaggcttgctctgagaatgaaacgatcccctgtcagtcaggtgctcagcgtggtgccaaggacagagtcagcccccatggcagtggctctttctgaggatgctgagcagactggcagggcgagcctgggaagggcctggctaaggagctagtcttctgttctgtgtatgaaggatgggccatcagcggggttaagcaggtgagggaggcgaatagctttgcattttaggaggatttcttgggtctcctgcttttgattggacgtggagaggccagaggtaaggtagttgagaggctctgtttagtccaggtgagcagtgatgtggatttgaaccggggctgtggcagccaggatgagaggcagagaagtccaggtagaaatgggaggggcctgataggacttagtgacagatgggaggagagaggggaatgctgattgaaagatctgtctcaggtaactgagagaagggttgtggcattaactgccctagggggatgtaggaggagcgggattgggagtggagccaattcggagttccattgggacatatttagtgcctgtgagtagatctttatctatgtttctttctcttttacttttcctgggtgggtggaagtagaaactagtaaaaatcctgaagcatcaataccgggtgtcttccaggtcctggcaggagaacatctctctgaaagagctccagagccgaggcgtgtgtttgctgaagctgcaggtatccagccagcgcactgggctgtacggacggctgctggtcacctttgagcccaggcgatacgggtccgcggcagctcttcccagtaacagctttacttctggtgtgtgcgtattgacctagacagacattgaaatttactggcattcagaccgtgacttgtaccctcgtaaagactggattaaaatgaccagttggagaataaagcgttgcaatgaagaactcttaatcagaagtccaacaattgatgtgggttttagttgtctagatcagcgttgtccaaaatggtagccattagccatgcgtggtcatcaaatgtttgaagtgtggcttgtaattgccgcagatacagaatacacaccaaatttggaagattatgttaaaaaaacaattgggaatatcttgagtaatttttctgaatactgattacatgttgaaataatatttttcatatattgggttaaataaaaaatatcttattaaaataatttacccatttcttttctttttttttttttttttttgagacagagtttcgctcttattgcccagtctggagtgcagtggcatgatctcggctcactgcaacctccgcctccggggttcaagtgattctcctgcctcagcctcccgagtagctgggattagaggcatgcgccaccgtgcctggctaattttgtatttttagtagagacggggtttctccatgttgttcaggctggtctcgaactcccaacttcaggtgatccgcctgctttggcctcccaaagtgctgggattacaggtgtgagccagtgcacccagcctcttttaaatttcttaatatggctactagaaaacttaaaactacacgtgactgggtgcctgtaatcctagcactttgggaggccgaggtgggtggatcacttgatctcaggagttcgagaccagcctgggcaacgtggcaaaaccccatctctgcaaaaaaatagaaaaattagccagatgtggtggtgtgtgcctgtagttcctgctacttgatgggctgaggcaggaggatcgcttgaacctgggaggttgaggctgcagtgagctgaaatcacgccactgcactctagcttgggggcaaagtgagaccctctctcaaaacagacaaaaacaaaagaaaaactacatgtgactctctttatgtttctatgtaatgggcagccttggtccagctggtaaacatgcaggatgtgtacttctgtattcccaaccctttcttgtgccaagcatgctttggctaaacttgtgccagcctggttggaaaggagggacagttagaagaagcttcttaaccacacgcctgggatgcttgtgttagacaaccacagccttggaagcctggaggaagcagcgttgccagggctgtactttttactatggaagtgtctctgccttgttttggtggtgacggagttttaaatttcatattttgatttcgtagactttagcccaacaattactggaatactggctggatttggagaagatgagatgagggtattgagagaggagagggccaggaggggaacctgtaggttggagtcagacctgagcagagtttgagattttttttttctgagatggagtctcactctgtcgctcaggccggagtgcagtggtgcaatcttggctcactgcagcctcagcctcccgagtagctgggaccacaggtgcccgccaccacgcctggctaattttttgtatttttagtagagacgggctttcactgtgttagccaggatggtctcaatctcctgacctcgtgatctgcccacctctgcctcccaaagtactgggattacaggcgtgagccaccgtgcccggcctaacttactttcttttttttttttttaactgttactgattgcatttactaaagaaagtaacaaagataaaatatttgaagtatagtggattttattacagaaaatgatattgaagctttccccagtgtcttgtgtcactgagtctttgtttttgcaggtgatatcgtgggcctgtacgatgctgctaatgagggcagtcagctggccactgggatcttgacccgggtcacccagaagtcggtcacggtggcctttgatgagtcccacgatttccagttgagcttggaccgagagaattcctacagactgttaaaacttgccaatgatgtcacttacaggcgactgaaaaagtaagtggatgggactggaaatcctaagtaccatcttccttcaacacagctaatccattcttacatgcctgtcgcacaaaagagagcaacaagtcatggtgtgggtgtggccctcatgggagttggtggcagcattggggcagaggctcgggcactgaattgcaggtgttctaattttagttttctcccttggcagagccctgattgctctaaagaagtatcattctggcccagcctcctcactcatagaagtgctctttggcagatctgctcccagtcctgccagtgaaatacgtaagaacttctgagttttcttttttggttgaaatcactactgaaagtatagagaacagtgtgaccttgggccgttttaataagagtttgagaaagtatgactagaagaagtctccctgaacatctttgtaggagtgtctcggagggccttgcatgaactggaccgtcctccttgtactcagtcctaatgaactggctcgttccattgaggttttttttttttttttgagacagaatcttgctctgttgcccaggctggagtgcagtggcgcgatctcagctcattgcaaactccgcctcccgggttcaagtgattcttttgcctcaacctcccaagtagctgggactacaggcatgcaccaccacgcctggctaatttctgtacttttagtagagatgaggtttcaccatattgaccaggctggtctcgaactcctgacctcatgatccacccgccttggcctcccaaagtgctgggattacaggcgtgagccaccgtgcgcctggccccattgagtttttagttaaaaaaatttttttttggcggggggggtggagggggggggcggatggagtctcgctctgtcacccagactggagtatagtggcatgatcttggctcactgcaacctccgcctcctgggctcaagtgattctcatgcctcagcctcctgaatagctgggattacaggcacacgccaccacgcctggctaatttttgtatttttagtggagacagggttttgccatcttggccaggctgttctcaaactcctgatctcaagtgatctactcacctcagcctcccaaagtgttgggattacaggcatgagctaccgtgcctagcctccattgagttttaaaataatgttctttttagtgtatataaatcttttattttgaaatgtaatgatatttcttttagcttagtactttgtgaaaatagaggaaagctgatcatactttatgcttgatagcaattttaggttggaaaaatcttttttttttttttttgagacggagacttgctctgtcaccaagagtggggtgcagtggtgcgacctcggctcactgcaacctccgcctcctgggttcaagtgactctcctgcctcagcctcccaagtagttgggattacaggtgcccgccaccatgcccggctaatttttgtattttttagtagagacaacatggtttcaccatgttggtcgggccggtcttgaactcctgacctcaggtgatctacctgcctcggcctcccaaagtgctgggattacaggcgtgagccaccgtgcccggtctgtgcactttttatgtcctttgctgttcttggagaacgtcatttttgggaggagtttgttgtctcatccagtcactgcccatgatttaacagtcctgtgagtattggacttggcccatttgtaaagcggtggctttggccaagcctcatgcaagggttaccccacagctattttctatcatactgtgctaggcaagccagtgttgtgttagcttcaaacacacaggacgactttgtagcactctttcagcatgcagtccctcaagatgtgttgtttttaaatactcattttctttctgcattttcctttggaaattctaaatgcagtcacatttcagtaatgctttatttctatgaaatatttactgaagggctcctatgcgtcacaaactgaattagaaatgtatttactgtgtcttagggactctggaatggcttggctagagcacgggaacgtggggttcaatggcctgttactagctgcacaccctgccgtcttccatgttggcttcagtctcacaagtcagggtcagcaaacaccctttgcttatgagctgctccttatccgataggcgtctctgtgtagtgggcaccatgtagcgaatgccatggctgcagggctgagcacagcaccacctgctctcaagagcacagcataagaagcaggtcttggccaggcgcggtggctcacacctttagtcccagcactttgggaggctgaggccggcagatcatgaggtcaggagatcaagaccatcctggccaacacggtgaatccccgtctctactaacaacacaaaaaattagctgggcatggtggcactcacctgtagtcccagctactctggaggctgaggcaggagaatcgcttgaacccaggaggcggatgttgcagtgagctgagatcatgccattgcactccagcctgggtgacaagcaagactccatctcaaaaaaaaaaaaaaaaagaagcagatctttagtcttggtcgtggaagattcaaaatagaaacacgatcctagaatttgttaatcattgtttttgtcatttgtctttatcattttatgggcactttaaagagggacattatgttagaaaggaatatgctctaggaaacatttccttcattcctgttactctagagcaggggtttttcctgtaaagggatggattgtgaatgttttgactctgtgggccatatcatacgtaccgtctacagctgcctgctgtagacggtatgtaaatcaatgggtgtggctgtgctccagtaaaactcaccaaaaccggcagctgactggatgtggcccacagtttgccgattcctgttcaaggagaaaccttgtgaaaataaagcagacttaattttgtgttgattgggttgcccctggggaggtccggcgtgttcctgacaggcatcactcatcccccggggcacacactctctgaggaggaacacccacagagctccccagagcacctgagcctcacgctgctgcttcttccacagacccgctgacattcttcaacacctgcctggacacctcccagaaagaagcggtttcatttgcgctgtctcagaaagaacttgccatcatccatggacctcctggcactgggaaaaccacgactgtggttgagatcattcttcaagctgtgaaacaaggcttaaaggtgggcagtgcatgccacttccctgtcagagcccgtccgctcctggtctgttgtgttcagtgggtgctcagcgacctttcagcctcagttctggtgggatgggtcaggaacattactgagcatttattgattgagccttggactgcccctgtttgatttccagcatccccgtgagtcttggggagcacgcgcaggagccgtagcctgggttgttgaggaaggctcctggagccctttgaggcgtggcagccttcgtgtcggccaggccctgggtcagggtttatttgttcaccacgcttgctgtgctcgtgctcctccgtgtgcacgcccgtgcaggggcctggagttggcctgggcccggtctgtgcccgtcaggagctcagcgtctggttgaggtgttaacagctaatcagatagtctggttaatggatacgatgcacatgtccagtgcacagatgaatgattttctgagatgtggaatataacattgtacattattattcacttacattttaaattttttttatttttattttttggagacggagcctcactctgtcacccaggctagagtctggagtgcaggggcgggatcttggctccctgcaacctccgcctcccgggtttaagtgattctcctacctcagcctcccgaacagctgggattataggcgtgcgccaccatgcctggctaatttttgtatttttagtagagatggagtttcaccacattggccagtctggtctcactcctgacttcagttgatctgcctgcctcagcctcccaaagtgctacgattacaggcatgagccactgtgcccggcccagttacatttttaatggctgaaaaaggatcttttatcatcatctgcatcagcttgagtcattgtggatcttggcacatggagagttttttttttttaatttatttatttatttttaattatactttaagttctagagctttttgaaaaaactttctggtttataaaaatgttggataatgatgagaattggaataatggccagttttgtagtttgatgtttactgggtgctgcctaccaccaggcatcgttctgagcacccatttaatcctcactgaaaccctgtgccaaggcaggtggttagtggccccagtttgtagacaaggaagccgggtgtggtggctcacacctgtattctcagtactttgggaggctgaggcgggtgggtcacctgaggtcaggagttcgagaccagcctggctaacatggtgaaaccccgtctctactaaaaatacaaaacaattagccgggtgtggtggcacacacctgcaatcccagctacttgggaggctgaggcaggagaattgcttgaacctgggaggtggaggttgcagtgaaccgagatcgcaccattgcactccagcctgggcaataagagcaaaactccatctcccaaaaaaaaaaaaaaaaaaaaaaaaccaaaaaaaccacgaggaaactgagaaacaaggtcaaatgcccagcactcagagtggcagagccagcaatggaactcgggcagagcgcagggaagcctgtcacttgcttaaaagattacgtccagcggttttccaatgtgtgagtgtctttgcacatgtttgaaaactggtaagaaaagatgacttattggaagggagcagattggtggttttaattgggtgccgactattcactaaaagtgagccaagacacacctgtgtgcacgctttggtggagatatgcctttggacatgccagtggggttggaggcgatgctgggcatagagagtgggtggctgagcctccttcctgagctgctgtttgttttgagcttaagggcctgtagagactctgcctcctctgctggttgccacctcctcttttttttttcctcagagatggggtctcactatgttgtccagggtggtcttaaactcctgacctcgcaccttggcctcccaaagtgctgggattacaggcatgagccaccgtacttggccagcgtctcacttttaatagtggagctgtggctgggtgcagcggctcatgtctgttatcctagcgctttgggaggccaaggggggaggatcacttgaacccaggagtttgaggtcagtctgggcaacatagcaagacccagtctctacaaaaaatagaagaaattagctgggcatggtgatgcatgcctgcagtctcagctacttgggaggctgagccaggaagatagcttgagcccagaaagtcacgaaacaccaggagtgtggtctaggtcttgctgctcgccacacagaaagccagttactgaggacaagtattgccaaggaagaggctttataatcagatggtgcagccgaggagatgagagctcatcctcaaacccatctccctgactaaaactaggggtttatataacagggaagaaatgtagcaatgtgtaaaaaacaggaactagggagggcaaggaggcacctgtagtggtctggtgattttcagatctttgatatttttttgagaggcctcaatgtccttttctgaggaagaaactcacataaataagtttgaagctttaacagcagatggtcaatttctctttatccaaaaacaactgtccatgggactattgagccggtttctccatgatcctgccactgcgctccagcctgggccatagagcaatttgtttcaaaaaaaaaaaagaaagaaagaaaaatatagtggagctacagtgttcgggagacaactgtgagtccatttgaaacgggaagggttcccttgtccccctcgcagggcgtgggatgggggagtggctcgcttcttcagtgtcctgctgctcagacctgcaggggagcatacagatgggcaggctgtgggctctgacctcatggcagtgtctaggggtgaatgtttacagctctgtgagttacagggtgctctcttagtttgccgtctataggtggcttatgttaaccaactcaattagatccccttccttgtcacaaggacagagggctttctgtatcctgggttcttgccttggggtaccggaagaatcggatcacacgtgggcttggaaaatgaatgcaagatttgattgagagcacgtgtgtacatgccttgtgcttctttctacctttaaggctttttgttgttttagtgtcaacttcagtggtttgattacaaagtaaatgaccagatcctaacttgcggttcccaggttctgtgctgcgccccctccaacatcgccgtggacaatctggtggagcgcctggctctgtgtaagcagcggattctgcgcctgggacaccctgcccgcctcctggagtccgttcagcagcactccctggatgcggttttagcgcggagcgacagtgcccagattgttgcagatatcaggaaggacatcgaccaggtctttgtaggtgtcatggccagtgtccatgtggggcgtgggcttctgatctgcagtctttttaaggagcaaatttatctgtctgcattcctcttgaccttctcttgcttctgtcgattcctttaataattttaaaaattgggctgcccttttttttttttttttttttttttttcagagttttgctctcattgctcaggctggagtgcagtggtgcaatctcggctcactgcaacctctgcctcctgggttcaagcgattctcctgcctcagcctccctagtagctgggactgcaggtgcgtgtcaccacgcctggctaatttttctatttttagttgagacagggtttcatcatactggtcaggctggtcttgaattcctgacctcaggtgctctgcccgcctcggcctctcaaagtgctgggattacaggcgtgagccaccatgcctggcctttgtttttgtttttttttttgagatggagtctcgctctgtcacccaggccggagtgtagtgctgctgtcttggctcactgcaggctccgcctcccggggtcaagtgattcttgtgcctcaccctcccaagtagctaggactacaggcatgtgccaccacacccaaccaatttttttatttttagtagagacgggggtttcgccatgtgggccaggctggtctcgaactcctaacctcaagtgatccacccgcctcagcctcccaaagtgctggattacaggtgtgagctactgtacccagccaggctgcccatttttgatagagaactatacttagcatttaacagagtctcaactgtcttcagagcacttggttagtaggtgtgaggaattgtaaagaaaacattttccggccggatacagtggctcacacgtgcaatcccagcactttgggaggccgaggtgggcggaacagttgaggtcaggagttcgagaccagcctggcccacatggtgaaaccccgtctctactaaaaatacaaaaattagctgagcatggtggcgggcacctgtaatcccagccacttgggaggctgaggcaggagaatctcttgaacctgggaggtggaggttgcagtgagccatggtcactccactgcactccagcctcggtgacaaagcaagactccgtctcaaaaaaaaaaccaaacattttcctgggtgtctttctgtctggtcctgttgtcttgctagtagtggcaatgggagaaaagtagcctgaacataaacattgaaaaaattggcatcctcctagagctttccgtccattccaccttctccttgtgaaagaggacaccagtcggctggagaagtagggtggtggtaggtttcttccatttgagagggccttttccccccagcccgacactccgacacttttgagctctttggttctcccgtggacgctttgttgtagtgtctgtgctcacgtcctgtcctgtgtgctcactgtcggtactggtactccttggtgtcttagtctcagaggagtgatggcagcagggagggtgctggagccagtctttgctctaatgtctgtgctcacatcttgtcctgtgtgcttacggtcagcacctgcaccctcggtgtcctaacctcggaggagtggcggcagcagagagggtgctgggagccagtctttgctatgggcccgtggcatcgaggctgcttgcgtggctgcttgcatggcagcgtggggatgggccgcctgctgggagggggaggaaggatagatgcatgtcatgcaggttcgaggtggtggaggaatatgcatgatgtttgctcatcacaaatgtgggtgatttcatttcctgttgaaattggtgcttttgaggattttctttctctgtaaattatacacagtaaaatacctcctgtcacccctgctaaaactccatcccccaaagtagaaatcacaaataaggaaaggttacatcttttttttttttttttttttttttttttaaagaatcttgctctgtcgcccaggctggagtgcagtggtgcaatctcggctcactgcaacctccgcctcctgggttcaagcaattctcctgcctcagcctcccgagtagctgggattacaggcacacaccatgcccagctaattttttgtatttttagtagagacagcgtttcactgtgttggccaggctggtctcgatttcctgagctcgtgatctgcctgcctcgggctcccaaagtgctgggattacaggcatgagccaccgcgcctgaccagttccatctttttgagatattaaagtaagttgaggttttgattatgggttgaaaaaattttttttaatctcttgaaaaatgtagaataatatgtgaagctcagtctctccattcgtaagctcctacaacccaaatcctggggcgggcaagcgctttttcttccccaagatcaaatgcctgtgtgcagggcagggctggtccaatttctggtctcctctgagttaaaaacgtggtctctttccaggacttaaaatgtctcttcctgtgacttcaaggcaagtgaggatgtaaggtgcttagttgcgtgtgtgtatctgtgtctctttcaaggaagatttctgagtgttttttacggagtttattgaactggactgaatgatagaagcacttcataaatagagttgaagaagtacaaagttggactgaagtaagtgtatctcctttgtttttctttataggtgaaaaacaaaaagacccaggataagagagagaaaagtaattttcgaaatgaaattaagctgttaagaaaagaactgaaggagagggaagaagcagctatgctcgagagcctcacttcggcaaacgtggtccttgcaacaaacacaggtgagggggcgtctccatcctgcctgtgtggcctcgaagaaggagttggggtgtgttccctcttctgttttctggaagagtttgtttagaattggtatttctttcttaaaagttgggtagggttcactagggaaggcctccgtacctgcagttttcttcatggagaggttttgaactacaaattcaacttcttcaatagataaagggctgttcaggttgtttttcttccatgagcttgtagctttcaagaagtttgtccattttatctaaacggttgaatttagaggcatgaagtggttcctaatatgcccttattcttcttttactgtctgcaggatctgtcatgatataacctgtattattcctgatactggtttgtgtgctcttttttttcctgctcttctggctggagggtttttttttttaaatttagattttatatatacatacatatatattttaagagacagggtctctgccaggcgcagtggctcacacctgtaatcccagcattttgggatgccaatgcgggtggatcacctgaggtcaggagtttgagacctgcctagccaacatggtgaaaccccatctctactaaaaatacaaaaattagccaggagttgtggtatgcacctgtaattccagctacttgggaggctgaggtaggagaattgcttgaatcctggaggtggaggttgcagtgaaccaagatcgcgccactgcactccagcctgggtgacagagcaagactccgcctcaaaaaaataaaaaccccaaaaccaaaaaaacaaagcaaaacaaaaaaagagacagggtctcactatgttgcccaggctggtctcaaactcctgggctcaagggatccccctgcctcagcctcctaaagtgctaggattacaggtggacccaccgcgcccggcctggctggaggtttcaattgatcttcccaaagaaccagcttttgctttttctctattgtttttctgtttcatgtatttccacattgatctttatcgttttctgttttcttgggcttgttctttttcttgcttcttaatgtagaagctgagatcattgatttgagacctttctttttttctgatacgagcatttagctccataaatgtctccctaagtactgcttttgtggcatcccacaaattctgatctgttatatttcattcatttcaaaatgctatctcatttgccttttggttttttagaagtgttatatagtttctagatagttgggaaatgtccagatatctttctgttgttgatctctcctctcctctcccctcccctccccgtccccgtccccgtcctgtgtgggatctcactgtgttgctcctctcctctcctctcttcttctctcctctcctcatccctgtccccatccccatccccgtcgccttccctatccccatccccatatgggatctcactatgttgcccaggctggactcaaactcctgggctcaggtgattctcccagctcagcctcctgaggagctggggctccctgcatgtgccactgcacctggcttactttctgttattggtttctaatttagttccatgtggtcagaggacatactctcatgacttggatagttcatcgagacttactttatggtccagaatctggtctctgtctttgtgagtgttccatgcacacttgatagaacgtgtgttctgattttattgagtgttctgtaagtagtcagatcatgatggttgatgatgtggttcaagtctgctgtattgagagagggacgttgaaatctctgaatataactggacatgtctgtttttcctgcagttctattggtttttgcttcatatctttggaaactcttttactggggtcataaatgtggggctatgttttcttgattaattaacaaatttatcattatgaaatgaccttctttatccctgataatattctttttttgaaatctactttgtctgacattaaaataatcatttcagcatttcagcttgcttttcttttcattatggtcaaaaacctgtaaaatttaccatcgtaaccctttttaagtctgtagtacagtagcattaattgtatgcatgttgttgtacagcagatctctagaacattttcatcttgcagacctgaagctctggatctgttgaacagcaattccctttttccctgtcccagatcctggcagtcaccattctcctgtctgtttctaagaattttattattttacatacctcaagtaagtggaaccatgcaggatttgtcgtcttgtgactggcttgttttatttagtgtaatgccctcatggttcatccatgttgtccagctttctttttatttttaagagacagggtcccaatctgtcacctaggctggagtacagtggtgcggtcaaagctgtactccagccttaaccatgaatgtgggacctccagcaatcctcccacattgacctcctgagttgctgggattaacaggcgtgagccattgcacccagcccccacctttctttcaactagtgttagtgtgatctatctttatcctttttcttagaacctatttgtgtctttatgtttaaagtgatcttttaaaaaatatttgagacacggtctcactgtgttacccctaactggagttgcagtggtgcaatcatggctccctgcagcctcaacctcctgggctgaagtgattctcccacctcagcctcctgagtagctgggacaacagacacgtgctatcacaccctgctcatttttttgatttttaatagagacaagatctcactgtgttgcccaggctggtctggagttcctggactcaagtagtccttccacctctgcctcccacagtgctaggattacaagtgtaagccactgtgcctggcctgtttatttctttttaaagagagagtcttgctctgttgctcagactggagtgcagaggcgtgatcataacttgctgtagccttgcattctttggctcaagtaatcctcccacctcagcttcccgagtagctagtactgtaggcatgagccattacacctggctaattttaaaaatgttcttttcttttttccttttagagatggggtcttgcaatgttgcccaggctggtctcaaactcctggcctcaagtgatcctcccactttggcctaaagtgaatttttttgtagatagcatatagctgggccttgctttattatccagtttgacagtttctgccgtttgttctttgttatattttcctcctcttctgctttcttttaattaattaattgaacatttcttttttttttttacataagttctcactatgccccatgattgaagatttcttaggaatttatttttatttatttatttatttttaaaagataatttatagagacaaggtcttgctgttttgcccaggctggtctcgaactcctggactcaggggatcctcccaccttggccaccttggtgctgggattataggcatgaaccatcactcctggcctatttttgtttttgttggcttgttagctatatatctgtatttgattctttcagtggttactttaggccttacagtatgtgtcttcaactcatcatagtctgttcatatgccacctcacatatagcataagggctttatgattgcaagctgacatttctctcctcttagcatttatgcttttgtcatatatttttcttatacgcatattctaagacttacaatgcttgttcttgttttaatggtgaattatctttaaagagatctaaataataagaaaaatgtcttcgtatttgcccgtgtagttaccacttttggcgctttgttttcttttggtttaggtcgtgtatttccacgtggcatcattttccttccacctgaaaggcatccatgatcatttcttgtagtgtgggtcagccggtgatgcagtccaatagcttttgtatgtctgaaaatatcttgtttcacctgcagttttgaaagatatttttgctgcgtgagaattctagattaacacttttccttgcaatattttaaagatgttgtccactgtcatctgcctgagtatttctgaagagaaattggtcatccttatccttgttcctttgtatgtaacgtgtcttttttcttctgtctgcatttaagattttttcagccaggtgtggtggctcatgcctgtaatctcagcactttgggaggcttaaggcgagtggatcacctgaggtcaggagtccgagaccagcctggcccacatgtactaaaaatacaaaaaaattagcagggtgtggtggtgggcacctgtaatcccagatgctcaggaggctgaggcaggagactcgcttgaacccggaggcggagattgcagtgagctgagattgcaccactgtactccaacctggacgacagagccagactccgtctcaaaaaaaaaaagaaagaaaatgatgctttctttatcactggttttaagcaatttgactatgatttgccctggtgctatttgcttcatgtttttttttgagacagagtctcactctgtcacccagactggagtgccgtggcgcaatcttggctcactgcaacctctgcctcctgggttcaagcgattcttctgtctcagcctctggaatagctgggagtacagatgcacaccaccacgcctggctaatttttgtatttttagtagagacggggtttcaccacattggccaggctgctctcgaactcctgacctcgtgatccgcctgccttggcctcccagagtggtgggattacaggtgtgagccaccgcacccggcctcatgttttttaacattgtggtgagaacacaacatgagatctaccctcttaaatgtttaagtgtactatataatattgttaactatagacgtcgtgttgtgcagcagatctatagaatttatcttgcacagctgaacctttatacttgcttattgctgagttcactaatttccttctttcatgcctaatctcacatctgtcccatccagtgtaactttcatctgacatccagaaataagagtctttttatatctttgatgttcttatttaatttttttaacatttggaatacaactataataactgttttgaatattctagactattatttctctatcacctgtgtcatttttggtctctttcgatgaactgttccccttgagtggttgtgttttcctacctttttgtaggcctgctaatgtttgtttggataccggacattgaggattttacgttgttgcatgctgaatattgaatatttttgtattcctataatctttttttttgtttttttgttttgtttttttgagacagcgtcttgctctgtcacccatgctggagtgcagtggtgcgatcttggctcactgcaacctctgcctcctggattcaagtgattcttttgactcagtctcccgagtagctgggactacaggcatgcgctaccatgcccggctaatttttgtatttttagtagaggcgaggtttcaccatgttggccaggctggtctcaaactcctgacctcaagtgatctgcctgcctcggcctcccagagtgctgggattggtgtgagccaccacgcccagtctcctataatattcttgtgcttggttttgggaagcagtaaagttacttgtaaacagtttaatccttttgagtcttgcttttgagatgtgttagggtctggatcagtgcttagtccagggttaatattcccctgtactgaggtaagaccctttgagctttctacccaatgcaccctgtatcatgagatttttgagtttgactggtgggattaggtgctgttcccggccttgtgtgagcactgggcacttttctctcattgttttggatggtatttttcccaggcctggagtagttttctcctaagcatgtgctaatcacaatacccaagggaatctcgcagcagatctctggggttttttctctctgtgtagcagtctctttggcattttgtcctggaaactctgcctgcattggtcgccacagattctcagccttgtctcctcaactcagggagccttctaggttctacctggctgccccttctctgtactctctcctggaaactctcaaggcagaaagctggggtaaccccagggctcacctcctttgtctctcgttattcaggggttacttttctttgttacctgttgtctagtgtcctgaagagtgtggtttcagttattttaaaaaaattttaaataactggctgggggggttgttatttgagatgggagagtaaatgcagtccctgctattccatcttgggcagaggtggaggacgcacattctctcttgtagccaggagagagcactcccgttacagagctgtgtaccttgtgactgttgtgggaatcttgtcaaccactcttttggggtttaggaatgtgtttgtgagacctctggtttgttcctgtgtgataatagtaccacaaaggtagcagctgaaaacaacccacgtttattattctacagtttatctgggcggagagcccaggcccggctgaacaaggtgctgtgctcaggatctcacaaggctgcgatcgaggtgtcagtgggggctgcagtctcatctgaaacttgcctggaaaggatctttcttcaggctcacgtggttgttggcagcattcagttccctgtgggttcttgctgggtgttggctggaggccgctcttagctgtttgcccttaggccttgccaacatggctgcttgcttcctaaaagccagcaagagacacagtctcctagcacaatgggttatcgtcttatgtaatgttatcaagggtgtcacatctcatcacctttcccctgttctgtggattagaagcaagtctcaggccccacccacatttgaggggaagggattatgcaagatgtgaataccagtggccaggatcctggggcataccttaaagcaagtttgtctaactaaaggcctgcaggccacatgtagcccaggatactttgaatgtggcccaacacaaatttataaactttcttaaaacattatgagatttttgtctctgtgttttttttttaagctcatcagctattgtcaatgttagcatattttatgtgtggcccaagacaattcttcttcttttaatatggccctgggaagccaaaagattgcacatccctgccttagagtctgtttgccacaacctctcagctggtgggctgctctaaggaacagagtccaggttctttttttttttttttttttttgagacagcatctcactctgttgcccaggctgtagtgcagtggcacaatcttgattcactgcagcctcctcctcccgggttcaagtgattcttgtgcctcagcctcctgagtagctgggattgcaggcgcatgccaccaggcccagctaattttttttgtatattttgtagagactggatttcaccatgttggccaggctggtctcgaacttctgacctcaaatgatgtgcccaccttggcctcccaaagtgctaggattacaggagtgagccaccacacctggctagattctaattggctttgtagttattgctttatccagttgtgttttaaatcagacaggagaaaaaaagggtcacaagcagaaaatacatttatggggtcttttatatctacccatgtagttgcctttatttcttcatgtagatttgagttactctctccaaaggactccctttggtatttcttgaagggcaggtttgctgtgacagattctctaagctcatctttatctgggcatgtcttagtttctccttcattttttgaaggatagtcttgctgggtatagaattcttggttgacagtctttcagccctttggacgtgtcattccattgcctgcatactttctgatgggaaagcagctattgatctcattgagggctccttatatgtgacaagttgctactctattgctgctttcaagtgtcgtcttttgtcttttgagtgtgtgattatcatgtgttaggtgtggatctctgtgagtaaattacatggagtttgtggaccttcttggatgtttagattcgtgtttttcatcaaatttggggagttttcagccattattttttcaggtattctttctgcccttattctactctcgtctccatctacaactcccattatgaatcagttgattcacttgataatgccccacagatctctgaagctctgttcattttcctccatttttttctttctgatcttcaggctggatcttctcaatggacctctcttcaagtttgctgatcattctctcctgttgaatccttctagtgaatttcagttattgtacttttcaactccagaatttctgtgtggtgcttttttttttttttttttttttttagatggagtctcgctctatcgccagactggagtgcagtggtgtgatctcggcccaccgcgacctctgcctcccaggttcaagcaattctcctgcctcagcctcccgagtagctgggtctacaggcgtctgccaccacgcccagctaatttttgtatttttagtagagactgggttttaccatgttagccaggatggtctctatctcttgacctcatgatctgcctgcctcagcctcccaaagtgctgggattacaggcatgaaccaccatgccagcctctgtgtggtactttttaaaaaattattcctgtctctttattgatattctcttatttggtgagacattattctcatattttatttctttagacttgtttcccttttgctgtttgaacatacttagaatcgctgatatttcaagtctttgtctagtaagatcagcatctgggctttctctagtatccagtttatttatttatttatttaattttttggagatggagtctcactctgttgctcaggctggagtgccgtagcgtgatctcggcctgctgcaacctccgtctcctaggttcaagcgattctcctgccttagcctcctgagtagctgggattacaggcgtccaccaccacgcctggctgatttttgtatttttagtagagatggggtcaccatgttggccaggcaggtgtcgaactcctgactcaggtgatctaccaaccttggcctcccaaagtgttgggattacaggcgtaagccactgctcctggcctcaagtatctgttgattgccttttttcccctgaatattggccatattttcatgactctctacgtgccttgtagttttttgttgaaaatggatgattttaaataatagaatgtagcaactctggaagtcaggttctcttcccaccccggggtttgttgttgttgccacttgttgtttgtttagtgacttttctggactaattctgtaaaatctgtattttttgtcttgcgtggccactaaagtctaatacaacttagtggccagctagtgattagacagaaatccccctgaactcctggagccataaatgccccagtctttgctgagtggctctgtgtgtgtgcttgggcacacctccaacacagagccaggctgtttgtgactctcagctttcacttcccgtttgtgcagtgcgttgagctgagccacagatgagagctgagggcctcccgaggtctttcctgagccctgtacatgtgtgtggccttctagattcccaggaatatgttggagcttttcaaagccccctgaggatatctcattccccagcttaaaactttggttatcctatcatttgctccgaccattattctctgtcttagaaaactgtgatgttcaacaattacctctgattgtttttgacagacaccaccagggaaaaggctgtttgtattacatgagctcagataaagtcttttgagtgtggtctaccagaggattcccagacagatgagataagcacagtttctggagtggggcttttcaggaatgccaaccctgttctgcaccccccggggctggcaggtgctggttttcaccctgacttcaggctgagggtttcaaggctgccatagggatggctgggaatagggcaggtttcagtgccaccgagctcccgtgctgacggggattcagatgcttttctggaatgaacacttccctgattgctgcagcctttggcgagtttccagagttctgagaaagttgattctgaccatttgccgatgtcttgttgctttcgtggaggagagaattctcagagcttgtgagagtctctttgctgacatccttctctggcttcaaggacagcacttgctggaaatcaggaggcatcccctgagccccacaaggtcagcttgtggcctttgtggcctttctgttccctgctggttgttggggaactagagtgagttcctggaagtgcttctccatcatgaagtctggtttctctctgtactgtgaagtcacatctgtgacctaaacatgtctcttaattatccaaagcccagccaagttctgtctcctctgtgggtgctttttctagccatctctgaagagtcaatcttgagaaatttctcagtatgtcttcatcatggcattatgtacatatcattagcataattcactcagatggaaggcagaaagggtgggaactaacattgatcacatttatggaaacctgccttctcgtgctgggcactttatatatgttatctccctttgtggtgcaatctcatgacatgcagtcattgtccatgtttgtgggtgaggaaacaggcttaggggtgggaggctcgcctgaggccccacactgttggctggagacagcgtggggcctgagtcttgctcacagcctgaacgctgcactctgctgctccgcgtcccaggaaggaaaagctgctgcagtgggtttgtgttgccaaatacatggaggcttttttctgggtgagtgcccagcagttgattgttctgtatgtccaagaaagtcaccttagaaaagaattaggttctaaatttagaaaataattgagttacaatatttagaactcagacagcatcccttgggcttggggtcacagccccgaaggggtgattaattttgccaattgaagatcagaggggcctgtggccagagtacccactgcttaagacacaggtgagctggaaccatgagttttaaaatgtcttggccaagtttttattacaagatacaaatttatcccacacagttgcaatgcaagccttgatgaaaccccagcttgatggtgtctcctctggtgtggctgcgctgttgggaagcagctgtgcccctggagactcccggctccctgtttccaccaggtgcgtctgccgatggccccctgaagttgctgcccgagagctacttcgacgtggtggtcattgacgagtgtgcccaggccctcgaggcgagctgctggatccccctgctgaaggccagaaagtgcatcctggcgggcgatcacaagcagctgccccccaccacagtctctcacaagtaagacccctttgcctcacatgcccttctctgcccccgccctcctgcggtccttccacgctcagccaggagccccaggctcaccaggagcccctgcggtgcctcctcggtttctcggcacagctcctaccccgtcttacagcattcattcatctcaacgtcgcatctgtgagatcatgtactccccgagggtggggtcgcatcaccttcatctttgtagcttcagaactggacacagggcctggcacgtttctggtgttccgtccctgcttgttgagttgaatatcccctcatgaaccaggcaggtttgatggtagagtgccgtgagagccttgggctgggctaactggcctctgggtggatgtgggttctttagtcttcaatctgtagacacatccctggatggagggcactgggcagagactcagcaaaccatggttctgccgtgcggagacaccggagccctgatgcagtggcctggcccaggctgtcctggtggagacactggagccctgatgcagtggcctggcccaggctgtcttggtggagaaagtgctgcccgcccccccagcccccctctcacctctccccatactacccagcactcactgcttcagccacacaggcctcgctggcccctctgcctggaccactcctgcctgggtgtggcgggcgtgccctctctccagatgaaccctctgcatggtatcccttgactgcccttacacgaggcctgtgaacagggcctggcacgtgggctgtccttggacaagtccctgttcagaaagttgtccctgaggaatgaaacacttctgagactcctgcatcctggccctcacttccaccgggggaagattgatttcttcagatttcggttgccttttgaaacacttctctgtttcactgtgggtgtgtagaagctatgaactcggaactttcgttgttttccgaggaccggaagaagatgtgcaagaaatcctgtcgagtagaatctcatcacaggggcgtgggcagcccaggagttggcgggtatgtagagagaggtgtcaaaaatagtaattgagagtgagctttgggaggaagatgttggaaataaagatggtggaagaaagaggagtgctgaggaaaggtgctctgaaagatcgtcctggtgggagacacatggggatctagagtggaaatgttacgggatctctggggtgttgatttttctggctggaaacctctgcggccgcagcacctttgcctcagttcttgtcctgcatccaggaagaatgaggtacgcagattagtgaagggtgaagaacagttttatttagtgttagaacagctcagagtagtgggtagctcctctctgtaggcaggtcatccgtcgagtgttcagctgtcagcagaggaggccctggagagggtggctcctctctgcaggcaagtcacttggacatctctgcaggtctctgaagctctcagcagagagcatagatcctctctgccctctccgtcctctggctgtcctctcgccttctctgactgagcccagggcttttatggacctcaagagggaaggaaggatgtgccaattggtccatgggtggccatgggcgggcctggaataggtaccatgagtcctcactctggtccacaggactggcagcccagctgccagccttcaggcccttcctggccttccactgtccccttccactcaggactctgtctgcctcccgctgccattcatggccctggggcttggctccaatcccactctgagatccgagtgggtgctgggcgctgagagaggccaggcagtggaagcagacacccatgaccctgcagggatggtgtgggggttgtccttcctggggcgcctgagggtgcaggctgcagagtgggagggcagctacagctgcacccaagagctcccgacccaccacctcagaagaggccaggctcctgcttgttcccggctcctgcctgcttcgtggagcaggaagcccaggtctgcagccacagatctggcggctgcagctgcacgcggaaaggcagatcctacctgttcccggctcccctaagagcaccgggagacgcagatccacagctgcagtttgggcggctgtagccccgcccttctggagcaggaggcctgggtctgtagctgtgaccctgtgtctgggctgcagcggccactctacctcagaaggggcggggctcccactggcttcatggagtgtgcagccacagccagggttccctgctgcagccggcatgatggcagcagccactgccatcagaacctccctgggagcagggaggacaggcgtgggaggacgcttattcagtggcttcttccagggagaggttctcgagatgtccttaaaggaggtcttcatcctctggaaagcctttgggtggaggaagtttggaactgtgcccttgagcagggaccctgttgtgtaggagggagtaggatggtttcgggggaagacgttgggtggcgttccctgcagagagtaggatggttttgggggaagacgttgggtggcgttccctggagagagtaggatggttttgggggaagacgttgggtggtgttccctggagagagtaggatggtttcggggaaaacattgggtggcattccctggagacagtaggatggtttcggggaaaacattgggtggcgttccctggagagagtaggatggtttcgggggaagacgttgggtggcattccctggagagagtagaatggtttcgggggaagacgttgggtggcgttccctgcagagagtaggatggtttttgggggaggacgttgggtgacgttgcgctgagtgttttgggtttgcagttggtactgatcatcgcgtcctgtcctcattttgttggaattaaaaatacgttaatcacagaggtctggtaagtttccagagggaaggtctctgaagtggagctgggtactgccccagggttttggtggggttggtgagccgtagtggtgcagagggtgggctctggcaccaggtggcccgggcaggtcctggctctgcagctcacccgggcagctgtgggctggcagcctcctctgtctcacccttcttacatgtaatatgggagtcataacagtagccacctcatgaggttgttataaggatgaagggagttaatccacatctggcacacccagcagtgcctggcgcctgggcagtgctcagccgctgcagccgttcttggtgggagtggacttgactgctcacagttggagcatgttggagtgtgttcgttccctgttatggctgtgacaaatgaccacaagcttagtggctgacaacaacagattttctgacctccagaaacgacaatctgggggtcagatgtccaaaatcagactcaccggcttaaaatcaaggtgtgggtggggttgcttcttctggaggatccaggggaaaacccatctcctggtcttttccggctcctagaggccattgcttgacttgttgccctttcctctgtctatgaagccagccgtgttacgtcttcaaatctctcccctcggtgaccttctctgactgaccctcgcatgcccccttataagacccttgggttatcacctgggtcatccagggtcgcctccccatcccaggatccttaacttcatctcagctgcagcgtccctgttgtcctgtaagggaacattcacgggccttggcgattggatgtaggtgcctttggggctgtgattcagccaaacccgccccttggttacttctgggtcagaatccaggggagagttgggtcctgaggtttggggcctgtcctcctcacttgctgtggttcacacctggactctggggctcaggcctgccttccccctttctccctcctgggcgcagggctgcgctggcaggactgtcactcagcctgatggaacgcctggctgaggagtacggcgcgagggtggtgcggacactgacggtgcagtaccgcatgcaccaggctatcatgcgctgggcctcagacaccatgtaccttgggcagctcacagcccactcttccgtggcaaggcacctcctgaggtgagtagctcggcaccacccgccgccccatccttctgccctggctaatcctctgcgtcacctgtttctacgcagcaagctaaagtgaagctttctgcatgaaagtcgactctgaggctagctttttggaagagagggtggccttgccctggagagctgggtcaggcccgctccctcccttctgatgtcctgatgtgctcattgtcctcccctacctaagccttttcctcgtgggaggggtcggttctgttgggtggggcctcagtgctgcactgtggccccctgatgtgctccctctctgcctgtgtgccagggacctcccaggtgtggctgccacagaagagacgggtgtgcccctgctcttggtggacaccgccggctgcgggctgtttgagctggaggaggaggacgaacagtcgaaagggaaccctggtgagcttgcttgcagatggccagcttttttgtttaaacatacctccagctctttaaaaataaaaggcactttaattgcctaattccgggaggagctgagagcagttgttgatggccgtgaaaaaacggagccccacactgcaagaggctgagcagcatcgttttctccagggtgagcagaccgctcctgggtgagatgggcctggcagcattttacggccttctcctgaatggtggcccagctctgcctggctggtctggtgatgggaactgtcattgctcagctgacaccaccatctccccagttccacgttgaacaggatgcacggccataggagtcaaaaggccttcattgctgatgtgaaattcaagttagctgggcatggctggtcctggggccctgggacacagatgattagctcccaggaagccacctgagtggaggatcagctggccatgatagacagaaacgtgcccgaaacacgtgttggtggtggatgcccacttggggcgaccttgtgctgctcacccgttctttctttccctccaggcgaagtccgcctcgtcagtttgcacatccaggctctggtggacgctggtgttccagcccgtgacattgctgtggtctcgccatacaacctccaggtacgagggtttccttttgtccctctacagagcagctggggctcacacaacctagagggtgaaagaaaaagggtgatttgttggctgtggtgaccgaaaagttcaggggtagggctgaccttattgtgactggatccagggcccaaatgatgtcgtcaggggcccctctgcgtgttcgtctgcccgccccaccttgccccgccctgcccggtgccccagccttctgcactggcttgtgttctggccagatttgctgggtgaccccggcagcctcaggctgacacagtccttccacgggcagccctggcggaacagcctgtccttttctggcatttcccacaggagtctcagccttgagccttgctggtctggctcaggtcgtgttcccatgcgtatctcatttggtaggaaaaatgtaccttctggagtatcgggaggatctgtggaagtggccatcataccttcctggtgtgcaggcatcacacatagggctgtctgaggctggcggctgtcataagccaaaagaaatgatcaaatgccagggacagggtgtggtattggcgtgcatgcgtgcccgtgaggagggcgaacgggaagcctttccccatggggctcctgcaggctccgcttcccaggtcctggctgtttcacagcgtgaggccctctgctgagctgaagggcagggtcttgctgcgctggcatgggtgggtgaggaaaccacagcccggctggtgtttcaggtggacctgctcagacagagccttgtgcacaggcaccctgagcttgaaatcaagtctgtcgatggcttccaaggccgagagaaggaggccgtgatactgtccttcgtcagatccaacaggaaaggtacggagccctcgccagagtcctttggggacagcacagaagtgaatttattgattgaggggcatattgggtgtctgctgggtgccacactggtttctggcagtgtgctcatggtgcagcttctgtccttagtaagttcacgtcaggcaaagcacaggcaagagagtctgcagaggctcagaggcgtgagtgtgctgtcagggagcaggtggctggggtggcagctgggggcgcagggtgggctgggaatgatcaggacatcctgccgaggaggtgaagccccctgcagcccagagctggcctttagcctccatgcacggagccgcggggtgtggtggtcgtggctgtggtttctgtgctgctgtggtgtgtgggctttcccatttgggatgagcattgttcccagaagcaggtttagtgaacgggctttgtgagacattctcagaaggcagaaagcaggtgaggcctggctagaagctatgggggaaagaagggaaggtcctggaaggtttcttgtgctttctccctggtgccagctgcagccacaccccaggcggcccctgaggctgggcttagaaggaaaggagcgacagaacccagtcgggttccccagagccccactcagtcagccgtggcagccagatgccagggcaggtgtggcatcacggtgccacgcgtggccgggcacccgtgtggatggtgggccacgcgcaggggactacacttttggtggtggttactgataagggcgtaggagcctgactgtgtttcttagtctgaaacctgcttctcactcccctctggccttttgtaggtgaagttggttttcttgctgaggaccggaggatcaacgtggctgtcacccgtgcccgacgccacgtggcggtcatctgtgactcccgtactgtcaacaaccatgcatttttgaagaccctggtggagtatttcacacagcatggggaagtacgcacggcctttgagtatcttgacgatattgtcccagaaaactattcccatgagaactcccagggttccagccacgctgccaccaagccccagggacctgctacgtccaccaggaccggaagccagcggcaggagggaggccaggaggctgcagcacctgccagacagggccggaagaagccggctgggaagtctctggcctctgaagctccatctcagcccagcctcaacggaggcagcccagagggagtggagagccaagatggcgtggaccacttccgggccatgatagtggagttcatggccagcaagaagatgcagttggagtttcctccttccctcaattcccacgacaggctgcgggtccaccaaatagccgaggagcacgggctgaggcacgacagttccggggaagggaagaggaggttcatcactgtgagcaagagggccccgcgaccccgagcagccctgggacccccagcagggaccggtggcccagcccctctccagccagtgccccctacccctgcgcagacagagcagcctcccagggagcagcgtggcccagaccagcctgatctgaggacgctgcacctggagagactgcagagggtcaggagcgcgcaggggcagcccgccagcaaggagcagcaggcctcagggcagcagaaacttccagaaaagaaaaagaaaaaagccaaaggtaagtcaactaataagaacttggggcagtgtcccctcactggggtgctggccccacttggagcccacctgccaccatcaacagaaggaagggcttcctcctggtggcaccgtgcccgtgtcattttagctttattttcagtcatgccactcccagctccgtctgggctcccctaggtcggtgatcaggtcacgggcaccttcttttcccagaccctgtgtgggactcggcaagtaggcagcactcagagcatgtctgcagcagcaggaggggcctggaagagcaaacatggatggctccctggagcccctcgggaatggagcgatcacggggtcccatgcaacatgtggccctggagggtggaggtcttgcacagcgaaagggtgcactctgcctggaagttgtcctgggcaaaatgctcagaaccacaggggctggctgagcgcaaaaccattcttgcccttgggccatgtggagtccctgggtgggctctgccccgtttgccacatcctgcattgtgcccaccccgcaggagctggctaggcgtgcagtgggagttggccaggcatacgctggcagagcgtgtagcggtcttggggaactcctgctactgccattttcctcagcaagagcatgcaggagttccagcttgcattgattcattgaattcctgaagcgaagctacaccagcacatgggtggctttgaaaggggcctcccagagcctggggctccagaggaattcactccccaaacctttgttgagcagctactgtatgccacgctttgtgctagaggacaggactgatgccacccctgcccccaggcactgacagggtagcagagggaagacacatgagctgctttttaattttttttagaattaatagagacggggtctcactctgtcactatgttgcccaggctagttttgaactcctggccgcaagcagtcctcctacctcagcctcccaaaatgctgggattacaggtgtgagccaccgtgcttagccatgaattgattttaaaaccttaaatgaggggccaggtgttgtctttccgtttgcctgagtgacgcgggtcttctccaggacatccggccacagatctgcccacggaggaggactttgaggccctggtttctgccgccgttaaggctgataacacctgcggctttgccaagtgcacagccggcgtcacaaccctgggccagttctgccagctctgcagccgccgctactgcctcagccaccacctgcccgaggtatgtcggcctcccctcctgcgatcaaacagtggggaggggtggtgggttccgtctccaggaagcagaccctgggcagacttgttccagtcggaacagttagctccttacaagctccagataccttcagaaacagaaatcagacactgactcatgatcggttttcagcacatcagggcacaagcaaacaaaatgccttatttgctgagctgcagccacgttagtgggaattctgggcagagggaattttgtcccagtgtccttgggttctgtcagtggcctaatctggtctgtttggcataggggaggtgggaggcagagcctccagcccgtcatctgagctggccatggcccggctgctgtgtcattcattccttgagccggggttgatgagaaccccctgggccaggtgtgggcgcctgtggaaagccgaggtctgaaccagccttgtctctaccctggaggatgctgggcctggtgggggacctgggtaagagaccagcatacagtaccaggtgttgagtgctctgaggaagaaaacccagggccagggtggcagcagggtcacccacccagatgcagcagtcagggtgggcttcctggaggaagtaacactggagctgagacctgtgggacagaaggtgggagctgggctgggaaggacagggccgatggcgggtgggcaggcaggctatccacccttagaacatgcataaagccccaggcccagtcagagagttgggagtagagtgtgaggcagatggctagagttgaggctgggcatgtcctggcgagctgcctggaggagtcaggcctgatctgaaggcagtggggtaccctctagggtgtcagcagggctgtgatgtcaccagtcttggctgcagtgtggattaggtaggcggaggctgggaggcagtgggaagtggccgcagggactgtgtggtcagtcagggtggtgccatttcctgtgtgcacactcgggggctcccgccacaccagggtgcagaccaccccgccgctctcccgccaggcagcctgcagggtgaaggactgacatggcgggaggagtggccttctctgttggggcgcctgtggccccccagctctttgatgggcagagctgcaggatctgcctccttgcccctgtgagcccagcagtgattcttgtgtcctccccagatccatggctgcggtgagagggctcgcgcccatgcccggcagagaatcagccgggaaggggtcctctatgccggcagcgggaccaagaacggatccctggacccagccaagagggcccagctgcagaggaggctggataagaagctgagtgagctcagcaaccagaggaccagccggaggaaggagagggggacgtgaccggccgcatccttgcacgccccgcggagctctctccatggtagcccagggcgctggcagaccatgctccgcctccaccagggccacagaggagcggaggggcctatgggggaggagcggagggccctgttggggaaggttgggtttttggaccccagggataagcttttccgatgtcacaatgtggaggaaagcacctgggggacaacagtgctcgtgcaggtggggcttgggaaatgcacgtcccttcccctcactccccgccaaaacccacatcccagcctctggatcctggggaaggttccagtccctggagaatacccagggcctcaaacttgaagtcactcctccaatgtctgggacttgccagctcagcccgttaggatgagggtgctgagaggaaacaggaaacaagactgcgaatggcgctcaggcagggagcagggagtggcgtttggcttgcacgttcccatgtggccagatgctggggccactttccttctgtctgctggtgactgcagtgttccccctcctcctcaccacggggctcctgtgagtctggggggcacctctttctggcctgtgcacctctctctggcttataaaggtgcctggcctgtgccagcccctccttgttgcgcctcaccgtggggaccaggtgagccggctctcccacgtggttgtcccgggaaagctgccccacagcctcagcatcttcagcacttaccgatccagagcctcccggccttctccggtgtcctgtaccaactcttctatttaagagaacctcagatgatgtacctgagcctcagggttttgtttcagagggatataaattatttaaaaattaaatgaaaacgttgcacactgccccagtgtgtctgctgcgggtctaaggggcgcgccctttgcctgttctgctcagctgctgtgccctccccgccgcgtctctcaagccccctctccttctgacctctctgcggcagactctcccggtgcaggctcctctctccttaaatcccattcatgtccttttatgtccccgatggttctgagtgaggttgagcttccctgacctgcacctagggtggctgtcccccagaggccatttacgcagcgcattcggctaatgtgtcctcaggccaggcctgcacgctttgactgccgtgttcttgctggtcctgggcgactctcccttcctacccggactgacgccccaccctgggccactagagcccctcctcctccccctgtcctgtccttgtctgttcccgtcaagtggcttttggactgaattgtttgggaaggggaccaggactctactgcattttgtgtcaagtgcggcagagttaatctggttgcttccataagtgctgagcaccatgcacagaaggctgcagttctcatgctctttgaggacccgtggctgtgggaggcatttgtgtaatgatgctcttgggggatgagggcaccattggaagcatctcccggttgacacagcacacagggacaggtgttcttcctgtgggggcgggggtgcctgcttaagctccccaacttcccagaatccaaacagctgataagagtcctgccctggggttgacacggatgctgaaagatgttggctcttgggtgggagacagccgacagccacactccctgcctcctaggtagcctgtctgcaggagagaaggaggccaaagagaaacagacccaaaaatgggggtgggagagtgacctgatgacactgtttgagcacctggatgtagccatgcctgacctccaccccattcttcctggtgtcctgagctagtaaatccccttttttagctgaagaagtctgccttgggtttttgtcacttgctgccaaagaatctttgctgacccagtcatgcccacatctgtttatcttattgggcatacccctcccagcatggaggcagtatggaattagtgtcgccccactcattagagaaggcacgattggaatccaagccctgtacctttatccaggtgttcttctgtgggccgtcccaccaggaggagcttgaagtagaggaaggcagccagcatcagcggcgggccgggcgggtggggggtggaagcttctggaatcggagggacctgagtctgaacgccagccagcaccaccgtccactgaggtgtggcctcagcaagtcacctctcctctctgagcctgtttgtcatctatgaagcaggacgggaacagttgctgccgcgccagctgtgctaagtggaagacatgaagtgcagcatcacgtccttgcgggacctggctccgggtttgtcgtctccctggctgtgccccccagcctcctgcatggagccttctccccttcagcactgaccaccgcggcccttggtgatgcattgttaaaatgccagaacccaaggttgcaacataaaaagtttccatttctcatcccagagaggccttgttaggaaaatatttgtagctggttgtttgaaaagtaccctacagtttggcctggatagggtaacccaagaaaaggaaaaaaatttcccaagccaaacgtctccctggccagctggagtgtggtcttgctgacagtagctgcaggctgtagcccacccgggccggaaccgggtggaagagagtagaggactcccttctaaggagaactgcccacctccacccgtgcggctcccctgaggtagccccgccatgtgctcctttccgggggtgctgggcagggcagtgggcacaggcaggagcccctgccagctctgggctttgctcctgagtttacttgggatgtgctgcgtgccttggggcctcagtttcctcctctgtaacatggggaagtaacaagacctgt

SEQ ID NO: 771 - DNA, 40325 bp, Human; identical to SEQ ID NO: 580

SEQ ID NO: 772 - DNA, 107045 bp, Human
  misc_feature (1)...(107045): n = A,T,C or G
ctcagctttttagttttgaattttaaagcaccatgattgaaactactgagtgtgccttgagttggaagtctctgagacaagttgctttggccatgtgtgaggtatgaatgggcccagcctctggaactgtcagcttggttgttggttggctgggctgggctgggcctccctatcctgggtccttttgaatctgcctggtggggacacaataacatctttgtaaggaggggcctggactctaaaggaagcagctgactgtgttttgaattcaagctcttttccctcttctctccgtatgccccatctctgccaccctccgccccacaatagagggaaggtttttactcctcagagaaattggattttggttgtaatgaagtcattacatagaccccgtaattgtttaaggtagcgagtttacaggcagtcggtgctggcattccagtgtgatttattcttcagcttctcagctatcctgctgcagggacaaagcgggtattaacaacctgtcatgcaaaaaatttgacacggctataaagataatccttctctctgtgttccttcttcactggcctcctactgctaaagtaaatgagtaacgttttaaagtatccattctttaacatcaaaatattatccttaatttgcttttctctctggcttttgtcttcgtgtgaggataaagccagctaaaaatacctgtgataattctttacatagcagttatccagcaggtaccaagaaacatacagatcctgtgatgggtgaatcgacccttccttgggcactagggaagaacgaagggcaccagcatggggccgggagggtctttccgttgtgttccgctgactatcagtggggcctgtgtacctctcaccgtctcacgcacttactgcctaccccttattattttgagtcaagttctattattacagtctttaatatatgggaaagggaatctggttatttgctgtgatgtttaaggtgctttcctctgcaagaagtagaaaacccatcaaactgacttgagccataaaaggaatttattggcttatgtcgctgaaacatcacaggcagatggtttcaggccagggctgatccagtgactccatggtgtcactgcagacctggtttctttccttttactggctctgcttctgcagtggttgtcttcaaactaagagtggctctcctcatggtcccaagacagttggcagcggctttgaggggggggttctgtcacactcaaaagagaaaagagtctcagaaagcctgtgtctctgcatcctctgaagggtcttacttggcattgtggtcaggagaatggagtggactgattggctcagcctaggtcacatgatccgtatttacagttgggggtggaatcggcttccccagaaccacaaagatccctgggtagaaataccttgagacgggaggagaggggagataatgctggagaagtgaccaacaaatatttggtacatatgacttatcagtcgcttaattataaacaaaataatagacctttttctgttctgtgtatttaaattggttaatattggtgctagaaatatgttgttgaaggcaggacttcatatatatttttttttaccgattccctggtctcaatccctcgtttttcaggctcagagactagacgtgcaggaaaagagtttgctggaagtgaggtcagatcacagagctccttgctgctgtcccaggacctgaagtgggagggaaggaggagaggacagaaatggagacatgatcactctttcaataaaatatactttaaaagtttatattccttgcagcattatttataaagaaacaggcttagtgtaaatgaatgatgataagaaacatccctacctaatttgttactttccacaattggaactttcctattcacagttctcttgtccccctctgcaccatgccacatcctcactcaaatcctgttttttttatgaacgataaagaatcctccatcttctcttttcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactgtgagtgccgcctgggccaggctggggagagggtgtggtgggcgtcagctggcatcttcgttccagctggaccacgccacagcgagcccaagagagggatcaggaattggttctgctgtatgaggtgtgtgagaacaatgccgtgctgcctgacctgaaacccagctgcagggatctagaacaaactctaaagagcaactcccatcactgtggttccacccagtttgcaagagggtctcccagtcttgcggttcaccactttctggggttcatctttgctgtgagcacatctgttttctgagtttcctgttaagcttcaagcatatgtccttctcccctctcactctattcctttactctgtttgtttttctgcctttcttcctctgttctctttatctcttcccccatctcttccccctccatcttaaatgcacgaaccccatttttaactgttaattccatcaacactaattatatgaatgggtaaaattgagccagaatcactcaaaaaggacttgtttttaaagcaagttgctgattttctcaggcaagccatgcccgtcggatgttattatgggaaactgattgcggcaggttattctgtggcgtttctcatctccctctcccacccctccagtccccagcttcctgcctgctgtgctgagtggggccccactccctgtggctgagtccatcagcacatgctggcgagagaggacaggaagccagcttggggcgcacatctgctctgtctccgggcttttgggatggaggcgagatgtgagtgccttgagggaggaggggcggatggaaccaaagaagatttgaggacaaaccaatcctcagtggctcgtagtgatgacaggctccatccattgaattcagcctcttgaattcagatttgcccttttgcccatccaacagtccccttctttgcgatccaacggcctccttctttgcagataccttaggggtaagaagagattttcaagaccagaggagaaggttggcagagctgccaggccagctcccaggcgccaccctgcaggtacctccactttgcaatcccaggtgcctgcggtccccacagcatcttgtctcatcactgggatttgggcacatttctttatgggtctcagctacaaatttcttaaccataaaatggggttaataatatctcagatggtttatggggagataaatgagataagaatttttaaatacctaacactgtgctggttggtagatgacattaatatgctccctccctcccttccttcctctctctctttcccttccttcctccctctgtctctccctccctccctnnnnnnnnnnnnnnnnnnnnctcctttttctccttccctcccttcctctctccttccttcctccctttctccccccttccaaatcagcagttctcagtcttggcacaagtgacattttgggctgaatcactcttccttcaggctgtcctaaacattgtagaatgtttagcagcatctctggcttctacctactagattccagtagcactcttcccccatgttgtgacaactaaaaatatatccagacattgccacatgtaccctgggggcaaaatctcctgcttcccccgtaccctcccaccctcgtaactgagaactctggctttaaaggaagaacagagctttaaggggccaggagattaaggacttgcttagggtacaacagaggaaaaaggacaaatcatggtgtaatcctcactgtggctttatgtggctcctgggagacagcagcctagagtgaagatgggggctggggaaccagacagaactgggatcaaaatccagggcaaatcctttcttgtctttaagcctacatttcctgccttaagacagtgcatacaaagtgcctggaaaaagaaacataacaaatcacaactattctgccttttcagataattcccaggttgtgcccagtgactcaagaatgccacttatcctcatttcatactaaaatatttgagcgatgcctatgagtcactgcccctcttgtgcctctctgcgtgtacatattgtgcattcaacatctgttgtctgaccccaattcatagatagttcccattaggtgcatttactctgtgcctaaattgggtggcatacaattatttttttttactatttgattatgtaaaaattttatttataatacagcaaatatagtgttggaggagggttgtgtcattctatgaaagttaacacatgtaaatcatgtaaccagcagtctaattgggactcagaacagttcccatacccctacatactccagtaccccttgtattaatactaccccttcacgcctgccctctactgcctaacccctggcaagccctgagctggtcttcatcactgtttgtattagtccattctcacactgctataaaggcagacctgagactgggtaatttgtgaagaaaagagattcaattgactcatggttctgcaggctgtacaggaagcatggctggggaggcctcaggaaacttacaatgatggcagaaggtaaaggggaagcaagagccatcctcacatgaccggcaggaggaagagagagagaagggggaagtgctacacactttgagacaaccagatctcctgagaactctatcaggagatcagcaagggggaagttcacccctatgattcattcacctcccaccaggcccctcttccaacattgggaattataatccgacatgagatttggatggaggcacggagccaaaccatatcactactgttttgtcgttttgaaaatgtccagtgaatagaatcatacagtatgcaagtgtttgaaagtagcttctttcactcagcataatgcattggagatttgtgcatgaagagtgagtccgtttttattactgagtagtatttcattgtatggattttttataaaccattcacccatttgggttgtttctggtatttgataattaggagtaaaactgctacaaacattcccatacagacttgtgtgtgggcataggtttttatttctcttcagtaaatacctagagatcttgggattgctggatcgtgtagtaaatgtatgttcaactttatgagaaactgccaagctgtcttctaaagtgagcataccgttttacagtccctgcagcaatggatgagaattccgattgctccaccagtggggctctgtactgtttttcaattgtaggctttctaatagttgcatcttggcatacagctttacattgttaactgcatgatgaccctaaatgaaagctgagcgatctcactaggaacagcttttagatggagtgagcgggagggcccttaggagctggccacatccttcacagggctagacaggtccctggttatttgctcttcataaattctagtgtcccctaggagctgactatttttgcctcttcaccacccaggcatctgaggggttgtgatggttaccttcatgtgtcaacttgactggaccatgaggatcccatatatttggtcagacattattctgtgaggatgtttttggggtgagattagcatttgaatcagtagactgaataaagcagaacacattcgggaatgtgggtggctccgtcaatctgcgggaggcccgaatagaacaaaaaggctgaccctaagtaggagaccatttttcctgcctaacgtggctttgaactgggacaccggcttttccttgcctttggacttaaactgaagcatcagctcttcctgcgtcttgagcctgatggcttgggctggaactacaccagcagctctactgagttgccagcttgccgactcacctggcagatttggggacctgccagcttccataataatgtgagcaaattcctatatatgcatatgatgcgtaggatgcatatgcacggtacgatgcgtgtttctctggagaaccctgataatacagtggcactaagtacctaagaacagaaagtgcacccttactattatcttggaagtctgtcccattttttatgtatttacgttaccttgaagaggtgtgttataattttttttctttttgctatacttgttttggaggttatgttttataatttttaatagactattgaaaatattaaatctgtccaggagaaacagtcgtctttgcctttgagaaaattatcatcctaaattctaatgtctttaacagaagctttagtcatcagtgacagattccatttccacttttctttcttaagaatgctgaagtacaggggtggttagggagagaatcaaaatgaagaacttgtcagaatataaccccaggaggtaatagtggctgtgtgtctgaatcttctggttcagtagtttccgtgtggatatagtttttggatttactgctttgacatgaagtccacggcaagtcgaacttcctctgagggttagtgatgaagcgggtccccttgttgaaaacttgtgcctgtctctaccttatatatgtgagttctgtcctccagactccatgcccatccttcccactgaaataaacatcccaaactaccccttctcttggtatttcatgaaccactgccactgacccaaaaaggtatctttgctgtcctttgtacagaaactatttgggatctgcattaatggtgcagttgtcaaatcccagtccaggatctgccctttaccatttttgcaagcctgaaagtcgctttaaaggcatatgtttttcccctacttgcttcactggagaatcattcacagaggatctgtcattgcagctcagcatagcatatacctgaaggaggcaaatgtgatttcttaaaatcacgatttcggatttcatgtcctccacgtcccattgttctctaatgaagtcgtgccaataccaaaatttcttcttactgtgttgcagctcacccacacatcatcacacgggcaagccactacaaaactttcaccttcagtgcttgaatcgtttcataactcgccttgttatctggtgaagggcgaagccaaactcacagaacttaaagtcgatgctatttctaaagtgtgtggcattgttcatcagcagccctggcttctagctttccattcctaaacttgctgctcagaaacagctaggtattttggtctgtggatagttatgcatttttctgtctagctgttgtctgcccagccattgttcaaacccaagtgcccttaggggctaggcatacaatgtaaatgaggatggttggcctccatgaagcctcagtgtcagggatgcaccagccgtggagactgtggcccactggagccctgaggccccaccccgaagggacagccaccaatcagttgattgttcctgtgtgtaattttggattcagtgttgtcagctcttccagttttttcaggaaaagtctgtaatctagatttttaatattggcagtcagttcatagtattcacgaacagacaaaataaaacatctgaagattgtgtgtcttgtacacaatccaaattctagcctgttttatgtaagcacatactttatctagcacatactttatctagcacatactttgtaagtatgtgagcacatactttatctagcacagacttccaaattctagcctgttttatgtaagcaataagttgatcactactataggagaagtaacatgagaaagactgcctcaaagggttagtgattctatgggaagggcaagatgcacacttagcattataaaatgattttttttttaaatatacagtttaaaacagtggctcttaaactttagcatgcatcagaattgcctgaagggcttgtttgactatttgacaggcttccagagttttgtattcagtgggtttggggtgggacctaggcgtttgcatttttatttaattttatttttcctagagacggggtgtccctatgttacccaggctggcctcaagctcctgcactcaagcgcttctcctgcgtcagcctcctgagtaggtgggactggggtgtaagccactgggcccagctcagaattgactttttggtttttttcttgagacagggtctcattctgtcacccaggctggaatgcagtggtgcaatcatagctcactgcagccttgaactcccgggctcgagtgattctcccacttctgcctcctgagtagctgggattacaggtgtgtggcaccacactcagctattttttattttttgtagcttcagtgtcattttgttgctcaggctggtctcgacctcctgggcttatgcagccctctcaccctgtcctcccaagttgctggaattacagttgtgagccacaacgcccagccagaatttcaatttttccttttttcctaaccttgaaagccagaatttccatttttaacagattcccgggtgatgcggatgctgctggtctgggttcatcttttgagaggctgtgctccccaaaaaggatatgttgaagtgctatgtccctgtcttagttcattttgggttttgcaataacaagaccacagactgggtaatttatagagaaaataagtttatgtcttacagtgctggaggcaggaagtacattttgctgcatgtgatgtgagtcttcttactgtcataacatggcaaaaggcatcgcgtggcaagagagggcaagagcccactcccaggagcccttttttaaaggtactaaactgacccatgaaggtggaggagcccttatggcctaaatttcttcttaaagtccctacctctcaacactcttacaatggcaattaaatctcaacttgagttttggagaggacaaacattcaaaccgtagcaccatagtatctcagaacatgacctttttggatatgagattgttttagatgtaattagttaagatgaggtcatactggaatagcacagagaacctaatctgataggactggtgtccttataagaaggccctgtggagacagaggaatggagtgaagcatctatacgccaaggaacctgccagaaactaggacagaggcatggagcagattcatcctcagatcccttagaaggaccatccctaccaacgtactgagttaggactgccagcccccaaaactatgtgatagcaggttgttgttttaaaccaccccatgtgtggtcctttgttagggcaggcctaggaaactaacacagaggcaccagttaacagaaactagatttcctggactgggagcctactcgcatgttgatctaaaattctataagcaagttagaaacaaaacaaaacataatgcctaattatggtaatgccatcaggtaactgcaaaatgacgcaatacatacatctcactccctgcagatagcctgagcagagaaggattggagcgggggtgggggtttggagtctaacataagataaggaagaaatggacatcaccaggttctggcctgcttcaggatggtcacctgagtagctctggatcacatgtctgaaaggttaccatgttaagaattataaagtaaaagtgctaagatggccaagtaagtattggcatggtggattgttccagagaaatcaagccagtttggttctccaatcctaaatgtctccccttatttgttctgcttccatttcgaagcacatctttaaaacagagtaaccccatttagctttctctctctttctttgtgacaggaaattccatttaattagtgcagtctgctatggttgtagccaagtgcagggcgtggagtgaataatgcattttttatatttaaaaaggtaaattttgctgatttttttaatcatggtaaaacaacatacagtttaccatcttaaccatttttaagtgcacagtacagcagtgttaattctatgcatattgttgtgcaacagatttctagaaccttttcgtcttgcaaaactgaaatgctgtgcctattgaacaactcctttttagctctgtgttttactttggctaagttaataatttctggaattcagtttgcccatcacaaacaactgctaagttgtattcaaacatttgtgcaatattaggtcactttatgtaggatcacggttcagttggctcactctctcataaccaaactgagatgcaaaataatcagaatacaaatacaactttgtttttcattgtatgtcagcgtggtgcatgtatgtagacgaacacatggtgccttggtcagcaagatcagaatcgcaagagcctttgaagaaacacatgcagtgattaaagtgatagtttcaaaggatcttaaaagtggcaaaaattgtacagagctgaatgtggtggtcgggacttagggaagctgataaatggggtgtgtggcacagagcccttcagtctccctgtctctgcttctctctgggcgctcacgaaccacaatagcacacactcagacttcctcaatgccttcttttgctgccacatttgttctctcttttctgagctcgagccagctcttttgactttttgaacttttgtctttattcacaaaggtaatttcaagagctcttgtgggttccacttctggcatcccgctcctcagatacctactattaggcaagagcagagaagtaaagtgcatttggcagcagtctctgcctttcaaagcagagctaaatcatgtaaaataggttattttccatccaggcattctcttgagaaagaaaaccctgtgtgtgtcttcccccatactctcacttcttgccagttcagttgaaaagtgttcccttaatgttattaaataggtattttcactcactgaagtggattatttgatttctgcacggtcttaagaaaaagtgagacaataggagtcttacaaacaaaccctatgtggtatctgtgagctcatagatctgtagtttttaggatatagtcataactttagtatctgccatgatgttctccatgctgaatacatgagctataagtaatatttggaatctctgtttatctccaagaaagacccatgatcgtggttaaagtttgggaaactgaggcaatgctgcttagtcacagctccaggcaggtgactattcttagactccttcccagggactagactcttctgcatcactctctggggtggtgcaggtcctgcaaattgttcatacttcctcttagaaactctccctgatctcatatcttcttcttcctgttttggccaactgcttccccaacctgcacatcaagcgggtgtaatggaagagaactttgtggaattgcggctttagctgtcccctcacaggtactggttttgcctcttgcccagttccctctcttcgctgctccagtatgttccccatccttgtcgtgggctccccggcactgtggctgccgccatcctggccaggcagctgcctctctccacccagagccaagtcccttccaggccctgggactgcctgtttggtggtcaggctccactcaaaccttccatttggctttcccccactctggtcatacggagtccacatccaggtcttgctgtgcccagaattctgggatggtgactggagtgagggttggagacaggcagccggggatggttcgtctccagctggtactccaagacggagagtgcctaggccacaggtcatgagagcattgctttattagatcagtatctgcaagcaggtcagtgacagtcttcccaagacgtccttgagcccctcagagcatccccttctgcctcacgtccttgcaaaatgtggtttaacaagcaaatacttccaagaacaacctcatactgctttttcctcctaatttgtatttccagataaccaagtattacctcaccttcttctatttaacaactctttatttccctgtgtgtaacttgtttttaatattgtcaaaattactgcaatgcaaatgaggaacatcagggatccagcgggaccgctgggaatatgtgcttgttccgtgttgaaatgtcagtttcatttccagcctctgaatgaaggcagtgaccgagcatggctactgtgagatgcaaacactattcaattaacagagttacatagaaatgggctcaaggacctggtcttccctggacgacagaagtgtcattgacgtttcccctaatattttgataggaaaattcaagtagagttgattatttcaaaaatgtagggtagaacgttcactacttttaaggcacttgcacttaggcatgggtcttcccaaactgcctgaagagaggatatggttaaacaactgagtggctttccttggaggaaaagggaaactgcccttcactttacctttctgagtcagccacagtgggcgcctccctgaaatgatctcatttaatccttgcgtgcaactctaggagagtggtgttaccaccctgcaggtaaggaacgctgtgccccctctgtccacatataggtcacaggagccggtagagagatgctcattctcagacagtagcctcttggagagagaattcttttgtttgagttttctaagccctaggattctgctaagccactgtaggattttgcctgcaaggccccattgtctgtgggctggttggccagctttgctcttccttcttgagagtgactttcacattccagtggttctggagacacatttgctcctcctccatttgaaagcagtgatttagaagcttttgaaagccaacctggcctcccagggcccctcacctttctgcttccttctctagcgtggctgcattgttcttgcccctcatttcttagcatttccatgaagttgggggtgggcagaagatgttctagttttccagtgggattgctgaagcctaggagtgggatggcttcatgggggctctggtgtgatagtggcatgtgcctatatgccccttgcatatgtttctttgagggcaagactacgtcctactctggcacccacagcactgaagactgtgcttggcccaatacatggatgtcaagtccagatagagcaggaagaacagcaggatctgaaaaagagtcacgtgtggctcaagaaccagttagttgaccagggagaaggacagttttggggggaaacgttgatttacttgcatgagcttcagaaaactcttgaccgagtttcctaaagagcaaagtaccccatcctcttgagtatcagggtttgggtcagtttgggtcctaccaggaaacagacggcccacacaaacagggaaatttgagacttaacaaacatgtgtgcaaggtttggagaacatgataagtgatggggaagcaccctctgagaatggagctgtcatcacccttgggcctgaaaagtaaaacaggggagtggtgtgaggaccctggaatggataacttcctggagagcactgcataacacaagctgagcctcagtagagggcctcagccaaatccacggccacatggctggaaactgttctccttttctgtggggctacctgttggccaaaccaaactagtgtcctgttttcaagggaaccttttgattcagtctctatgagcagcctccctaaacccagaagtggatgtaggagattggagcatagatctggagaggcagggagaaagtaacttcactctgggttcaaagagatttgtcttggttctctagtccagatgacacttcagtcctgatgctgtagctaagtagttacaacccaaacttcccggtgtcccccttccccaatggcatccttccactgaaaaatgcacaatttgtcactgcatagttagggtccatttgatctcatgccctcttttctcaaagactttctgcccatcagaaattctttaaaagggagtacatttttttggaagcatgatccccttttgtttttcctattttccacttccttattggaatggggaggtagagacatggagggtgagggccagaagtcttggctctttggcaggtgatagctttccattgccagggccacttgcctagcaggaaagctcaacaccacctacctcttctaccccttgggtgccacatccatctcagaagggatgcgagtggtcttggtgctccttgacatccacgtttataatggatgcaatgggaagagttttcctggagacaggacgcaatccatactcactcccttctcttccttgactctcattcccccttcagatcactttcatctaccttccatttccactactgccactgaaagggtgctgccaaaactttcttatatttattgcaaagtgtattaatttgtatgcagcccatgatactcaattgtcacctcctaatcaattggtaatccctacagatgtgtctctaggtctctctggagccctacagttgcttctccagtggcctactcgacatttcctccaagacgggtctccccaggtacctcaacttcacgtgtcttaaactggactcatagcattccctccatagtccctgctcccctctgcttctctagctcagtccatggcatctgcatcttcctggttgctcagactgggaagcttggagctctccttgcttcattcttctcccctattctccactgtggcacacatctagtcttccgtgacgtcctgcaggctctgccactgaaagagcttctgagtcttcccttattaccattctcttactttggccctggcccagaatctcaagaattcttcctgaattattacagcatcctctagtttctctcctgttgagctcacccctggattcattacaaaacagctgcttctcttgctgaagaatcttaggtgaatggcacatgaatagatgctcaatattattagtcagtaggatctataactcagaagcactgtgagatggcgcttcacacccactaggatggctctaatcaaaaagacaggcaatctcaagtgttggtggggatatggagaaattgtaatgctcaaacagtgctggtgagaatgtaaattgttccagccactttgggaaacagtttgtctgttcctcaaaatgttaaacgtagttttcataggactcagcatttccactcctcagactgtacccaagagacatgaaaatatatttccacatgaaaacttacacatgaaagtggtagaagtattattcatactagccaaaaagtggaaactaaccaaatgtccctcagctagtgaacaaaatatggtatgtccattcaatgggctgttacttggcaaggaaaataactgtgacaacatggatgaaccttgaaaacatgctaagtgaaagaggccagacccaatagaccacccaccctatgattttattgacatgaactgtccagagtaggcacatctgtggagacacaaagtagctgcgtggctgccgagggcaggtgggagtgtggtgggaaagtagggtggctactcatggacacagggcttctcttgggggtgataatgttctaaaattagattgtggggatggttgcataaccctgaaaatactaaaacccagtgagtggtacactttaaaagagtgaattgtatggtgcgtgaattatatatcaagaaagatttaatcttggatgactccctcctgccctctgaatgaggtccatgattggtagagtggtgcagagcctttgaacctgtgtccaggcccctccccatattcatccatgtctcttccaccccactttgcctctgccctgatgctccacccacagagaatgtcttgccattgccagatcacacctgttcccctgtagaactcctactcatccatcaaaacccagctcacatgtcaccctctctggatttcctacccactccagttaggtttaattgtttttgtacttgtgttttcctcactttttaggcgtgtgtcgattatagcacatactgtactgtattttaaacatttatgtgtctctcctgcagtggactgtgagcttcctgaggatgtgccagtattttactgatttatttttctgtgccaaccttgtaggagaggatgtacatgctagcacactgtcagtgcccagtgaaagtggttgaagttgaattctgtcagggagactggctgggaaacaacagtaaggactctgaggaaccgcaatgaggagctttttcatggcaaggacagtggggtgaagagaggaaacagagccacaggcactgcttcccgaaggctctgccttgcacgtgacctgccatactctaagtagtcctctctcatgagaacggggcagtttgtcagcagggctgatttccaccctgggcctgagaggattgagacgcaggaccatgtgttcaagctggatgcatgggatgggaacgagctcaatagaaggacagtcgatgggactccacgggacaggcattgagaacctattatatggccggcattgttatgctagaggccaatgacagtcagaggtgggcggttgaaagtaatgctgctgattgtcgttgtcatctggtagagtcatgcccatcacgtaacagctgccaatgcatatttctgcaaagaaggaaagaaagccgatgagctcttcagaagatgagctcttcagacaatcctaagtctcctttacccattacagcatcctccatggcactcaccccaatcttactctggcatgcatgggcccagacagacgatgctgttgaaaaggagatctgaacctcatctgctctccttagaggcctctggtgggggcagatctctgctctcagcccctgcttccagcagagcggggtttcaggccaccctctccctggccctctccccaggtgggcggtggagaccctctgctcgtgcccctccgctcgtgcccctccttggtctctgattccctctcctctcaggaccaggtgttttagagctcaaagagggaaactgggatagaaaacgtgtgacagccttagcacctgctgagtgaattccagctctttccccttttccatcgcttcctcctcctcaaacccttcttccccctcctcagactaagggaagaatcgctctgctctatgcctgttaaaattgcggctctccatgtctcaaggtggctaaagaacaggcagcacatccttcggatcagctgtgtgcctctgatgggctggtggtcctctgtcctgggatttccaggtcatggaagggcagggagaattaagcccagtcaagaaggaggaagagaaggagtagggggagggggagggggagggagaggggaggaggaaggggaggaggaggaccgggaataggacagggaggaggaggaggaggactgggagtaggacaggtaggaggaagaccaggaagaggacagggaggaggaggaggaggaggagctggtggtggtctgtatttccctggataatagccttcccttgttttcaactagcccaggcagattgattttggaaaaaaaaacccatctatggctctccctgcttggtttactctggccgccttttgttccagtgccagttataattacccaggctgaagagatgcctggcggcccctgcttttccgtttgccccacttttgattggcctaattatttctgtgggtctccaaagcctgggctgaagccattaaagcaaccagagacttggcatgtgctgcggccactctggctgttaagtgtcttgtttctctgtgcctgagcactttctttagttccagcccgggaatctccatgtgtccactggaggatggagctatagtttgtctgtcaggcactttcctttctaccctccctcctccaagtattgcctggagcaaggattccctccctttcctaccctgggacagcatgcattggtcatgaccacttactttgagtgctggggtaaatggctgaggttgtttgtggctggagatgatcacctggaaggtccagcaggatactccagggccccatgcaatacccaaaggtgtggggagaggcctgtgcctctacacacccacatcccgtttacagcgacccggttgtcaggctcggccattgcactgggggatgccgtgcccagaggctggtgggcttcccacctgcaccacctagtccagatttcctccattcctgtagccatctgcagtaagcatttctgcatcttccagcctccctggccttcccagggaggaaagagtcttcatcgtcttccttgtgtgtatcactcccattgttggtgtgccattttctgagtattttccagactctgtgtttctcttgaaatctagagctcagggtggtctgtggtctgcagttctttggatgttgaacattagggagtctgcctcttgctttgggtttgaaatcaattgcattcctgatgcaggcagctaaggatccactctgactctgggcttttttctctcatgctaatagtttctcatctgaattcgtttttaacttcacctgaagtggacactgttgagcacccctctctaccctctcctgcctgttagaactgtggcctgggtgactctagaccctcagcctctcatcaccaatccagtaatctgcagttcccccacatccacactgggctcggtagagcctcggcaatatcagagccctttttcacacgttaccacctctctccaagggcatcctttgggcccatggaatgacttgggatgcacattgagccaccattctagaatggctttcatgctggctgccttgcactttttttttttttatttctctgagttgatggcctctaccattttcatttctaaaaggtctctgggaactttaacaaattctgatttcatttctttggagtatttttatggtacctcccccatccatttctctttcccatgcgccctcgctccctatcccctgtggaaacaaaaatgcaagcagagaatcagaaactgagccaatgcccagtgttggggtaggaggctgtggtttctgtgaatccttcgtaggtgtgacaacctcctacaccagacaccctgcagggtgtgagtgtcaccctgctgcctgagcagcaggctccggtacctcacaaaacagcactaaaggttgtcttctcctgaaggttgtctcttacaaaccaagtctctgaaccaagagcacattttcaagaactccagtcattttgatgtattcagtgggtagagggaaggtagattctcttccctgaaaggggaagagaggaaaaaaaaagattgcttttggtttgttggcttgttttataaatgcctccttatattccacataatgcttcctcaatttaagaaaaaaataggctgggtgctgtagctcacgcctgtaatcctagcactttgggaggccgaggcaggtggattgcctgagctcaggagttcaagaccagcctgggcaacacggtgaaaccctgtctccactaaaatacaaaaaatcagccgggtgtggtggggcgcacctgtaatcccagctactcgggaggttgaggcaagagaattgctagaacccgggaggtggcggttgcagtgacccgagattgcaccactgcaccccagcctgggcggcagagtgagactccatctctaaaaaaaaaataaataataaggactttttaaaaattccatgtcaagctgagaactgcagcctcctgtttgaaaatccgcgcctcagcaaactgccactcaatcatttggccctgaatttgagcatgccatcatttgagtcagtgggttgggtaatcacataaggggcccactaggacttgaaagcacaattgtttattatgctgtgctggtaatgacttccaccttcttaacagctgagtaaagtggtctggccccacatcctcctgggcctgctggtattaataaatcatggtgcattttcttttcaccaatccagcattctgtttccttcttggatgctaaaagaaagtcatggttttgcttttttcacttatgaatgaaagtgattacattaaaaatcttccttttccacacaggctggaccttaatgcagcttcacagattagtctttcatgcctatggaagaccacatttttgaggctagagaccttttggggatcccaaagtatttccaaatgtggatctttcttttcttggcacagttggcagagctaacaggtttggtccctcatgcacgaggcatacatccctgaaacataaggtttttgtgctggtagcgacagtccgtccccatcatcaagcaggacacaaaggaactggaataaaattgcctgttaattttaggagacattggggaccgggtgcagtggtgacgctatgggctagagggtgggttgggagtggaggtgtaagacaagatagtttttatgaaaggttctgggttcctgagaggaagggattgtgccggggatcgagctaacatttcctgtgcaaggactgtgtgccatgcccttgctcataagtgcctttcatttgagctcatttaatgtagagacggtgaaaaaacatccacctctgtagaaagctgggcctgaggagcaaaacccctcagataggaggtaacactttgttcctggactgggaggggaactcaagcagctttattttttctgaatactgataattgccattcactgagcactttttatatgccgggtgtattatatacatcgtgtcatttaatcctcacaaaagctcaaggaggcagggttctgagattctattgctacaaaagaaagcactccaaagcttcttgatgtgaagtggcaacagtcatttgttttgatcacaaatctgaaattaggacaaggctcagcagggacaccttttccctactccttgcagccacagctggagcagatgcctggggctagaggattccctacttagatggcccctgacatgctgcagatcactcagagggaacccccttccaagatgtcctccacatgactgacaaggtagtgctggctgtcagctgtgagttcagtcagggctgttggttccactccacctgtgctcctccactgtgctagttgggctctcccacagcatggcagctgagacctaaggtcaggtcctccaaaacaggacatggaagttgccagtctcttaaaacctggatctggaaactggcacagcatcacttctttcagattctattggttgagcaggcacagaacttgctcagattcaaggcgatgcagcaaaagagaccacagctctcaatgggtagtgccaaagggtttgcagccatctttattctaccagaggtgcagaaaggttaagtgtcttcccctggattactcagccagcaagtggacaggacccttatcccctgatttcttccagatcctgtgacactcctgagttggccagagcacccgactgacctcgagtcagctttctgtgtccattttttgccatcaactgtacctgtaacatcaatgcccaccacagcgccagaggcctagcgaagcgaattctataagcattcctaaatcacctttatttggaattgacttaaagagcaacaatggcaggaccctaggcttgagaagaaaacacccagggagcatgtgataaccatcttcagatgtgggagggtgactgtgcaggccacagcgtggttggcgttctgtgacctccattgttcttgagtagttgacaaactacagccggtggtcccgagaccatcacctgcatatgtgtagtccttaagaaggaaatgaaaatgtttttacattttcaaatggtggaagaatgaaagcaaaatagaatacatagcagagttgaacagatgcaagagagtgtatggcccaggaagcctctcacagaaacagtttgttaatcgctgtcccagaaggcagaatcagcacctatgtgaccagaggtagatctcgggtcgctataggaatgaattttctaactaagagttgtccatcagcaggaacagcagctttcagctgaaggccatacaggcagatgctgtgccttggacactgtaagtctatggtgtgctggtaaagctctaacaacaggctccccaggggagagagccttggttggtaatgtttgcctatttctgtggtataaatgctcccacatggccagtctccagctgccagcatagcatcactaaatgcagagtggggaggagatgcacacggtcagctgtctcaggagccccaggttccactgtgatgggctcaggcgatcatcagtatataacgctgccctcgagtagctcccagtgtagagacttgcagggtcttgggtaggcacagtagtgctggagacttctgtgagatgccatctgctgctctgggcccacaggcagccattgttaacatccacaagcccagaaagattaagtactttgcccagggccacacagctgctaaattccacatgctattttattgttctcacatttggtttagaaaatcctgatttctgcagaaagattgataagtttgaccgcattcaaatttaaaacatccgtttaacaaaacatcactttaagcaaagttagaaggcaaataacagattgagagaaaacatttagaatatgtgagatcaaggcgtgggtatccagaatatgtaaggagtacccatcagtcaattaaagttaatgactatgatggttcagtaagaaaatgggcaaaggatgtggacacgcagtttatacccactcaagtacaaacagccactaaacatgacagatgaccaatcttgccactaagcaggggagtgtatgataaaacattggttcatgttttccacttattcgattggtaaaagtaataataccaagcaagggccatttgcagtgactcacacctgtaatcccagcactttgggaggccaaggtgggtggatcacctgaggtcaggagtttgagattagcctgaccaacatggtgaaaccctgtctcaactaaacacaaaaaattagctgggcgtggtggtgcacgcctttaatcccagctactcgggaggctgaggcaggagaatcacttgaacccggaaggtggaggttgcagtgagctgagatcataccactgcactccagcatgggcaacaagagcaaaactctgtctctttaaaaaacaaacaaacaaacaaaaaacaacaacaacaacaacaagcaagtgaggacgcgaagccaaagcaacttcatgaactgctgctggaggaatataaggttatgcagcccagcctgcaaccgagcatcaccttgacccagaaattccaaactgggctagatatcctagagcctagaaaacctgtcacatcctcggagtagtcaggtgcacagggaatcattgccttctagtttgtgatagtgaaaatttggaatggatgtaaagaccatcagttagggaatgactaaataaactcttatctagaccttcaggtgaacattaagctacaatgatgaggatgcaagagattaatagcaatgggtattgctgaggtagaatagcaaattgcagattgatgcatagactctgatgtcatttatgttcttaaaatgtacataaaacaatgccatatggtgcatagacttcatataaaaagttccggagggctgtacaccatactcgtgatagtgcatgcttttggggaggtagggatggggagggccagtactggggaggaggggagatgttcagaagcagcttcagttttatagctggatgtttaaatttttctaaaggtcagtgtatttttaagagaccaagccaaagttcagttatttccaaacagaacagtggctgtaaaggaacctactatcttcctcagcaagttcagacccagcaggttggccatggggaggcgcccacatggagaggggtgtctgggtgtggttgcctcggcccatgaggttgaccttgctcctgagggtcctctctcatcacgtctatgatctccatcctggcctcaggtccccttgacccttgcctaagcaggaaaatgctttttgcttaatttattattgcacagctgggacaactgaagaattttaaataagactttactgagagctgagaatgacaggaggaaaatagagtcacagtaggtaggcggtgttgcttataaatcgcagggttcttgtgccaagcttggaatggccaacacctcctccctgctcagcccagccacccaccccctttgcttgctccctctccccttgcccccggcagctctcaggaatgtctaaactccactgtgtctagacccaaaggaaagatgcagacagagtgtcccctctcccatgtagccatggcccaccttccagcttacctgtttcctgtctaagagccaacctcttccccagatttttggccccaggaatgtccatctgtttcagcaaaaccctactcttcaaccacaggagtgtgggccttattctgtcattagcatgaggtccacatcagaatcccatgcctgtaaacctaggacctgggcaagaggcactcacagaagcttcaagggtttctctcacctatggctgtgaggagttcaggccaaggattgctgcggggaatattgcaccgttgccatgtgccagatgcttatatcctagccatgttctcttcatcaatcccattagaagcataggaactaatatcccattttctggacatggaaactgtgcctctgaaagtaacttaacctctctgaggacacagagcccgatgcaaaccaggctactgcctgcagtgcctctgaacccttgagccatgttcttcccataggggtttgttctaggtaccttcaggaggctccttcctgctttcacacaacctccctgggtaaaaggaaagatcccctcccccatgagctttgagtgccacgcatgcatgctgttctatgagaatccatgcggctccttttaagttgttacttgaacttgaatttgaggtgaaaacagacagaacttgtatattcagatacagcttgcattttggatttaaagaagctagggctaattcagaggaggccttaaggttaggaacttcgttgatatgattcatttaatttgagggaaacagagcatagaagcaaaaaatgtctctgaccccctgaatctatttccaaccttaaattcactccggttcgacaaatgcagaaaggaatgccctgtgttccttcttccccttcctgtgtcccagcttcagttttcattcagcaaagtcctccagtgacccaaggaactgaaattagaatgtgagaggtgagcgtgtgaacacccttcaaggcttcccctaaattaacaggaaagaacattcaacacagtggtgatgacggagcattgagttgtagttcttggtttatttagaggcaaagccaagaggtagttggggaccacctcactccttcacgccgtatacaccaggatagttacggtaaaggaggaatcatctcaaaatgcttggggagttacttaaaccccaaggagagcaccagatatatatttctcatccacatttttctgacctgaattaaaacatttttatagtagtacatgaatgagcccttccttcacaggggaatccaaatgcaaggctaagaaaacacttcagtggattctaattatcttcccctttccttgcttctctttatttcctgaattgctttagccaacctgtaatattttgcttgcagcttgcaaggagttattacttattatgggttggattggatactcccccacaaaaaaataatgttgaagtcctaacctccaggacctcagaatgtgtgatcttctttggaaagagatcattcttctcattggttacattctttgcagatgtaaccaagttaaaatgagggcacttgggtgggccctaatccatatgactggtgttctcataaagggggagtgtggatgcagacacagacgtgtgtggagggcggtctacagggagagacgcagggaaagtgccagttgcaggcggggatgggaacgctcgtctacaagcccaggagcacagagattgctggcaaagccccagaagctgggaagtggccagaagggattcccctccaagctttagagggagcatggctctgtagacaccttgattttggacttgtaacctgaaatttctgtcattttaagccacccaatttgtgctactttgttagtgtggctccggcaacctaatacactacctatacctacctaacccttttattttttattgttttttgaatatgtttttaaaaattttatgtagagatgggggtctcactgtgttgccctgggtggtctcaaacttggggcctcaagcaaccccgccttggcctcccgaagtgttgggtttgcaggtgtgaaccaccatgcctgggcctaactctttcaaagtatacatttaggatcaaataaaattggaaatttcagttcctctatcatagtcagtttgacattatattttccaaagatggcttcagtgttatctgctgtcctacctgtagggccaaacacctgaaatcaggagctggattctaaatcccccttcccttggatctggataggcccttttgatgctgtgtgacttctgaggcagcatccacctgcgtgctgggacacttgctctggagccctgacgtgcctgtgaacagtccacttatcttgaggccagtgtgctatgagggagcccaaactagcccagatggagagaccacgcagagacatgagactacaaggagagaggtgcccagacagcccccgagctgcttcagtgcccctgccatttcagcatcagccattgtctgattacaaccccatgacacaccctaagccacagctgcccagccaacccttcctgaattcccaacccataagataattgtcatgattaaagcctaaggttctggggagatttgttacacggcaatagataaccgcaacagttagcatgctctgtgctttgcattggtcactttcttttaatttataaaatgtattacattattacttgtgattaaatagttttattatttaaagcagacagaagacaaccacaaaatctggtagcttaacattataggatttatctctcactcactcaaagtctcatgcagatagggtaggttgatgacctcctccaggcagtgactcagggatctacattccttctacctagcctttgctgccccctggtccttcttggagtcctgtgctgggtcacctgtgttctggtggccaaagagagagatgagagtgtgggtgggggattacatcggatgttttggggaccgcatctgaaatggcacacatcattttggtccatattttactggctagaagtagtcctggattcgaggagctgggaaatgccccttagttgtgggcctgcaagaaacagggtagtatggtgggaacacaaccgaggctctgccacatctgcacacagatcggaggatcttaaaataccagagctggaagggccttgagaaatgagcttatctgcgtgtcatctctgcttcaggatgaacagagtcttgttaaaatgcagattctggggcctcactcaggaagtaggtaccaggaaattacattaaaaagatttcccaaattattgttgtgtgcactaaggttagagaaccacttaacctggttactcaaccctctcattgtacatagagcaaaggtgaggtccagagaggtgatatgacctccttatatctcttcaagtcacccaccccttgaggccagaattggagctggcgcctctgcctcccagggctttgtgacctaggagccaggcctcgaaggtgtgccctgggggagcatacttggtgcctgatttcttccactctgaagaatcctaatgtttgccttgaaattggcctcatggggtaattagtatgtagacaggggtcctctgcagcttagatgataaccaaagcggatcctaaatcaagtcttgttatattttgggcaattcctagcaaaagtcaggaaccctccagaatgttttaatttagaaaatggaatcttgcaataccttctcctgcattattaaaaggcccactttgtttttaatgtagtgacatgtcctaaataccttctgtcgtggccaacttttagggaggctttggtggtagtaaaagacatgttgggaggagaaagaaccatggtattttccagctctcttggtgaaaacagcaaatgttcattagtattcatttcacacgatttccctgataaagccataatttaaaacactgactcaaagccctaataaaggaggttaacttgctttctaaatctgctgcacagactgctcatctctccttccatcagcctcccttctcctaagccaattgtagaatttggaacaaagagaaaaagtgcaaggtttttttattgattcccttgttaaccagattctgctgttcagcaacatggtgagcatttgagttctggttctcagcatgcatgtgaaaaatcctcaagtcattttctaccttcagagatttgggggccaaacagggaataaattaccaaacaatgcttatcatgctcccaaacatttgctgaaatcatttagtttcaattattttaattactgaagattttataagcagagttcatggcaaaaacatctgccttcatgaattggcacgaaggaggatgagtatatatgtagaaataaaggaagatgagtatatatgtagagatgaaggaggatgagtatatatgtagggatgaaggaggatgagtatatatgtaaggatgaaagttaattagtatatatgtagaaatatatatatatatatgtatgtgtgtgtgtatatatatataaaataccagatgggtatgtatgtatgtagagatgaaggagtatgagtatatatgtagaatgaaggaggatgagtatatatgtagggataaaggaggatcggtatatataggagtgaagggtgatcagtatatatgtaggaatgaaggaggatgagtacacatgtagaaatgaaggaagatgagtatacatgtagggacaaggaggatgagtacatatgtagggatgaaggaggatgagtgcatatgtagaaatgaaggaagatgggtatacatgtagggatgaaggaggataagtgtgtatgtaaggatgaaggaggatgagtatatatataggaatgaagggtgatcagtatatatgtagggatgaaggaagatgacaatatatatagaaatgaaggaagatgagtatacatgtagggatgaaggaggatgagtatacatgtagggatgaaggaggatgagtatgtatataggaatgaagggtgatcagtatatatgtagggatgaaggaggatgagtacctgtgtagaaatgaaggaagatgagtacctatatacaaatgaaggaagatgagtatacatgtagagatgaaggagggtgagtatatatgtagggaagaaggaggatgagtatatatgtagatatgaaggagaatcagtgtatatgtagggatgaaggaggttgagtacatatgtaggtatgaaggatgatgagtacctatgtaaaaatgaaggaagatgagtatacatgtagggatgaaggaggatgagtatatatatatatatataaatgaagggtgatcagtatatacgtagggatgaaggaggatgagtacatatgtagaaatgaagggagatgagtatacattagggatgagaaggatgagtatatatgtagggatgaaggaggatgagtatatatgtaagatgaaggaagatgaatatatatgtaggaatgaaggaggatgagtacatatgtagaaataaagaaagatgagtgtacatgtagggatgaaggaggatgagtatatatgtagggatgaagggtgatcagtatatatgtagggatgaaggagattgagtacatatgtagggatgaaggaatatgagtccatatgtagaaatgaaggaaatgtagggatgaagggggatgggtatgtagggatgaaaggggatgtgtacatatgtagatatgaaggaagatgagtatatgtgcgtatgggtgaggggggatggagtgaatacatagggccttctgggcatcagttgataagtcctgacctagtgggatagggactctcctaacctttctaatgtctaactgaaggacttggttgcctggacagccatgacatggactgcttcataacaagttgagatttgaacagggacttgtgagaagggtcaatgatgaaaactaagaggatcaactagtgctctccttctcccagtcttgatcagtcactacactttgcagtcctggtccctaactcttggggttccagggttattcattgtccttactcctgtggagttgagtttctgaggacgcaaatactgaataaggcacgagatgaccaggccagagaagggcaagcctaatttccattggctgagcctagtaaacaagcccagttcaagatggtgcatgttctagccttctatggctatgtaaaaaactatcccagacccagtggggtgtagcttgggttccctgggaagcagactctgagatggagaagagtgtgcatggtgtttattaagaactatacttaggatcaagatttggagaagaggagaagggggcaggaatgggtttagtggcagccccagttggccaacagggagttctggggccagaatgacccttgagagttgccccaggttgggctgtgatgacctagtctttatatcagggatcagcaagttatggcctataggccaaacccaggttgccacctattttttaactaaagttttattggaacacagccacacccatcatgtacatgtcatctgtggctgctttcatgatacattagcagagctgagtagttgggacagactgcaaggctggcaaagcctaaaatatttaggatctgcccttgatggaagtttggcaggccctgttatgttccctcattgatcagttgctgaatggacagtctctgacctctgtggcctcggctgcgctggagggtccccttctaaggtgccttccttgctcgaggctccttggccttgttctccaaggacatctcttcttcctgggtttctccacgtggcacagtggtttggcatcgtcgtacttcttgcatcttacctgagggcttcaggaggtgggacctggaggcccccagtccatgaaaagccacagcagggctggcaaaatcacttgtgccattggtcaaagtgatcatggggcctgcccagattcaagagatggagccacagatgccgcccactgcctgaaggaggatggcacaatcacggtgcagaagagcatgaggatgagatgctgtcagaccgtcttcggaaaaatgtggaacaccatggcaggccaggtggctgctcggcagtgccgtgtcaatcccagctcacccaggtcaccgctgcagtgcctgtccctccccaactccacccacggtccctgacatcacgtggggagggagtttgagatggccatggtgggaatgtgacacctcgggaatgggctctacccaccccaacgccaaagagcctgctgcacacccctgctgccatgggaggacttctggtttgaagccacatgggaagaaagacagcagcatttattgagcactaagggtcgctacatgtcctggaacctcaggatgactccgtaagctatgatgttaccctttattttatagaaggggagtcagaggctcagcaaggttggaggccctggcaggatttgaaccatggtcccctcgtttttgccatcctgcctcacagaagacggagctggcaggagaaggagatcctgggtctgaagaaagcttaggttggcagggagggagagaaagctggccagagaagagcgggcaaagcctgaggccagggcagcatggggttgccagaaggctggacagtggagtccctggaaaggactcagggccagcagactgcgccagctgtgtgggtgctggaagattcaccccaaccaggcagccaaactcctgacgtttctcattgtctgaaaaatgcatctctgtactctaagacaacacaagcagaatgcgagtgaggtgggctcgggaggccctgaagagggccacggagagaaagccggcggctgggcaccacattcacagcagaagtttcagttccttcccctcaccttcttcctgggaagcacagtggttaggctcaaccaatggaccagttttaggaggaggagcgggcaggaaggggctttcatattggatcctgtaggaagcagtggtatgctacaggggtgacagtggccttctttataacaacactcgttcccgcaagctggaccttacccacgtgccagccttgccagttacacatgtctattacctttcatcctcataaccttcaagggaagaggtcttatgactcctctttggggaaatgaggctcaagagaaggggtaaccttccgggtttcagggtgagcgcgtggcagaagttaagacttggactggatgcaggcacttgacttctccacatcacgtggccacggtgcctgagtcagcccagtggtgcggggcgccccagagagcacagaagccagggctggagacccaggtgtgatgggagagctttctttgggtgaggttggttcacaatctcccactttttcccccctatagttgaaggattttctctccccgttgtttgttttaagaataagatgcaaaagtgagaagcgggaggccttgccttgttccgtgggcagacagtgtgggggctgtgaggccaaggacacctgggaggggagagggtgggggcagactgcatctcccaagagcagggtggggagtgcagggaagggtcaggaggagagcaaggccactgctgaggcagggtccatgtaggacacctttcgcttggactcctggatgtcctggctgggcccaggccctgctgtgtcccctggaggataggggaggcctgtggactgctcacaggagggtgtggctacctctgccaggcccctggggataggagagtcactccaccatccccgtaaaccagtgggaggccctgcagcaggagcgtggaattaagacgtgggaaaatggtctcagtttttcaggtgcttgttaaagatgctgagttttctggtcaccattcttggaagccctcacacagcagattgaaagtgaggctcagaatcttcatttttaaagcatcctcaaataattctgatacccatggactctagaccgtgctaaggaaaacactgacctggagggtgaaggcatgtgggatctgaaacttttaagaaaacagcttttttgtcattcttatctgatcttatgagcaccaattttcttactctgaatggatgtagatgtggaaggtataatgtttggggagcgctcttgccctaagagagataatgaatacagcagtttgtgcataattgcacttaattattatgttgtgaatatatggttaaacttgataaagattaacttataaaaactcttattaaaacttccctgttatttgccattcatcgctatcgtggagtttttaggggagcttgttcgtccatccacctgataaagttttgaatgcatgctgtgtgcctggctctggcggggagtggggcatacagcagtagccaatagctggggtgggaggttctgaccactcccctccacccacttacagtctggacagagaaataaactaaaaaaatccgcaaccaacaacatacattttgctttttttgtaaatgtattctttttttttgtttttttgagacagtctcgctctgtcaccaggctgaagggcagtggcacaatcttggctcactgccacctccgtctcccaggttcaagtgattctcctgcctcagtctcccgagtagctgagactacaggcacacgtcaccatgcccagttgttttttgtatttttagtagagacggtgtttctccatgttggccaggatggtctcgatctcttgaccttgtgatccgcccgcctcagcctcccaaagtgctgggattacaggtgtgagccattgcgcccaggctactaaatgtgatttttataaatgtgttagtatttacatacaaaccaatactagacaagagaggaaaaaacccttatcagaccatatattgtgaatttgagttttaaagaattaattaaacatgcaagttatgaacttttcaggtactctctaattgaaataagaagatatacactataaattctgtacaaagctggcttgcagatttttttctcgtcattagagttaagacatcacctctaagtatgtttaattaaaatgttttcaagatacactgatattttcttcacagcatttcatctctgcccctcctctcatttgtgaacacggaaccttaggaaaatggttcccaagtgctttcaagcacaaatgtgtctgaatgcagaattgtcaacaacctgcacagagaattctgaatccatgcttggcggtttcagcatagtctttatgctgttttcttgtctgaagtttgagcgcaccaatagtctatgagagaaggaatcaatatgaaacagagttgttaccaataacctctgcttccgggttctcagcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaaggtacgtttcaaagtgtaagccagatagaagcttgtgcagatcacagccttggttgtttctctgctaagaaaaattgaggcatctgaaagagttacatgattttcctgtaccagtttaacaaacagaaatatcactataaatcggcaagcataggatacatgccccccactgggatggctaacctttttgtgggatagaggcttaatgataattgattacattctggaattcttggtaaagaatacaaggggtcttaggagccaggttttttagtaagggggctgctctagccagcagctagtgactggcactggttccttctgtggctctgggcatgttaagatagaaaatgtgttgagtgatgcaaaggcgtatggcctgactctgtcaccaataatcaagcaaaccaaactcagattggctaattggggcatttgcctggctggatgcaggacgctgttggagatgaaagggcatgtaagccgtcctcccagccatgacagaggtgtggtctctttgggaagggaagacacgacaggagcaataggaagtggcaatggtgggaagttccagttcaaggcaggaagaggtggtctggtaaagcagcgcgtgctccatccgagtagttgattcagaccagtagagctgggataggatttcagaggagggaggattttccccattcttctgtagcagagctgtcaatgtcccattcatgtccctgctggccccacaaacaatgtgcaaaagcacacactcatatacatcctaacagagggcttgttgcaaatacctgtgactcttcctggcatcttgtttctggccctgggagctggaaatgcaaaagaaaaatgtccacagaagcaactgtcagccatggaggatggagaaatggtggataaagaccccagctccctcctgctacaattggaataacactgagttctccttttcctctcccattcccccagttacccccacttgataggacacctcgtagcagcttccttctgtttcctgtatctcctttctctaccaagtgtttcctggtgtcccctcccacataacccacttgcatccgaatccttgtctcaggcctgcttcagggagaacctagagcaagacatgtattttcctgctgttctcttccaaccaccctttcttccctactttttggccttttttttttttttggagagaagaactattctgccatcttgtcctcagcataacatatcatagctttttatttatctctctctttttttcaagcctgagaacataatgcttttggatagaaatgtccccaaacctcggatcaagatcattgactttgggttggcccataaaattgactttggaaatgaatttaaaaacatatttgggactccagagtttgtcggtaagtttctttgctcctgtggtcatttacgtctcataaacattattctggcaaacctcccctgctagaagattctttccctgctacatgttcctggttgttgcatgaagatagaatcggttagtttgcttcctcccaagctaaatgagtgtttgtttcctcttagctcctgagatagtcaactatgaacctcttggtcttgaggcagatatgtggtaaggagtatgtccttggtgttgtttgctttctgatttatttgactattcttctgacatgtttttttgtttgttttgtgttgtttttaggagtatcggggtaataacctatatcctgtaagtatcagaattcacaactcatactctcttctcttctatgagaccataggtttaattaaccattaaatgtgctgtgttgatctcttcagcttatgcatgcttttgatgcaaacatattcattttacacccccaaaacatgtttagtttatactaattaaacatgttctcctaatttgaaatgagtcatcagaaactgtagcataatcactgaaagaaagcatagctgtccatcactgccgagaaaacaggtttcctttaaactaccagacgctgttccagattaacttgttaagtgaatccttttgcctgaagctgaagcatttgctcctgacagttaaagccctatgaaatataatcaaactgtgactattcgagcaccagattataatcttattccacactccagatgttataggagcaaaatgacaacaccaaggggtcatcattaatgttctatgcccaactttatttttaacagcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagtgagtgtccacgttcctgaaaggtgcttggccacggcctcagccagcccagagcctgtgtctgttccatgcacagggccacgttcctcagaccctgcttgcttcatctgccaaagggcagcatgccatgtgaaacgcttcagaaaatgcaagcagggccctctgcccccactcagtcagtccctgcaggcacagtgaaataatcacaaaaagaccgatgttgtttttggctttcttccctgaactgcattttccacagtatctgcttggcaggcccagccagcatgaaaacaaccttagtatttgctgctatggtcacagcattttttttcttctccccctcccctcaaggaagagaatgacaattcaagatagtttgcagcatccctggatcaaggtgagttgcatattacgaaactgtttagatcactttctatgtgattggtttgggcaccctggtattcatgtatcatagagtactgctaaccacaggtcacacctggagtgttaagtttgctatttgcatcgtatcttaagaaaagctgacaggttagactgtatactaatgatcccagaggtggggagagaggaataagcgagcacagagcaggaactgaagaaggtcaagcccactcgacaactgtgtttggagtgacctgtggggtgttggcccaaacagtgtatttaacattttatgttgattccagcatgtaaatatcaatcaaatctggatttccagcttctcttgggaaatctgaagatctgctgacactgagccctcattccacgtggccttgggaagtggcacaggtgccttggtgctagggaacagggcgccctggaacattacacctttacattacctgcctggcctggttgacatttggattaaagtatcttcaatccagggcagaaagggctaagggtgggaaagtatgatagttacagaataaaatcatgaaataaagaagtgaacatcacagaatcaggctctgggggcaaatagctttgctgtgcaagttcccagcagttacctgggttctcctagccagctatggtgtctcctcctcccagaggtggaggacaaaagctaaatacatctactgaaaaagatacaatacaaggaattctcctgctataggccaaactaactttgctgacctctgagatccctctcagctctacattacttgatgatacccaagttcaaatgcctcataacatagcctcaccatgaatattgccattcccaaactatcagtgtggaaagtcgtgatttagtttgaccccaagctctacttctccccagtgtccatggatgatacgaaaccctgagatagaagagtgagcccgctaagactaggtgcctaggtattccatgttatcccaacttcttatgctaatttaataaggtgaatgtgtaagcatcctgaataaggagatgtttcaaaaaattgtcatgtaacacattttcataatttgagagctttaattttttttcttggatttttattttagcctaaagatacacaacaggcacttagtagaaaagcatcagcagtaaacatggagaaattcaagaagtttgcagcccggaaaaaatggaaagtaagattgtttgttgtggagggattaacaaattctgtttcctgtgtagagtagtgtgtggtcagggtgcatctcctctgatactggtaatatggaagatacatcctttcctctttttaatccaccctgtagtgttctgcaccattactctattttgaaaaacaagcaaaaacaatattttagtcactttaactgataccattaaatgtaattttgtgttgttttcatcaaaactattctcagtgcaaatttttatagcagcactgtaaaattatagtgaaatttttttctaatactacaagccacattttaaataaattcattctttgtggtaagcagcatgagattacatttgtgctgtaccttgggtaagtgggtctctcagcccagcctttatctgtgagtggttggagtgggggtggggtggggccgtgagcatttgcagggtggcctgttctccttcctcagtgtggatggcctccacaggggctgggtaggacattgctctgaaggcattgcagacctcctggaacaaatcacacttcagggctaagaaggtgatgggatggtttcctgtgcccagggtcatgtcaaacctagaggaagtgggtacctaccgtgtcttcccagctcagggccagaaatgtacctcgttttcacacctaccaattttggggtgccgtggtagggatgaggaagaccacagcactagattcccaaaagtccttagaattaggcttaaaatagagagagagcaaccatttctctttctcgctctcattctttaactgtacttttgccttagagagtaaatgcagagatgtttgttctatagactaagaggtcccccagctgttcacttccaacagctgttgcgttttggttatcacattgtctaccatcactgcttatgtggcacaaaggacacagagcaaggcccctgcagtctgtgcttctctgagggtgatctgcaagggtcagatcaccttctccaaacagcagagaagaaaatatagagagagaaaggatgtggggtgtccagctctgtagttcaataatgaaacatggaaggagaatctctatatcctgttgtcttgatttataagacctttaaaattattctttaagcaaatacaacccattctgctgtaggattgcccaccctgggagagtgtgtgctgatagcaatgaacacgatctcgcaggctttgtcgtttgtactcatttgacaattgttacataagctgtctctcctcctctcaccctgcctttttcctccccgccctcccttttttttttttttttttttaaaaaaaagcaatccgttcgcttgatatcactgtgccaaagattatccaggtcattcctgtccagaagtaacatgagtgttgccagaagcgatgatactctggtaagcaaacccgtgagccctggtgctccccttagcactgggtactcagaatgaccaagctgttctatttgttcaacctcccaggaacctgaagttgtggaaatggcaagcttattcttgatcccctcggaggggtttgggggtgctgattgatgcaccctcttgcttctttcctctttttttctctttgatttggatggtgctgtcccccctcatagccccatacctctaacactaccctccaccttgatgcaaacataagcacagaccacccccgcaacacacacacatacacacatgcacagcaaatgcacacacatagagacacacgcactgatattttggtaaaagagaggctagccagcagaagagaaaagagcttatcctaattttcatgaactgtagccactgacatagaagaatcttggttaacagtagcacagaaggggcagacagccgccactcccttcccacacacccacaccagagaatcagggagaatgcagtgctgcttgctgatgtgtctcctagcagaccagaaggccaaacctgcttgcatgattggcctggtgttgactgcccaaggcccttgaatgtaactccaactttcttagttttaatgtgaactttgacaaagtggcaaagatttatcaaatttgttgttcggtactctctagttatttttcctttgtaattagaaatgcatttattttccaatttctagcctttattttctttattttcccctctaatccaaactgaaacctaatcacagataagctcttcagatacgagtggaagtgtccgaattcaacaagactttcccctgacaatcaaacaacggggctttgttaagtcaggaggtgaaggggactccagacaaggcagccacggttgtcctgcgggaactaccctgcccctttaactgaatagtcagcattttcccggtggagccaagtacttcagggtgggaactgcaaacaccaagctccccttttttctccttaagttagtagcttcactgaggcttcacatctagccttgtggagtgaaatgggattggagatgtttgaaaaaaaaagcaaaagagaagcagattagggcgagaagagagagaagaggaggctttgtttgggaattgttagagggtggctgcacaaccagtgaaaagataaaaactgtgactctaggtaagataatgagaatgattaaagattgcaaattgaaatcactgaatattcaactgagagacaatacatgtgtcacagtgaaaagtttagggtaggagagggaccaagggtcttgtaggagctccaggtggaaagataccctcccagaggtcagattcccttatttccatattctaatcatggggatgagtcataacaatctgctttattccttctgttttccccatttctcttgacttgcactttcatgtaaacgcctcttagtcattgacttcaattgtgatagaaaagcattcttaaacatgcattttatacaaatattactaaaacccacatgaaaagtgtttggattcagatctatagagaagagaaagcagatggagagaaatgctttctccattctcccccacaagcagagattcagcctctgtagattaacttttccagatttgaaattccagtggtcataattctgtgtttataagttcagaaattttgtttaggatttttctagctaattccttagttttaatgtgaattttgaaagagtggcaaagatttttccagtttttgttcactactcttccagttatttttcctttgtaattagaaatgcatcagttttctgatttctagcctttattttctttatttagagcctattgttttaatttttatttttctgttttttataattgggaccagctttcagagatttttgccgtgttattctatacctagcaatggaagaaattcaagtgatcagaaaacaattctgtaattggaaaaattgcaaattgagaatatcttattcaaaggcatcatttctttgctgcaataggcttttctttttccttatccaggaagagagtctgtgttatacctaaaaattttcacagtggttttaggaactatgttttgacagattcttaagataaacacaaagggttacttatcatcattatttgaaatctggatcttggacattgtgtctctgggctatactgcaggtgatattaaagcccagataaagagtagatagtgcttgtttgcaacatggaaggggcaaaaattccttcctaggtccctccatgactgtatggatttggggagtaaatggcttactttcctctgaatgcccctgttaacaagtgagcacaggtttcttttatgttggtaagaaaagcatggctagcaatgtaactctgtttccatcttggctgtctctctcaaggatgaggaagactcctttgtgatgaaagccatcatccatgccatcaacgatgacaatgtcccaggcctgcagcaccttctgggctcattatccaactatgatgttaaccaacccaacaaggtctggttctgttctgccgcatactggaggggtgggtcacagcgaccttgcccttccatatccaaggaaagaccccatctgcttctccattctcccttccaattggaagctccatactgtggggaaaatcacttctgtttagaaagtgatttgagttacaaataaggtctttgtgcattgagggccttccttcattcacgtattgtatctctacccatgaaattttagatcttctcatcctgctaatgaaaatgtccctgatgatgagaatccaaaaggggaaggaaaggttttatacccttccacctgtcttctcttcctgccacgcagtggtagctctatgtctgttgagacaggggaaggtgtgtggtaacagcaatcatcgtttgggcttttcctttcctaccaaacctgaaaattagtaatttttttcttgcctattctagcacgggacacctccattactcattgctgctggctgtgggaatattcaaatactacagttgctcattaaaagaggctcgagaatcgatgtccaggataaggtcataattgttttattgaaatgaattgaattttaaagtattttcaagtgtctcttaatcataggggtaacagaggaaaaaaatttatgtcctaacttgtttctcagtttcctgtaaaggaagatgagctgcttttaaacagcttggtacagcctgacacatgggttaaagaggcaaacatttatcatttatcctccccttggcgctgctgcttgacatcagcatttctttgtacactacccagattttacttcttaccgatcacatttactcaacaatgttagatgtcacacatgaaaaagttttgttatctaattattctcatcagaaatttgtttgcctgcttctgcagacgtcagcagagctgtaagtggagtagatctggccctctgcagtaagggaatcctaaccagagaggggagatgagggtttacaaacataaaataattgtttataagcaattgtttattttgaaatcatttttgatttacaaaaaaaagttggaaaagtggtacagagagttccatcattcgcttcacccaggtgcccctaatgctagcatcttgtgtaaccacggtacatttgtcaaaggtgtaaaatagaatgagggttttattcctctgggaagttgctcctctggggtttgtcatcacacaggaagggaaataacagtgagtctgaggaatgcatgcatctggtgctgtcagctccctagaaatgtgaccccaggttgattttcctgcagggcgggtccaatgccgtctactgggctgctcggcatggccacgtcgataccttgaaatttctcagtgagaacaaatgccctttggatgtgaaagacaaggtaaggccacttctcttaggaggaacatgaggtggtagtaaatggatgcatgtgagtgtgagtgctggcctaccgtgtgcatcgggacccaaaggaaaggaatcaggaccagaattcacctgcagaacatttaagttggaaatgtcttgttgcctgtggtttggtctaatactgaaatcagccttaagtcaaaatctttcaggtagttgccataatacgcacgcattgaattataatccccataacataaaaacctcaaagttctagtacagacaaccagagagagacctcggtctcgattcgattttcttcctgactcaaccttgtgcttttaagcggatctcccctattctcttcttctttgaagtggctgacagtgctgacctgacaatcacagacactagaagatattaatgagacaatgcacataaagtaataaagtaaggcttttttttggcacaacggtgttataaaagttactgatttatcaagataccttgttttcatatgtgtgtgtttcattcagttcacacaacaatcctgtgaattaattggctgtgctggaacctgaacctggaattcctacctactcatccattatttattctactgtacaatacttctctgcttccagtactggcagactaatttgacgtttagtcaagctgccacatgcagttgcatgggttgtgcactgcaccatatctgaggggtaacattcatatcagagacacgcatttattatggcagttttctggaaggtggcaacactatatcttgttttgtcttcttaaaatttgtttattctgatgattttctgtggggtggatagaagtaaagtatcttaaaggatttgcacttgttactaattcacagaaagttattgcatgggcaaatagtgacattctttaaaatttctgagaaaatctctgagaatataagaaaataagtttctaatcataggcaatgaaatgagaagcttattaataaataaaattgttcatttaagtaactgctgaatgatgaacccaatagtaaaaagagagtgttgtgtttaaagagaaaatcacacagctagaagtatcagcacataaagaagactgagaacagctatcatggaaaagggagagccttctcctgagttgtttgcacttcacaggatgagccaagtatgtgggcttaatactcactgtgtggtggacaccccaacctcaggtccccatcctagccactataggggcatctgcccaaggtgggtgggtggaaccaaaggggacagagtggaaccaggcaggcctgggtgtaggccttgggttctggtctccatagcctgctcacagatgtggctctgaatcaccggctccttttcttctgcagtctggagagatggccctccacgtggcagctcgctatggccatgctgacgtggctcagttactgtgcagcttcggctcaaatcccaatatccaggacaaggtgggtcgtgactgacatcctcccttcctctgctctatacatgaatgtacaggcagccagatggtacagtcggggcctttagagttttatccaagctaggctttctgtcttcccctacagagggcaaggctcaaggggcagggactcaaacagaagtactagctaaggtgtgcaaggtgctaatgccaggatcaggtctaaccacttgattcattcatgcattcaatctgctgaacagccctatgaggtggattactgttatcattctcattttagagatgaggaaattgagacagggaaagtttctgtaactttcccaggctcacaaagctcagaagtggtagagctggggcttgaacacacacagtctggtttcagagtccacctttgtaaccaccgccgcactaggatggcctctcatcggtgcatatatgtatctagcgatgttgatcctgaagatacaggcctcacggtctataaggacttcccttgacttggttcaaagtgtggctctcctaattaccttcttgccccaagcacaaatactgttaccactcaccttgtgttgtaaacatgacagaaagctagaggcattaaggttgctggaagaattcatgctcagggaagtggttacctactgttagtagtttcagataaagtcagcgaggcacttattagaaagatgctgcaatgcacctgcacgaaggctctattgttcagacaagcagggccgatggtttcaacgggctcccgaaagtcaattgtcagtcatatgcttgagaaagccaaattcatcaaacacacaagtgttgaggaaggaaaactaatgaaagagagacatcagatctacctcttaatgctggtggctcacactcatgttgttattttattccagattaatatttcactccaatacctatgagctctttccctctgctgccttggttgcgtttctgccaaatttgacagggactctcaccttgctttatactttgtttctcattattgtgttctcctcctctctgtactcgtctccttggccaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggtgccttatgggggaagactcatatgcactgggaagtgatctaggggtctagagggaccacaagactcctcagtttgtttccctaagataacaaacttgaatgcagcaaactgtaattaccccgtctcttctctgttccaaagattctgtgaacttttctatattgtatttaatagttaatattaatttatggcatataacaaaattcatgagttgatcaattgactttggtctctaaataatttttagcttttttagctttagagcaggtacagtgatgttcactgaatccgagacaattctcattgaggactgacattggcaacacgctattaatttttagataaacaaagaaatagatgttttacttatttctatcatccgctgtgttgtaaaaagacaataaaccactcttgtctggcaatctcgatgctagaccaggtttaaataaacaaattcagcctcatctgtttttattgtgatctgtacttaaaacaagcctgtgatgttgctatatacggttagatttgggattctgtagttaatttaatatctgccctttgtgaagttattttctttgtatagagcaatggttctgggtcgggggcgactttgcccccaggggtgtttgataatgtctggggatactttctggttgtcacagctagagatgggggttgctactggcatctcgtcgatcccagccagtggtgctactaaacatcctgcagctcacagagcagccccctcgacagagaatcacccagctccaaatgccaatagcgctgaggctgagaaaccctagcacagtaggttttagaaatgtttcagaactctccacccagctcctaaaactcaacacatctattcattagggattctgtaataggtagaatgaatgcccgggctggtttttcatgggatgcagaggttacacatgttaaatctgcttctcatttatatgacagcccttgagcaagttatttcacaatactttcacatttttcctggtgcaaggtaaaataataggctctctatttaggaaattggcagagattgctgggcaaatgtttttaaaagtgttttacaaatgctttgattaaagaggccattggagtatcaacaattacttatgttctatctgattgtactgctgaagcctaaatgaatcaagctagtgttcagcttaggctgtgattatttagagaggaatatgtaaagctccgcatcctcccagtccttacccctgctataggagtaaagttttcatttaaatcctccactagggcttttagtagtgatcttgttgccaattaaacctcactcgatggcggcagaaaaggtgaagagacggaggccacatgcccaagtgaaaagctctcatgatctctggggtttgtttccaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaaggtatgcacagagaacaggatccctacagcttccaactgtgtccatccacccgattctgggtcctgattctgtgtcctctcacctgatcccaggtcctgattctgtgtcctcccacctgatcccgggtcctgattctgtgtcctcccacctgatcccgggtcctgattctgtgtcctctcacctgatcccgggtcctgattctgtgtcctcccacctgatcccgggtcctgattctgtgtcctcccacctgatcccgggtcctgattctgtgtcctcccacctgatcccgggtcctgattctgtgtcctcccacctgatcccgggtcctgattctgtgtcctcccacctgatcccgggtcctgattctgtgtcctcccacctgataccaggtcctgattctgtgtccatgcccccgatcctgggtcctgattctgtgtcctctcacctgatcccgggtcctgattctgtgttctctcacctgatcccaggtcctgattctgtgtcctcccacctgataccaggtcctgattctgtgtccatgcccccgatcctgggtcctgattctgtgtcctctcacctgatcccaggtcctgattctgtgtcctcccacctgatcccgggtcctgattctgtgtcctcccacctgatcccgggtcctgattctgtgtcctcccacctgatcccaggtcctgattctgtgtccatccccctgatcccaggtcctgattctgtgtccatccccccgatcccgggtcctgattctgtgtgctcccacctgatcccgggtcctgattctgtgttctctcacctgaacccgggtcctgattctgtgtcctcccacctgatcccaggtcctgattctgtgtccatccccccgatcccgggtcctgattctgtgtcctctcacctgatcccaggtcctgattctgtgtcctcccacctgatcccgggtcctgattctgtgtcctcccacctgatcccgggtcctgattctgtgtcctcccacctgatcccaggtcctgattctgtgtccatccccctgatcccaggtcctgattctgtgtccatccccccgatcccgggtcctgattctgtgttctgtcacctgaacccgggtcctgattctgtgtccatccccccaatcctgggtcctgattctgtgtgctcccacctgatcctggattttggccaagtttctatttgcatgtgtttgttgttgaaagtgaatattacttatatggacatgtacttttttatagcgttttgccatcttaagttgcattttacatgtgacttttgaataatttcatagataaacagaaaattattataataagtactttttgcataactcagtgtacactgatggaaatcccgtgtgtgtgtatgtatgtgtgtgtgtgtgtacatgcatgtgagcatgaggctctgtagaggaatcagagaagcatggtaaaattgtaacatctttctagagcactaagtcttcaggaaaatgtctagtgacattaagatttgatcccaggactgtatttctcttttttattttatttatttattttatttattatcattattattattttttttgagacagagtctcactcttgtcacctgggctggagtgcagtggcccaatcttggctcgctgcaacctctgcctcctgggctcaagcgattctcatgcctcagcctcctgagtagctgggattacaggctcatgccaccatgccctgctaatttttgtatttttagtagagacagggtttcaccatgttggccaggctggtctcgaactcctgacctcaagtgatctgcccgcttcagccccccaatgtgctgggtttacaggcatgagccatcacacctggccctatatttttctgcttagctttccgcattgagagttttatgggcaaaagttcctactaccgttttttgtgctaaataaatgtggtaagactaaagagatgctatcatttggtgaaaaatggagaaatgaaaataactgtgcttttaggttcataaaaaatgttgacttctagattttagccagcaccttcccttttctctgaattccatatagatgttcattaccaaacaacacagactattgcagattcctgtgattttggccctgtagctgtattaaagacaagcattatgccattacgattatgctaaaaatgaagtccaagcacaattaattttttaatttcaggaaatgtttatcaatggcatatacaatgccagtaggattctagtatggtttgttggaggtaaaaggatatctgaaacagctggaaagttatacttttatgtacacttattccttttgcatgttatgtgattaactcaagcagaaattgaaattggtaatttcacattctgagactgtgtggaagggcagtatcccaggttttagccattagctgctggttgctttcttagtttgtcccgttttaatcttgccaagtcagttgtgtaagtggcttaaggggaaagccaagtgtaatatgaagtagcatcaagaccttgggtttccatctaggattctttaaatgaatcaaaagcagcttcaagggacatctgcacttatttgactctctgtagacattcccactgtgcacccaggggtctactatgtgtgcagcatctagaatcagctctccccttgtgagaggagagaggaggagctgagcatctcatggtgctttgccctaacctcaacagggaatgtgttcttcccagtttcactccatacctaaatgtacaacttcacttgttaaatacactcttcaaaaaatccacaagacagtcccagactttcatgttttgaaaccactggcttatttactggaaaagtctcacatttttcaggctgcaaatatctataagtaaagtcgataaatgctgacataaacttgtgtaatcactgtctgtggcagagcagctgtacatagagggccttctgtagatgattttgtcattgaatgaagctcagctgatgtgaaaatcatcagttccagtttcaaccccttggaattagcagcaaaattcagacccgtaattcagagcccatctggacagaagtgtgctggttccacacaagctctgcatctctgcccccgcagacaggctccccaggttggctttgatgctcccatcatcagcacaccctgactttggggatctcacagcttcttcagaagggttgctgtcaggcttgttttgctatttttttttttaaaggaaaggtgatgggggctttagaagggcttaaaagaagcacaggtacgtaacagaaggcatcgcttcctaccaaagcacatccagctttctagagactcactcaagtaactgattgtgagcgtggggtggcatccacattctacaaggaggctgttgctctttctccattgcgtggtcttgccttttccttatctgaattaagttcctccagaaataaaaatggccattcaaatcctaccctgtcaccagtatgtgacaggacctcatggctatgtttgacgctaatgcagtgaaacagacatttctgcattcttcctccttctcatatggaaatcaggagagtggccgtttaacttgccgtgttagaaagcacggaaaggaaagggaatagatggcgcagaatgcatggcccttacccatttgtccctctttaagtcggtgcttcccataaggacagacagaaggcacgctgtgcacacgcacacatctgggaggatgagagaggactccctgcctgtcaggtgtttatcgaggcccttccagggcagcactgtgcccagcgcagagggaggaactcgtagatgccaaggtgaatggctttgccctcaggctacttttagacacactcaaattcagatgtagcagcatctcatgttgtcattgctgctgtgatgggcataaggtgctccagaaacacagaagcaacaattcagatattaaagaaatcagggaaggcttttcagagttgatcacttaagatgatcgaggctttgacagatggagaagagggaagcctgttttccaccaagggaagccagtgtgtctgccgtgggctgtcgctgacacacggcgggtgttgggtaggtatttagggagggggttatggggaagggagaaaatgaagctggagacgttgggtccaggtgtggcagacctggaatttaaggctaaggggtttggtgtcattctgtcccaacctgggcccttcaacagtggccgtttcctctgcccttttcttcatcacactctcttcctcagctttcttcccttctagaaaactgtgcattctacaaccaaaattacatctcccttacattgcatcttctaaacatttcacccagtcttcaaaactttcccttttccttctcacgtgaactctaggatgcttgaaagcttaatatctgttttctgcattactgcagaagataataataaagaaatatgaatgtatcccacactgcagcagtgtttacactagccgggaattggagctgcctagcctcccgcctcagtggctgaatgaatcatgagagccacacagtggacgcgattcaggcattcacgagaatgtgatccctcccgttacaggcatggaaaagtgttcccaatctactgttaggtggacaaagcaagggacagagtgggaggtgggctatgaccacatctcggctgtttaaattatttctctcctgttgaggattcatagataagagcttgggaggaaatggacaaaaatgttaaacagggacagctctgagctagggagcttgagagtaaggggggaggggagaaggaagatttttattttgtattatgtttttctaggttgcttggatttttaaaaagagcatgtgttaactttataacaaaaactgatatttaaaaatacatagcattaaaaaaaattcccaaactttctcagttcacaacatcctcagggtttcagtaattagttttttcatggttcccctagatcaaaagaaatccctaacagttctgttcattgagtggttcagtccaaacaacttagtaaccgcttatgtcctaacagcttagcagcagctaagaaagataatacacataaacggaaagaaaactaatattttcttttccttcttccatgaccacattacgtacaatctgatgagtgctcccgttgggcactgcacttctgaaaccttggactcagagtggacacggcctcatttcctgtccacagtgatttcctcaagactcttggttcctctcagggcagctaccaaccccccgctgtgagagacatgatgtcatggaaggcagggtggtgcagtctaatgatgacactctgcacctcttcaagcgagtagttcacctggtctcagaaccatgtttcttatcaaaaactttagatattcctgggcacccctatgaattcagtacagttccctgggttaccttggcacacaatttgggaaccataggcacaaacaaggcttatgggcttgtcctggtattttcactaattaggatgtcttcaatatctgtcttccatgtcttcttccctggctgtgtctaaatttgaactatggtgcagatcttgctggaactctggaccttgagcccttgactcctgtctctttcaggccagcacagcaggaaacttacttaagttatctttgaagttgtattttgaagctcctcttttaattgcaaagtacttggaaaggttctgcctggctggcctgccccagtggagagcaagtttcaggagaagggagatggctccttcctcctttctggtgggccctgaccccttccttaaccttgtgtctccggaatgtcatcctcagcaactgcgtgagaagaacgacctttggccttttttctctcttcccagtatgggcgaacgcctctgcaccttgcggccaacaacggaatcctagacgtggtccggtatctctgtctgatgggagccagcgttgaggcgctgaccacggtgagtgcccacagggcttcgtgaaggagggagctgctgggagcctctggcgcctccagggcaggagggacagggcttgtatggcaactctgcattctgaagcagccaggctgctgttcagccatagctcctccactgcggtaacatagacattcgcctacacatgcccagcctaatgtctccttaatgttcgtcctcttctcatctcaccacaccctgctctgccagggattccgctgcttcccgctggcctttttgtttttcatgtcacacaccagggcccctgcatggtggggtgtgtgtacttccccttcctaaatgctcctctgccccagggtgctggagcccctgccctttagaaggagctgggggaggaagaatcctcagtgggtgttgggtgcagtctccacatttaccccacaagaccaggctgccaggtgccgtaagcaggagttgcttaaagagtcaggcattgctttaggcctgtggagtattttaagtgagatttcttcagttctctcactccctgctcccgatgccagacctagcacctccctgctgaggaaaccctttgattcacatttcatgaaatacccaagaaggaaaatgcatcagctaatgaggtatggttgcaattttatggctgcagtgaaataatatcattcgagtgtttgctggcctgagagtaggctgactgtccagtctttgtgggacagtcctggactcacagatgagagctttactgacagagggtgattctctgaggagaccaagagggcctcatttcctggagatcatccagaggttagcaaaccatggcccacgggccatatcccgctgctggtctttgtaaatgaagtcttattgggacacagccatgcccaaggtttgtattggccctggcggcttccacgccaggtgtcagagctgagcagctgtgacagagaccatatgggccacagagccgaaacacctacttgcctggcccttgacggaaaatgtttgctgaccgctggggctaggatgtcgcctccccgaatgcactcatgttactgggatgtcattccctccccagaagtaataggtctgatctgtgcagtggggggcccagctctgtgctttctctgcaggcccagttattaccagtactccgcatggggtgaggcccctttctagggcacctggtcacccaccgcaaacgcacacaccatacccacatcaccctgctgtgcctgacttgctagatcttgttggccattgtcaagccctgcccagccatgcttgggcacaggttccagttactccctaatagagcatttatatgcattttcaagacgaagaaatatttttgtcctatgtgtggcctcatgaaagacccagccaggccattattgaagatgccagcagctgacgctgctgattcccgcagtgcgggttggggctgctgaaatgtgcggccccctctgtagggtccctccgtgagccgcgggcccctctgcccttgcccacgacatctgtatcagtggtccccgcctggctcctcctcaggtccctccgtgcacctccttgctctcccgcttgccaccgcaggaaaagcgtcttctgtccccaggcccctcccacggtgcccagagctaacctcagagccgcacccgcagcgctcattctgcagccccctcagtcactctgcacacaccgcacccgcagtcactccgcacacaccgggggcacagtgagagcggggagtccagagggacaagacaggcacgcgcccctcaggagacttctggaaatgggagagggatgctgacctgagagtcatagccgtcaattacagtcactgaatgggaccgcgtggtgacaggaaggagtgggtcctgagggcgtggacaggggctgggggcgcccctgcgggaggcattgctggaacctgcaggccaggccccgtcctcagccggacagagtcccgggaggatctccctgccctgttcaggaccggagctcagcggcctccagtgccctcctgcggtgggagcacaatgtctggagctggcgtggaggcccaggagatgggagggtgagcagagcttggtgggcccggccttccccgcagggaaccggggcttcctctcccgtgggcagccaggggagggttccgcagggccggggagaccctccagactggagggcattactgggggcgtcgccctcagaaacgtgaccacaccacatccctcggtttaagtttcctagcagccacatggaagaaggaaaaagaaacaggaaatgaatttcaataatatattagcacaagatatgcaaatattatcatacctgtcaataaatttattgattgatttattatttgtatatattcatagggtacaagtgcaattttctccactggtatattacactggggtgaagtcagggtcttcagtgtgtccatcactggagcaaagcacattgtacccatcaaacaaactcccatcctccacgcgcttccctccccttcacccctccaagtccccgttgtccatcattccacactcttcttccctgtgtacacatcatttagtgcccactttaagtgacagcatgtgatatttggttttctgtgtctcagttgtttcacttagcataacggcctccatttccatccatgttgctacaaaggacatgatttccttctcttttttctttattttttatttttttgtttttgtttctgttttttgagacagagtctcgctcttcgccaggctggaatgcagtgaggcaatctcggctcactgcaacctctgcctcccaggttcaagtgattctcctgcctcagcctcccaagtagctgggactacaggtgcaagccaccatgcccatttttgtatttttagtagagacggggtttcaccatgttggccaggatggtctggatctcctgaccttgtgatctgcccaccttggcctcccaaagtgctgggattacaggcgtgagccaccacgcccaggctgatttccttttcttaatggccaagtagtattccattgtgtatatataccacaatttttaagtccagtcctctgtcggtggacacttagtttgattccctacctttgctactgtgagtagtcctgcagtgaacatacaagtgcaggtatgtttttgacataatgatttattttccttcaggtagatacccagtagtagggttgctggaatgaatgggagttctatttttagtcatttgagaagttgctgtgcgtaatttctctatgttttccatagaggttgtactaatttacatacccaccaacaatgtataaaagttcccctttctctgcatcctctccaacatctgttattttttgactttttaataatggccattctgattggtgttaaggtgatactcattgtggttttaacttgcatgtctctgatgattggtgatgttgaacatgcttttcatgtttgtgggctttctgtcttcttttgaaaaatgtctcttcatgtccttagcccacttttaagtgggattattttggggtttttgttgttcttgttgagttgtttgagttcctggtacattctggatgttagttccctgtcgaatgtagagtttgcgaatattttctctcattctgcaagttgtctgttcactctgttgattatttcttttgctgtgcagaagcttttagtttaagtcctgttcgtctatttttagttatgttccgtatgcttttgaggtcttagtcatgaattatttgcctagacccatgtttagaaagttttccctgagttttccttcagtatttttataatttaagatcttccatttaagtctttaatctatcttgagttgacttctgcaaatggtgagagagaaggatacagtttcatttttctgcaaatagatatccaactttcccaacactctttattgaaaagggtgtcctttttccagtgtatgttcttatcagttttgtcagagaacagttggctgtaagcatgtggctatatgtttctgggttccctattctgttctattccattatctgtttttatgtgggtaccatgctgttttggttgctatagccatctagtgtaatttgaaattaggcaatatgatgtctccagctttgctctttttgcttaggattgctttggctatttaggaccttttgtggtttcatatgaactttagagttgttatttctaattctgtgaaaaatgaggtgagtattttgatggagattgcattgaatctgtagattgtttcaggcagtatggtcattttaacaatattaattcttcccatccgtgagcacaggatgtttttccatttgtttgtgtcatctataatttgtttcattagtgttttttagtttgccttgtagagatctttcacctccttggttaaatatattcctagttttttttttttttttttttttttttggtagctattgtaaatgggattgccttcctgatttggggctggatcgtcattggtatataggaactctaatgatttctgtatgttaattttgtattctgaaattttactgaattaatttattaactcagaattttttggtgacatcctcagggttttctagatataaaatcatatcatcagtgaacagggataatttgacttcctcttttccaatttggatgcctctattcctcttgcctagttgatctggcgaggacttccagtattcttaaattattgagatttttcacattctttggtttatacaaagctttccttctgtgccctcacagcgcatccttactccccaggtttcaagctgagtcaaggcctagggaggggcctctggtcttcctggaaggcccagcacctacgccttcctcctaccctccagaagcaattccatcctcctctccttcagaaccacccttgaccaccagcgccccctgctgccaccttccctctccgctgagtcctcagccagggggacctgaacaagtctgcacgtcctgtccccactttgtccttgcctcccctactcctgcaccctccactgtcttgccttccgttccacgtaaccctcagcagagtccccactcacctcctgacagctttccttctaaactgtcttactataaaagaaagcatagatagaaaaaagcacataaaccaatataaagcttagtgggtttccataagacaaacacctttgaattccacgcaggtcaagaatagaactttcccagccaccccaaagcccccatgaacctggcccagctgttgcctccgctcccgcccactgtgagcccctccctgatttgaagccagctcttccttttgcttccttgttatctttccacccaagccccagctgctgcccctaagcctctttcactggatatccccaggactgggcacccttggcacgccctgacaatcctgcctgggctgagaaagtccccgcgtcctgcttctccctaggcctctgcttcctgctggtccatcttctccctctccatccccctggccctctctggcccccagacttgcagctgtccaacactgaggcccatgctcaggtctctggtccctgcttgcccctgagtgccagcctcacacagcaccttcagaggccctcggcccccccacaccagggtccctccctccagttctgtgcttcctcctccccagtgttcagcctctgcaaagggcttccgcatctgtctgtcactctgcccaggatcatggaaacccttcttactctctcctcacctatttgcatctagccggcagcctactaagtctcctcccacttctccatgaccacgaagcacccgcctctccagcccccacctggttaagggcgtcacccttaaccttagtctcctccagaccagtcggactcttcacccacccctgcactgtagcctcctgccccttgggaccagtccatcccagccccacgtttatctttctagaaatgccagccactcagtgggctccactttcacctccacctggggctcctctgccttcaggatgtgaactctgcagcctctgcccagcctccccttcccctcttctccccttcagttgtggctgggtcctgggaagcccctgccggctcccccatcatggagttgtcacctgctgttctttcaccctggagctcccctttcccccttcaccccctgcgcatagtgtacccacagcatcagcacacacaggcacacatctctctgcccacttctgccctgagggtacctgatggcgctctgccttcagagagagacttggaatgcccgctacgggcatgtgggcacacagcccataacattcggggaagactccgtggcacccactcctcctcatccatcaacattcacctccagcccaggaaacctcctctgttccagcctctccggtgtgtgtgatttgcccctgtgggctggtagtcccttcgccttccttgctctattggaatcgtatccggatttctcctagcaggagtgagcccttgggcaggaatcactgggaattcattgctgcctcctaagtgggctccctgcttccacccttacctgtccacagcctggtccccacgcagccgcctggtcagacgtaagtgagatctcatcctccttgctcagatgctctagcaacttctcatgggaatcagagcccttcaaatgggggcttccccaaggatctgcccctgacattgcctccctgacccccatctcctgttccgcctcctcccgtctccctccacatcagccccatgagcttccttgatgttcttcaaaagtgctggccatccaccgcccgggggcctttgcacttgctattcttgggcctgagtggctcttccccaggtatccatgtgatttggtctctcaccttctgcaggttttgactcgagcttcaccttctcagggaggcctttctggaccaccctattttaaatcctatccctcccccacccccaggactgcccctcatctcccctgccccatttttcttcatagcacctatcaccacctgacctactgtattttactcacctatttgtttcttgttggctctccccactagattctggatcccatgaaaatagggacttttgttggttttattcactgctgtatccatagccctgtgcataatacgcactcagtaaatacctgctagatgaaagtatgaaggaaggaaggaaaaaatgaatggcaccatagtccaggcaggacatggagtgtttgttgaccgagtgctaagtagatgagcccttataattctgtaggttaacaaaaaatccatattttccccaacactatctaaagatgtttaaatgactgtgcacattctttcagatcatcttttcactggggatacacaaataggtttccctgtcaatgcttgccccagttgaaaccccatctgttcctttgcgaagcatattacacgtgtcactagaagtcatgactgtgagcatttccccagacgtcaataagcagcatgtctgtgaagggcaggctcctaaaactggctggcctgtggggctccggcttcttgaacacaataagtgaagtggcctttcacctttccatggatttctttctatgtcatggggccaacttgggaatcactgcccacagtctagaatgtagtgttgtgggctgctggtgcacaagagacaccgtgatttctggacccaactcacccttctgcagccacttggtccccagggctcacgttgagatgatggacagctgagtgctgagacacttggccatctttctatatcttttcaatgcatgcacttcattgagtccatgagccctgttggtaaggaggagggcagcaagtgtaagtgttgcttttgcagcctccgtcggggtgtccagtagagccaagaccaaaatgcagagatctgacttctgcccctttccctctcagacagaaggccaggtagttagggcaattctcagctcttctgtgaataatttccaacactgcttgcttcttctgtgcctggcactgtgctggttctttccatttggttttctctcacctgctcaagaacctgtgcagggagggtgccattttccatcttgcagatgaggaaacccaggcttgggaaggctgagtgacccaccacatagccggtgaggggtgggttcaggacttcaaactgggtcttctcccaacttcaaactgtctcctgcactgccaggcatttctgttgaaagtctgaatagtgtcctttagagcaacatgttttgcaagctgtaaagtgcagtgcaaatgtgaggaaacatttttattttatatatatatatgtttttgtttttgttttttttttttttgagatggagtctcattctgtcacccaggctggagtgcagtggcacgatcttggctcactgcaacctctgcctcccaggttcaagcgattcttatgtctcagcctcctgagtatctggaattacaggcatgcaccaccacacctggctgatttttgtatttttagtaaagacggggtttcaccatgttgggcaggctggtctcaaacttctgacctcagatgatccacccacctcagcctcccaaaatgctaggattacaggcatgagccaccatgcctggctgtgaggaagtattgttgatggtggttctcttgactttgaagaggttgaacagtggagagttcatcctgtcggtgaaaggcctctgcctgtgttttgtgcgcgtctgagctctgcaagaggaacgtcctgttcagacgtgtcgggggcaggaaacttcagtcaaggctcagatttcttctaactagggcagtggttcccaaaccttgctgcataatagaattaacctgggagcccaggatgtaccccatactgctgacagcagtgtctgtgtgggagctgggcgacaggatattttcaagttttacaggtgattccagagtgtaatggagaaccccttctctttatggacttttcttgtgtccacaaaaaaactagagcatttggcatggatccctggttggagatgcagtgtctgataaggcacctaattcacccccaaagcaagcttgaagccctggcctgcccactgggggatatttcaggaatttaaaggaacagagagacgggcagttctgactgcacagcaagcctccactggagcagccacctgggcttcaaccggcagcctaaggcagtggttctcagcaaggcaattttgcctccacccccagcaattgccaatgcctatttggttgtcacaactgggagttagggggtgctactgccacctagtgtgtagaaaccagagatgctactaaaattcctaagaggcacaagacaggcccagcaacagagaattgcctggtgcaaaatgtcagtgttggcaagattgagcaacagtgtctgaatgggaccccaggcatgactctgggagtgacttgggttgaggaattgagaggttgctgttaagtagatttcggatatccctaagcttctacaaggatgcaactttgttattgatacacattgatagataaaccaaatccttacttttttattaaaaaaaaacattcattttcatttttttaaattgcttttcatcttttctacttttgaatttttagtgatctctaaaactgcaacagaacagcccctacatgtcccttttctccccagtggcaggggaacagtgacagcttctgcctctcaggggtgacttcaaggactgaggcttgcagagagcactgagagctgggtcgagcacatattatgaggtggtgttcaataaatacttgctgtcatcgtgtatgttcatggtgtagatacagaaacaaatttattcagtgtgaaactgcagcctatgaaaaatctctaaataaaaagcaagcataaaagtgctgtggactcttatttccttgttttctgttcaccaaaagatctttcaatcaaaattgcctgtcaaactaagtatttcctttgaaatgcacagtaattaccaggagctggtatcatgcaagggctgggtttgtccctgtaaggattataacacagtagcttgcactaactagaatttggcacctaatgagaatctttactgtctgcctgattggagattggagagaggggttcaggacagggaggaaccagccagctgaggaggctgttgagttgtgattaaacctgtggacctgaaaggtgtcgctattggacaggaagacaccaacatgtgctttgttcctgcgtcttaccttcctgtcctggacaatcaagtgaaataaggattgcacagccagagaaacacaccgagacgtgctctttgtccacctggcttgcttctcacacctgctatgcttgtttctgcctcagacccacggaattggcgtatggaacacacacagctctccttttcagagaaaagaaactaatgcatttttctccaacaggacggaaagacggcagaagatcttgctagatcggaacagcacgagcacgtagcaggtctccttgcaagacttcgaaaggtgagaagttctgttataggtctgaagttctctacctgtgtttatgtgaaaaagtctcagtctttttccttatttgagaatgagcaaaatgaggctctagacagccaggttttaggaacagtggtccctgtcctgtggtttacatgtcagtcggtataaatgcatcagctccctatctgttttcttctctatttggacttggaaatcatttagcatgtttgcagttgccgtgcctggttttccttctcccactctctctataataaaccactcccacaaagtagcgggggatgaggacgctgactctgcctctttccttcttatgtttgagctccaagatggctgttaagctcctatttatcaaacattgttgctctgaggcttaaagaaacatgacaaaaataagtaaaggcaggtgcaccctttccagcctacaacatgacagttgtgtcaggagacttcacaatagccataccctttaatctaggaactctgttttatgcttaaagatgttcactgcagtattatttataatacagtaataaaaattggaaacacagataacccacgataatgtctagtaaagggtcctacagccatagaatagaatggctttggccttttaaatattttaagaagttttactaataggagtttattgcttggggtgggggggtcactgggcttcaaagcagaagacagattgtatataggtaataatctctactatgttaaaatccatagaaagaaaatgatacaagtgatgtttttcgattttgctattatactcaacattttcttctttaaacattagtgtattttaaaaaatttaattactgtattttttttaaaatgttataacaatgttacgtaatcatttttttaaaaaccacaaactatctagaaataaaatgataattcatttggtttaagtgcttgctgagaagataatgtccaaaatatgctccagatatcccacaaagttcttgccatatagaccgagaagtgcctggggagaagtgctgaggtcataaccttcacagcccctgaagtttatattttcatacatgtcctgtggtcttgccaggggcaggggggggccacagattgggataatttctttcctcatgcagaatatagacttggagagacacacttcataaatgcatattaaaaccccttggagttgacctggcaggggtaaaatcatgggtgattgattttcacacccttctgctttggattctgagaactggcctcagaggcactgagcagatgttaataaactctgagagctgcgattcagtctcccctttgtcctggaaagtccagaaagagacaagtcaggtaaaatttccctagccttactcaccttttcttaccagaaattcataaattaccattatgggctcagtgatttctcactctgtaccattatggactgtgtcattatgccagcgaatttggactagaaactcaagggaaaccttttcgtttacaggcaaaacaagcaggggcaagggagatcccgtgagtcgtggttaccattcaagaatgagccttttcatagagtttcctaagtttaaaattcactgtctttcaagcagaggaccagccaaaccagacacgttgggcacagaatctcacgcctctaggctggtgtacatccattacccaggcagcatccattgatagtgaaaggagaagagaagtctggtttttgcacaggctaaaagagcacaatttctttttcctgttagttattaggtctctattacggtccactagtaggaagaaacactattaaggaaggctgaaaggcttcttcgacaggcctcatagctttaccgagtgcataagcctgcttggtcaggtgcgctcaggtttccacacagagaggctgcaaacccacctgcagcacctggcacctggcttgcatccctgagtccccatgctgtgccctcccaggtgtatgatgccctggctcagctcacacagcgccagcacttccaccactaccgccctctggaaatccgcttaccacattcactctcaacttcgagtgctgtttaccatctaagaaactgtattacagagcaggggccagggggacctgcagtcagctcattgtgaggcggacactcagctgcagcaaggtgacctgcaacaccctgtcaggtcactcgggaaacccacctcatgcagagggaggaggcgtctcgtgggctgtgctgtgttctgctgcccatgcccccttagcaatggtcccttctttgacttaaaagtagcttactgtgcgagatgcaaacccactgtttggacgagtctgaaaacagtgaaggaatgctcagaaaaaggaccgagggagagcagtgttgcactagccggggatggtcggatcggtggtgggtggaaggtccttctcccgtcctctgtccccgttatctgcagcctgcttagatgactggcatagtgaggagtagagatgcaaagcaccttgctgcggcgcttcctccaaatcctcagtgaaaggggcttgttcccatttagaattctgagtttctgggggtgggctctcaccctgtctcagtttgggattttcttttcttctatccattggtacctttgtttttggtgcctagatttttaaaagagatgggaagtgaactattacagctataaaatacaaaatacaaaaatataaaatatattttatagtttataaaatagaaaaaactataaaatacaaaatattattttgtgttttaccattatcctgtggtctttttctctaaaggagaggtcaaggaaaagaatagtcaccttttttttctttgtttttttttgagatgaggtcttgctctgcggctcaggctggagtgcagtggcatagtcagggctcactgcagcgtcaaactcctgggctccggtgatcctcttgcctcagcctcccaagtagctaggactacaggcacgtcagacacgtgtctccacacccacctggctaatttttaacatttgtattagcaactatgtctcaatacattgcccaggctgtctctaactcctggcttttagtgatcttcctactctggcctcccaaagcagtgggattacaggcgtgagccactgcacctggtcagaatagtcatcttaatgccctaattaaaggacaacatcccccttagcacccagagtccagtgaaaagtcccccctcatctttatgtagaagcaaagtacagagtagtgcctaagagcagagactggaggtcagatggcctgggatccaactccagctccgccacgctctagctaggtgagctagcaagctgttcaacagctctgtgcctcagtgtccccgcttgtcaaatggttgagtcagctgctacctcccacgaccgtgataagggttggatgggtcgatgtagatgatgtcccttgcacactgcctgcacacagtaagcaccacgtgtttcctgttattgttggaaccccgcagaccactctggaacagctgtgaggtgcagcagtggcccctgtggctgggcaccctgagtgtcatttgtgatgacagccaccattgagcgctcagtgtgtgtggtgggcactgtgattttacaacacacagtttgtaaaggtttacagaggggaatgttgctgcaggaaacctggattcaaagaggtgagcaacatactaatcagtgcagacctgaggtcctgacctgacctggaaatacctgtgatctgcttttaatcaatgggctcggggggctccagggcagattcctggccagatgggatatgtcctttccacactggctgctgtacctgtgctgagccacctgctttgtagtgcacagggatctccttcccatggggaggcccagggttctaattccctcagaatcttctagatgctgtgttcaaggagtccctggaatttgtttgtcttcatcatccctcagtgggctcttgacgttagcccctgattagccataatgggaggagttgtctgccaagcattgctaattgcggtctttcttccttgtgtatgaatataaatccccatgcaagtaactgcttggcacctgggcacacccggtactggaatttggttattggaaatgactgagctgtcgcggcagcttccttggagaatgcatcgctgaggattgtggggagcccagaagcaggcaatgcctgtggaggacaccaggaaggggactgacctgcagttctaacttgggtcacctggaggaggagacaatcgggtacatgatcggggaggggaagggaaagaagaagtcattcaccctgcagagcatcttaggaccattttcctttccatgtcatttctccttgatattccccagtgtttctcactgggtgctgttggcagtttgggtgactgggaggccctgtccttgcaggatgtttcttgtccctggcctccaagcatctaacatgctagcattccctacagccatattgtgaaaaccaaaagaatccctccacacattttctctcaacccctagggtgctaccacactctgcaagaaccactgcaggttgatccaaagcgctgtcctggggagaggtctgtatctgggacagctgaggatggtggccctacattgcctgccattttatttggtttccaaatgggccaattgagcaaaagaaatactttctatctacgctgtcagctttcatcagttgacattgcctagcaatgtgtctttaaactatatttgctagggaagcaatgggatttggcatctggaaatagaaccaaaatcatcctgtttgcccgcagcagtggaagatgtgcaggggagagggactggctgttttgatcactggagagttcaaggggcaggagactgaagactgctgaggccaaggctacagctcttggggaagaaggaacctggggcagggctgagctgcatgggatcgactctgacgcacctccacattaagtgaactcgggcagtagtgtgcaggagcctctggtgctgtccctgagcgccgagcttgttttcccaacctggtgacatcacatgggagtcttgaaatcagccagggagggagcatttgcaccacaggaatcagcaaatgctagagatgaagtctgcttctccctaccaaaggttgttgataggttcatcattgctttgggggtccctgagagcccgcgcttggctgtaggtaccaccttatcacagagggaagttgtaccttctacttccttgcgctcagtcagtaacagagccctgggcagctgtccaaacctgcctgaggactgtgttgttgctcagccaaacccagttctccttctagaagaaaggagggaccccttctatgggaaaggggttgatctagatttttatatcagcacccatttttactataatcactgcaagttccattcttatctgattttaaaataagaatttcaagggggttgaggagttggcttatttttattttgtttggccatccttctaatcagattttccgtaagcctgaaattaaaagtaggctgggtgcggtggctcacgcctgtaatcccagcactttgggaggctgaggcaggcagatcacctgaggtcagtagttgaaaaccagcctggccaacatggtgaaaccccgtctctacaaaaaaaattaaaattaaaattaaaataaattagccagagatggtggtgtgtgcctgtagtcccagctactcgggaggctgaggcagtagaatcgcttgaacccaggaggtggaggttgcagtgcactgagatcatgccactgcattccagcctgggtgacagagtaagactctgtctcaaaaaaaaaaaaaaaaaaaaaaaagtagtttgcttttactaaacctaagacccaacagtgaagaaaggtggccaggaatattttgaaaaatgaaaacaattggggagttgcccagattgaaaaattcaccacctgtaaactgcatttgcgtaattaaaagttgctgcaccatccgtgcagtctcactgcaccctgccacatgggcaaggccacatcgcctctcagtgctcttatctggccttcccagaccgtgaatggtcttccccatcagcttgctaatgtttagtcttcttgtctgatgagaaagtgaaagctaagttgctagggagaaaacagtactggaagaaagaaaagtagaaactaggagatttaccagggcttcaaagagcaacacagttaccaaataacattcattcactcacacactgaaaagatatttccagtgtctactgtaagagctgttctaggcactgcagagaccacagtgaacaaaatcggcagaacccagccaagaaaccgataagaaaaatgtgtaagtcaggtcaaggggtggcaaacaatggcctacaacccactgcctgcttctgtaaataaagttttattgagacacagctacacactcttgtctgtgcctggtgttcctacatggcagagttgagttgccacagagaccatctggccctctacagaaagggttgctgcctcctggggtaggtgccatgcagggaattgaaacaggatgaagtgagatgagaggatggtggagtctactttcacctggctgatgaggacctctctgatgtgacactgaaaccaagacctgaagggcaagaagaaggaagcagcccgaggaagggctggaggaagacagaggaatagggagtgcaaggggccgggtagtgaagggttggaggagctcaagcataaaacaacaaagaaggagggtaactgggctagggtcagaggatgtacctgggtgtgcaggcagagaacaatgcccgacatgacccgagaggcggcacagctctatagaccttacccagcgggtgaggagtttgggtttgggccaagtgcaggcaggtgtgagatctgccttaggtttaggaattctcccggctgctcagactggagcctcagggtcaggatggggagcagagggacctgataggaggtgatcttggcagccaggggagatgtgacggtgcttggactggggctgtccaggctctattacttagtgagccttgggcaagaataccagggaggctcctactcctgtgtaaatatttaaaggatgtgattagagctaatacaggtaaatacattctaccctacacacacacacacacacacacacacacacacacacacacacacacacacacacacacacccttatgaccacctggaaggttctgagtcagaattctgcgctccttggagttcggttctgcctcctcctctccccagcctggtctcgccctgactgcaggaggtcttgcccacaccctggatgccccaggtctcctgagtaccctccagccacacccacagacctaggggacacacactggagagcacttcaaaccatgagccaaaaatgtcggtggcaccatagtcccctctcctctcccctagaggtgttggctgcacatggctcccacctggcccagccagggagggcccgaccagcctgggcttcgtgccagccaggtctcagggttgtcttgtaacttgtgttaaacacacactgtgtaaggactactgaactccccctccaaataaatcagtcttcctagcaccttctagacctggcctggagccctctctgagttggagatagatcattacgtggatgaaagctgctttcccagggagaggcctctgcgccacaacccgtccctacccgccatctggtagtgaaacgtgaaaacgtgcctccaccaatgagggagatatattcggatgtgcttagattccccaaggttcttagtgagcaggacgaggggtcatctgccaggatcagctgagattttcttgtgaagggaaatacccgaggatattttgcttttctttgcctttcaagatgatggtgaattctgtaagtctagatcagcgcagtttcctggcctctcttcccaaagacttggtgaagggtgagtgggcacatcttggccaaggctgacagctcctggtggaggggaagggggtgcaccaaggacaggtgcactccaatatttcactccaaagggtgccctattcaggaagtgccttccgagtgggatgcactgtgaggggccctccttggatggtcctcagtgctgtggggttcaccttcaatgtgcacatccctgtctgttcctgtctcctctgcttctgaggaacctgccacctccctttcagtgtccagcagtgggaggaagacctggtagtgagttctggctttgctctgtcaccttgggcaagtgccttggcctctccaagcctcaatttcctcatccgaaagggaggaggatggcattaaccacaaaggttccttggaggttttcatagggaatgtgagtgaaggcatagcatgagctggaaggcgccgtgcacgtggaagttactgctgcagacaggaaacacatctgtctcaactcctcctgctgcctcctccctccttctccatttattgtgctggcccatgaaacaggcagattgccaggagcttctgaaccagcattgccctgcgtggaatttgaaggagtgagctggactgtcagtacagggaagtcacaggcatagcttgccctcatacacaggagcaagtcagcctgcaggttcagtcgcttctagaagcctctcacaggggcagcggtgtctgtagttgaccatggttcgagtctcctgagagtggaagggcctgtgggattcctgcagaaggaatgagcttgccccattcctgcagacaggacagacgtgtgtgctgaagctcaaagtgtcaagatccacaggcacaaaacaggaagaaagagctgcaggcagattcatggcacagtttctttaccaaaatgggggcacccgggatccagtgactggatttaaccaggagcagttttctgccttcccctggtctcagatgaagcagactcgggccggtaccaagaatctctgtgtggcaggagctgcgttcagggaatagatggggaagtttgcatctaccctgtgggatgctcaccatggaaggtgaccactgctcagcacagtggacgcagctcaggtgctcatgcatggcatggtgtgggtatagccttggactcacaaggaagacccagggctgctgcggaaggctggagtaggctgggaggtggaattgctccagggtcggtggcagcgcggcagcatgggcgcacctggtgcacgtggcgctggggacaattcagagccccattccttccagcctgacaggtgccacccccaatgagtaactcctcataatagaatctgtccagcttttttgctgattcaggtaatcagtcagggacattgctatcaagacccccagtcctttcctttccctttggtgctctgtctctgaacctgttgggatttgaggtcagaagaaaacaccagagtacagaccacctcgtgttctacagatcatggtttggtgccgtggcctccaccccagctgccccagcattttacaacacaccttgtgtcacgctcccttgtagaatttatagacagggacgcacctactacacagatagtttcaaaagatcagtagcatgccctaactgtaatataacacagaccttgtgggagcatgcgcatagtgaaatatgctggatgtcagcatgcatgtgctaggacacaggcaggaggaggctgggaaacccagcaggtccctgcactcacgcacaggatcactgagtgcaacccccacagacgcccacggacactggagggctgggatggcagctccagcaccacagcagcgtgctgagctgatgtccagaaatcggagacagcactcagcaaagataaaaggaaaaaagcaaagtgtagttatttgccaatctataaaatagcagcattcgtggataactcagtatatattaaatactgcccccaaaaccctgtggatgatgtgtaaaatgtagttaagttctcagctcagatgattgtaaacaggcttttcccctatataaatgctcatcagatgctcagaagtcaggggacccaggagaattcttcgctgtgaggggcattttgttacagggtgtctggacacccagcgtctggctgcaggaatatcccctcaacattgtgggaactaaaatgccacctcagatttccacagtgcccaccaggggtcagtatagttcctgttgaggaagtctggtcctggcttaggaattgcaaatggaaataggaaaatcaaagccttcaggagagttatgtatgagattgtagcaatgcagttataacagcaaaagtaacactggcttttgctgctggaagagatcaggagatcagaagtaagtgagcgcctcccaggatttagaactgaaggaatggtcccgccaggtgtagatcacatggaggtgcccttgcgtgggtccctctgagttctgtcatttatatgacactggtttatggcgattctacacctgccagggctgggaattccgtctgtccccgcagatgggctcctggtctagaagggagagcaccccataattacaggtcgggggtcaccatggagagccacacatggtgggaagaagcaaccaggaggagatggcaggcaagacaggttttgtgggtttgtgggaacccacaaagcaggttaaagcagagggggtcctcctgggtaagggtgaggaagaggcttcaggctgcacctcacggctccaaacaggtccttgttagggagcagggcaggagtggtgggaagggatggtggcctgtgagggggtgtgacaccagggtggcatggtcagagccacatcacgtaaaccttgagcaggttcccttgggtgcactgaacgccttgcctacactatcctgttaaaagctcttacttggtattagatgtgaaattgttcacatgtctgtatctccccaagaccatggatctgggctgaatctagattttcctgttgtccgcactgcgcttagcatggggttggagggcctccctaaatgctggttgatgaatgaaggagtgagtgagtagcgaactatttcattctgtggagcctcctgcttctccatatcagatggaaaaagaagaaagtaatgaggatattgtgttcccagccccctctgcagcatggagcttgtacgttggagtgccccttctctcatcctcttgtcccattactgccctaaaggatccagacacctccacacagagagggacagatgctcttgctggtcagacagggctgatcctatttcatgattaaatcgaaggcttctacctttcttcatctcctggctttccattttctttcagcctcttaattgattagggtaaatttttgattatcctttttattttatgtgtttagtaatatattaatattttaaaatttatttatttatttatttatttatttttcttttgagacggagtctcactttgtcacccaggctggagtgcagtggcgtgatctccgctcactgcaagctccacctccgaggttcacaccattctcctgcctcagcctcccgagtagctgggactacaggctcccgccaccacgcccggctaattttttgtattttcggtagagacggggtttcaccatgttagccaggatggtctccatctcctgaccctggtgatccatgtgcctcagcctcccaaagtgctgggattacaggcgtgagccaccgcacccgatttgttgtaggtctgttcctaggcttcttaggttgtcatgtggttgaaaccaaaagtgatggtagatatttttaatactcacatacaggtgacattgccatgaagttaaatcaaaagtgctagtagctatttaacagtaagataaggttcctattccagacctacagttatgaagtggacatttgggccatccaattatgtttttctgataaatttctaaataaagtgtgggggtcacacacacacacacgcgcacacacacacacacacattgaaggcttcacagttgctccatccaacttgtcatgcatcaaaatgcaatggaaataggcagattcttagagacagaaaacatctctatggttgccaggggctgagcaaagaggggaatgaatggcaagtgactgctcacgggtacagagcttccttttgggggtgacacaaatgttctggaaggagacagcagtgatggtcctgcagcactgaaaatacactaaaagcctctgaatttcacagttgaaaatggtgactttgatgttatgtgaattttacctgaattttcaaagttttcattggagatagaaataaacataccgccaggcacggtggctcacacctgtaatcccagcactttgggaggccaaggcgggcggatcacctgaggtcgggagttcgagaccagcctaaccaacatggaaaaaccctgtctctactaaaaacacaaaattagctgggcatggtggctcatgcctgtaatcccagctactcgggaggctgaggcaggagaatcgcttgaacccagaaggcagaggttgcggtgagctgagatcgtgccattgcactccagtctgggcaacaagagtgaaactccgtctcaaaaaagaaaaaaagaaacatatcttcagcatgggtaaaaactgcacaccggggattaggaatcttgagaatcattatttgcctctttttctgtcactcactggctctttctcatccatgctcaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacaggtaggaacctccatgctggccccgtctctccagcaggtgttggcttccgcactctctcctttcaaggtctaggggggaagggagttgtgtttgggtcacttggcctatactggaccctgtggccttagtggttttcaggtccaggttggctggtagccttgtgtgtgctgcctgttgtccagcagtaacagactgacttggcagtagcaaaacaagggcctcactgaaatcacagccacagacacaaaggtccatcctcataaatgtgcaaactgcagaatttgcacagtcagctttggggacacagttgcaaattgcattgcattctactcagggctctggccttagagacaaaaagagctcaaactcaaacagtccaagcatagcacagatccaatagcagcccaagaagggtcctcaacccttatccttctttctggagtgctacaggcagacccagtattgtagatacatagagcaacaaaaagggatttccaggaagcaccatcctgctcagttcaaggttggatagaggtttccagaggctccttagtggttttcagggatggtctctctggtcacatccaccctccttgggaacgtttgctgccttccgggccttccacagacagggttattgattcacattagggggctgtcacgaaacacctggcagtgagcaagagaaaatgatgcaatcttgggtgtgattccaactgaatcctcctttagacagagcgagtgagtttgtggaaagataagagaccttccaagagtttcctaaaccaggacagttttgtgctttgtgccttgattcattctctgtatatgatgtcacagaagagccaggtctgttccccaggttgatgctaaagtttgtgtttctcttacgtcccctcagtgagggaggacgctggggagcatgggtagctgcggagagttggctgagatttatattcccttttcaacttctgttctctgaacacagctatagaattgaaatgaggagaagaaagaataaccaaaacagagttataattcatattattatattgctgatacatatgtcaatatttatagagtactgtgtgccaggaactggaagaaatatggtctgaaggacgcctcatttaatccaagtgacagcttccgaggtgtttttaccgctatttccctgcagccttgaggggtcagttggcttctctgaggcgcacaggtggcaaatcccagaacatctggtgcctgagccagtgcttgtcaataacaccctgcataaggaattcacaggcacacctttccattttccagtgtgatttttttgttttttgtctttgcatattaagttaaatgttattacaaaagagtcaaaactttaaaaaatttaaaagtagataatggaaaaaatgtgacagaaggttaagattaatttattattaaagaaaaaaatttattttatttatttttttttttttttgagatggagtctcgctctgttgcccaggctggagtgcagtggtgtgatctcggctcactgcaacctccgcctcctgggttcaagtgattctcctgcctcagcctcccaggtggctgggactacaggtgcatgccaccacaccaggctaacttttgtatttttagtagagacgaggtttcaccatattggccaggctggtctcagactcctgaccttgtgatccacctgcctcggcctcccaaagtgctgggattacaggcgtgagccaccgcacctggcctccagtgtgatttctgctctagttgaggatttaagtggggttcagttgctcccttagagggaggcagcacgctcctgctgtggttaagggcactgcagcctgaacctctgtggttaggagggtgggatatgagagagagagagaggtcatgagctcatgatctggaaagtttgcaaggcctaagtgggtgtgcagatgatgcccaggagcccccattgtggagtcctgggagtcacctgtggctctgcccttggcctcagaggtgaggtatccatggccttgcttctcctcagtatctgtgtctggtctttgcagcaggttcctggtgaagggtggctctgggtgaccctttttctgcacgccccaccatggggggagcatctttagccagggatcggggagggggtcctggcgcgggggcagaagcccctctgcatgagagccctaaggtgcaggcacaccagctgctttcagcccagccgtggggtctggggaggaggcagctgtcctggtccctgggcccccacagtcagtgccgcctgcccctggtggaggaagtgtgcgctggtggttgcccctgaagcctggtggctgagggatccctgggcaggaggcatagctcggcagctggacttggaggtggatgagacagacaagatgcccccatccctggactgggcgggtcaccaggcacttgctgccctcacagcttgtacatcagcatcagacagcgcccgggaaatgcagagcagggcacaagcacagggcaccgcgagggcggcctggggagattggactttggcagagggtatgtgtgttgggggccaacggagcagcgtggctttgttagacacccgaggaactgccgctcctgagcatgcctccagggactgggcctggttcctgaagcagcaacactgtcacctgccagggggcactgctcgtgcctggcaggccgtgctggggtctctttcaggccagggctctggacaccagtgacctctcctagaattgtcaggcccttttcccttcaatgagagagatgcctacatggcaacatttatatcatcagacagcaagaagtttgcttttagaattttggcccttttccactgccgttctcttgagaacgctggaggccaaggctgagctcccagccaggagaccggacggggtcccctcgaagttttctgttgcacacatcactcagctgtggggacactgagggttgtggctgttgagctgtgggaaggaaaacatccaaggtcataggaggcatgaatgtccaggaagagtatttgaagaagccattcctgttcccgcggagaggagcctgcgggaggaattcccggtgaccaggtaaagtgggtctcctgggagccgtcacgttacaccgccagggggcagtagctaacaaaaatgatttcctgggatttcggtgcttccccatgaaattattgttttcataacaccttgtacaaagcctgtcctaaccttttatcctcccaacgaaaactgtcaccgaggagcaggaatgactgccatttaccaacgtctgctctcattaagcacagggccacatgccactaaaagaaggcttgttcctgacaggcaggcacccagacacaaattccaggtcacagggaagtggacagacccattcttgggcaacccagcagcttttgcaggctgggattaacaatatgcagagaaatacactaaaatggcagctatgttgacatcaagacttacatcattttgcttttgttttctatttacattcctatctgccaactttcctacagaaatagaatatgtgttggtgtttttaagaataaatcttgccctcctagtgccctttctcctttccctgtacctaatcctgcccttaggatccacttttcttctcctcatcccctccgttggatacccccattatccatgtccaaagtcttaactctttggtctttaagtaagggattaccttggtgtttggatcgcctgttttaaagtcagatacccaggtgaaatggtcacttctttagtgcctcgcaatgtctattgtattaatggtaaaccaatggtactgcagttaagatcaatgaatcccttctccaatgcaattcgttcaccaagttcttacagagcactctctgtgggccctgggtcacagccctgaccagaaaggcagcttctgcctgcacaagcctggtgggagagacggggagcagggcaggccagtgagtaactgagacagtgaggaagcacaggctctatgcctaaacgcaggggacccagactctgttattcagctcccgtacaacacccacaagttcaccattgtttacataatgtttcctttaaactgactcactttttaaaatgtactaaaatacattgatttgaaaatgaaagttaatatccctatcataaatgggaacccagtgtcactgccataagtaaaaataaatgcagtgaacagcaaccaatgtgaataaaatcccgctaaacgccaatgcccacaccctcttcattaaaagggaagatgagcaggtgttgaggaaatgctaaaatcggaaggcctcaagtggagactcgctgcaagaacaactgaaaggccttcaagggaatttcaaaaaggagtagctttcacagtgtgtgattcagcattatttaatgctatggcctgctactgtctgaaatcattttccatttaacctgcaataataatctcatgtgcaagagagagaagtcgctcagtgggagctggaggaagacagagactgcgagtatcagcaaagtagcaggaagtgagaagggaagaaacccgacctctgccctcccaccctctccacagcctcccgttggctgaccctaagcagaaatcacatggcaagccagcctagagacacaatccctaggaccagccacccgggcaacagggcggggcagaaaaggttgtggggaggtagagcaagcggaaaagcccacagccttgctgggaacactgctgccctgcacgtgtgagggcagacacactcagcctgaagccagagttggggtggggacagaggcgtgctccagaaaaggaaacctcagggccagcctgggagggagacaggcacacgctgcccccatcgagtactcatgtgatcctttccatcctgcagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggtatgccctgcctgccccaagggaaggacctcaggtttcccttcaacagggttgtaagtcatccctaaagggagcttgtcctgagctgtatctgtcacttccagaaggaaatccaacacagactgatattcagagtgagccaggactgaagcatggctggctaccatccctaaacagtgaaattaaacactggggtattgtcagcgcctagtaaagcacttggcatacagtaagtgcttgataaatgactgtggagtaaattaataatatttgtacatatttatggggtacgtgtgatatttcattgcgtgtatagaatgtgtatgtaatgatcaagtcacattatgtgaggtgtccgtcactttgagtttttatcatttctatgtgttgggaacatttcaagtcctctcttctagctattttgaaaaatacaacgcattgttaactatagtcaccctattctgctattgaacactggaatgtatttcttctatctaactgcatgtttgtacccattaaccaacctatcttcattcccctctccacacacacacacagccttcccagtctctggtatctatcattctactccctacctccataaaatcaacttttttagctcccacatgtgaatgagaacatgcagtatttatctttctgtgcctgggttatttgacttaacataatgacctccagttctatccatgttgctgcaaatgatgtgatttcattctgttttatgtctgtgcataaatagtgttctgttatgtgtataccacgttttctttattcatttgttccttgatggacacttaggtcaattccgtatctttgctattgtgaatagtgctgaagtaaacatgggcgtgcacgtatccctttgatatactgatttcctttcctttggaaaaatgcacagtagtggaattactagatcatatgttagctcaatttttagtctttttgagaaatctccatgctattttccataataactgtactaatttatatttctaccaacagtatataagaattctcttttctctgcatcattgccagcttctgctattttttttttgtctttttaataatagccattctgattggtgtaagagggtgtctcactgtggttttgatttgcatttcttggatgattagtgatattgaacatttttctcatttacctgttggccatttgtatgtcttcttttaagaaatttctatgcaggttcttgctcatttttgttttcctttctttttcaacttgtattttagattcaggggtccctgtgcagatttgttacctggtcatattgcatgatgctgaggtttagggtacaaatgatccctccctcccaccccctctagtagtccccagttactattgttgccatctttacatccatgagtaccgaatgtttagtacccccttataagtgagaacatgccatatttggttttctgttcctgtgttaattcacttaggataatagcctccagctccattcatgttgctgcaaaggacatgattttcttcttttttatggcttcatagtatttcatgatgtatatgtatcatattgtctttatccagtctgccattgatgggcgcctaggttgactccgtgtcgttgctgttgtgaatagtgctgcaatgaacatactagtgcatgtgtctttttggtggaacaatttgtttcctttcggatatatacccagaaatgggattgctgggtcaaacagtagttttaagttctttgagaaatctccaaacttctttccacagtggctgaacttatttacattcccacaacgtataggtgttctcttttcttcacgccctcaccagcatctcttgtttttttgtctttttagtaatagccattctgattggtgtgaaatggtatctcattgtggttttgatttgcatttctctgatgattagtgatgttgagctttttttcatatgtctgttggctacttgtatgtcttcttttgagaagtgtctgttcgtgtcctttgcccactttttaatggggttatttggtttttacttgttcaactctttaagttccttatagattctggatcttagattatgcctttttggatgcatagtttgtgaatatttcctcccattctgtaggttgtctgtttactctgttgacaatttcttttactgttcagaagctctttaattaggtcctacctgtcaatttttgtttttgttggcaattgtttttgaggacttagttataaattcttccccaaggtcagtatccaaaatggtgtttcctagattttcttctaggattcttatagttttgaggttttacatttacagctttaatttatcttgaattttttttttatatggtgaaaggtgggaatccagtttcattcttctgcatgtggcttaccagctatcccagcgccattgattgaatagggagtcctttctccattacttatttttgtcaactttgtcgcagattgggtggctgtaggtgtgcagctttatttctgggttatctattctgttccactggtctatgtgtctgtttttgtaccagtaccatgctgttttggttactgtagacctttgcccactttttgatgggattgtttgttattttactgttcagctgtttgagttccttgtatattctggatattaatcccttgtcacataaatagtttgcaaaatatctcccattctacaaattgtctcttcactctgttaattgtttcctttgctgtgcaaaaactgtttagtttaatacactctaagttgtctatttttgtttttattacctgtgcttttgaggttttatccacaatatctttgtaggaccaatgtcctgaagcctgtcctcttctactggttttataatttagggtatacatttaagtctttaatccatcttgagttgatttttgaatatggtgagagacaggggtccagtttcattcttctgcatatggatattctgttttcccagcagcgtttatttacaagggtgttcttttccccagtatgtgttcttattgcctctgtcaagttatttggctatgaatacctggatttatttctgagttttctattctgttccattggtctatgtgtctgtttttatatcaataccatgctgttttggttactatagccttgcagtgtattttgaagtcaagtagtgagatgcctctagctttgttctttacactcaggattgctttggctgtttggccactgttttgtttccatacaaattttccgattgtcttttctatttctgtgaaaaatgacattggtattttgatagggattgcattgaatctgtagattgccttgagtagtatgagcattttcacaatgttgattcttccaatatatgaccacagcatgtatttgcatttgtttgtgtcctctcagtgtctttcgtctgtgttttgtgcttttccttgtaggggtctttcacctctttggttaaatttattcctgagtattttatttttattgcagctattgtaaatggaaatgccctcttgatttctttctcagctagttcatttttgatgtatagaaaggctactgatttttgtaggttgattttgtatcctgcaactttacctatttaatatgaatttatttctcagatctaagagttttttggtggagtctttaggtttctgtagttataagaccatatcacttgcaaagagggacaatttgggtttctcttttctagtttatatgctttttatttctttccctttgcctgattgttctggctaagaattccagtactgtgttggataggagtgatgtagggggcattcttgtcttatttcagatcttaaaggaaaagcattcagcttttctctattcagtatgatgtcagctatgggttcatcatgtatgacctttattatgttgaggtatgggttcgtcatgtatggcctttattatgttgagatatgttccttctatacctagtttgttgacagcttttatcatgaagggatgttgaattttgtcaaatgctttttcggcatctgttgagattatgatatggcttttgttctttctgttgatgtggtgtattatgtcaactcatccttgcatccctgattgtggtgtatcatcttttttgtgtgctgttggatttggtttactagtatattgtgaggatttttgcatctgtgtttatcagggatcttggcctataatgatgatgatgttgttgttgttgtttttacattcttttctggttttgttatcatggcaatgctggtttcatggaataaattaaggagaactcctgccccttcagttttttttggaatagattgaggagaatcattagttcttctgacatccaaacctggacttctctttttggggaggctttttaataccagttcaatctcattactcattattggtctgctctagttttctatttctttctgattcaatctttgtaaattatctgtctaggaatttatccatttcctctagattttccagttagcgtatagttgttcataataacctctgatgatctttggtatttttgtggcatcagttgtaataccttacttttcatttctcattttgttcttttgggtcttctctctttttttctaggtcagtctagcaaatggtttagcaattttgtttatattataaaagaacaatttttcatttcatcagttctttgtatttttttagtatctgttttgtttagttcttctctgacctttattatttcttttctcctgctaaattgtggtttggcttgtttttgcttctctagttctttgaggtgcatcattcgattgtttatttgaaacgtttctgattttttgacgtaggtgtttattgttataaacttccttcttagcattgctttggctgtaggttttggtcttgtgctttgattttcatttgtttcaagaatttttttaaatttctcccctaatttctttcttgaccctgtggtcattcaggagcatgttgtttactttccatgtatttgtacagtttccaaagttcctcttgttatcaatttctagttttactgcactgtggtttgaggagatacttgatatgatttcaattttttttacatttgttgagacttttcatgtgtcctgatatatgttctatcctggagaatgttctgtgtgctgatgagaaaatgcgtattctgtagctgttggataaaatgttctgtaaatgtccgttaggtccacttggtctaacaggcagtttaaattcagtgtttctttgttaattttctgtctgtataatctgcctaatgctgaaagtggggtgttgaattccccaaatattgttgtattgaagtctatctgttcctatagatctaataatatttgctgtaaatatctgcatgctctggtgatggatacatatatgtttagaactgttatatcttcttgctgaattgatcccttttgcattatataatgaccttctttttttttttttgacttaaagtctgttttatctgatataagtacagcaactttcgctcacttttggtttccattttcatggaatatctttttgtatccctttactttcaatctatatgtatctttatagataaaatggatttcttgtcagcagcatatagttgggccatgttttattagtcaaacagccagtctgtatcttttaggtggaaaagttaattcatatacattcaaggttattgttaatatgtgagggtttattcctgtcattttattaattggttttttgttgtttcatatattctttattcctttctccttcattatcattgtggtttggtggctttctgtagttgtaatatttgagtcctttctcttccttaatatgtttcctctaccagtggatttatgctttcgtgtgttttcatgatgaaagaattgtcctttcacttccaggtgtagaactcctttaagcattgtttatagatttgatctagtgatgatcacttcccccagcttgtcttgtttttggggaagactttatttctccttcacttatgaagcataactttgctgtctgtagtatccttggctgacaatttccttctttcagttctttgaatatagcatttcattctctcctggccagtagaatttctgctgagaaatctgctgtgagtctgacgggcgttcccttgtaagtgactagacttttttttttttttttttttttttttttttttttttttctgttttcagacttccctttgtctttgacttttgacaattggactataatgtgccatggagaggaccttttttcgattgtatctgtttggagatctctacagcttcctgcatctggatttccaaatcttttgccaaacctggaaagtttttaacaattattttaataaatagattttttatctccttcagtttctctttacctttgggacaccaaaaacttgaatatttgattgctttatggtgtcccatatgtcacaagagttttgtttatttttttatttttatttttttaatgttgtctgattgggttattacaaaagacctgtcttcaatttctgaaattcttccttctgcttgatctagtctattgttgcagcttttgaataaattttctgttttattcaagaagttcttcaattctagaatttctattttgattctttggtaaacttctcataatattctgagttgtttttctgatatctttgtattgtttttctggattctcttgtacctcactgaacttgtttaatgtcatgattctgagtactttttttagattgcataggtttatttttcattagaatctgttgctggagagttattgtgctctttcggaggtgcaatatttccttgctttttcatgtttcttgtgtccttacattgatatctgtgcatccggtataatagtcacttctttgaactttttgaacttgctttcataggggagggcattttcctgaagatgtgtctatggtgttggttgagtagggcactttggctttgattctgggtgcatgcagtagcatagtggccatacgattttttttcagctgtaagcagctccagtggtgcctgtaattttctcagtggcttagggtatggttgttagtggaggctgtggtaaagtttttctggagatggggataccacgtgggccagtcctcagaacctagtggtggcagtggtgggctgagcatgcctgtccttgggccccagggtggtatatgctggtactgatactagtgggtccaggtaggttgattcttgggcctccaggcagcttgctcaagtgctggtagtagtagcagtgggccaggtgggtagtcaggttctcagttccctgggcagcaggcgtggtgtgagtgatggcagtagtcataatgagacagccctctggctcccaagcaatctgtgctgatgttggcagtggctgcaatgggctaggcaggccagtacctagccctgcaggtggcatatacaggtgagtgccagctgtgatgatagtggtaggttggatgggcgtgacctcaggccactaagaggagtgctcaggtgccagtggtggtggactgggctaggtgatccccaggtccccagacagcatattcaggctcttaggggattgtgaagtcaagctcagcaggcctgtcgtcaggtcccctggtggtgcatgtgatccccagcctctggcaaaatgcttgagtcagggaggcagtggctgcactgtggctctgctactgggaagagtggtcctgctttcactgtcagcagccatatgcggccagctggggagtgtatgatttgcacatactttagactcagtggacacagcagcagtggctgcagacaggggattctgtccttggggcagatgaaaatgcacagccactactctgctagggacagtggggtctctgtcaatgggttatgcctagaccttggtggcagctgccagccaaggtggtggctgcaggcagagatgtcagtggggctctagggatatagagatgccaaggccattgggctacagagcaggatgcagtctacgggtgtttggaacatacaaatggtgccgcactgtagctgcttcggactcagagagtgcgtgggagccagcctgagctccctctctggagcaatactgtcatgcagtctccaggcagctccctcagctaatctcagggcccacatgggtgaagggtccccctgcaccaggggcaaaaattgcgggagttcatggtctgtgtgcattttgctctcttaaaagttgggcttcctctgagctccccagagcagagctggctgtggcagcacagagagaagagaaacttgtcttgggaccccaggccctgctcccatctgatctctcacagccccagccgcaacccacctcaggaccccacactccaagagccaatttctgggtaccagaactttccatgcttggcctaagcagccagctttggagggtggtccctcctgcttcactacaagtctgagaaaaaccctttagatctcagagtgcatcttgactgcaggattttgggtacagagtaagcactgaggggtaaacgaggtgaagggagccttcaaatcctgtaatggaagtggccctggccaggccgccccagaggccagtggtgggcggccacagtcctggcaggatgtggcagtgtagagagggggcatctcaggtccactggaggttccgggagtcctgggagctccaggtggaatctaatctgcagatatttctggggaaatgggcagccttcacagctccagtatgggaaagcaattgcccccacatacaacctttgacccctgcttgacactttcctgcctgaaggaccccacctcctcccagatccaagcacctcctgtgtaggcagaactgctgagctctgcatctcacacccctgcatgcttcttgcttcttctgagcagcctggacagggccctcagtcacctggccaagtcagtccctgttgagccaaattcaggtgacttttcatagtcactgttacattcaatatcctataccctggcacgttccaaaattcatgtatatttattcaggacacaaaatcttttcacccaccttctctcaattaatcctctatgggactttgtgagtttgggaatcacaaacctaatgtgggcagtttgtccccggctccttccttgtcaggagtaaattctgcaagtgaaggtggagtgtctgtattaaggatatgtgagcctacaaccgtgtcattattattatggatgtggtgttcacacttctgcgtaatatgacctgatggatctttgttttttccccaggtggttctctcttttttttaatacaccaatatttgagggggagtaatacaaaatatatatgtatacagacacacacacacacacatttccatgtaagcacccaggcatgcacatatatgtgtacatgcatgttgtgtgtgtgtagcactccagggtattagaagtagtcatgatatagatacatatatacacacacataataatgaaggtacttagggaaagagttaagcaggtgcagacataagtagaaaaacagacatggatatacatgctgtagatatgtacgcgtgacacaagtcgatctgcacgtcagtagatgtgtgtcttcgttcattttgtgttgctataacagaatacttgagacagggtaattgataagaaaagcggttcatttagctcatggctctgcagactgggaagttcaaggggcgtggcaccagcatctgctttgattctggtgagagcttttgagctgggtctaaatgtgacagaaggtcaaagggtaagtggacacacgggaagggacaaaaacctgctttacatcaatccacgttctcaggacctaatccattcccatgagaactaatccactctcacaagagcaagaacacactcactcactcactcactccctcccaccagcaccaagccatttgggagggatttgcacttaggacccaaacacctcccaccaggcctcacctcccacatcacctcactgagtgatttcaatatgagttttagtggggaacaaaccatacccaagtcataacaagatgtatacacatacagaagaatgccataagtatcactatgcctacttcgaatccgtggaacgctaagagaatttatgattgaaatttggttagtggtgtttcacgattgttatcatttttctttttctgtaggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccataggtgagctaagtccctgcaggccagtgatgtcctacctgtggttggccaggaatcgcctcctccttccaggcttctgccctgctcctgccactgctgctgctggccttgcaccaggccatgagcagatcccaccgtttgtggctaacagctgagccaacttcctttctccttcctgctgggagacttccactctgagaagcttcatgaggctcaagtgttcgtggtattctgcaggctgtttttgtttcatgattgcatattcctgcctcaaaggcccactttgaacaatcctttgagaggcatttctcactttttttctacacttgagagccatggtcattgtatgttgggtgcaaaatggaatccctgcttggatagctactgcacctttacctaaagggtacagaattagtcagcagaatgagcagttcttcatcctgtaattccactaagaaacaaagaaagaggccgggtgcagtggttcacggctgtaatcctagcactgtgggaagccaaggtgggcagatgccttgagctcaggagttcaagaccagcctggcccacatggcaaaacctcatctctacaaaacatacaaaaacttaggcaggtgtggtggcatgtgcctgtagtcccagctacttcaggggctgaggcaggaggattgcttgaacctgggaggctgtggctgcagtgagccaagatcgtgccactgcacttagcctgggtgacacagtgagaccctgtctcaaaaaaaaagagagagaaatgaagaaagggagcatgttgactgaatgtgttatcttaactttattcctagaggagaggataacatgaaataaacttcctttggtctttgcccacaacaagagaagcagccttccctggtgaaatgcaatactcagcagtcaattttttttctttccggaaaagcatataatacaaggagttgggcttaatgcccctctgggtactgccagttttgcctctttctttgtcctttttttcctttgttttaaacactccccgaagtgggaggctctttgtgtgacttgcaggtcatttacctctgacccatctctgtggtgttgctgcactcaggcgtctctctttggtcttgtaagcggcatcccttttgtcacaggttaaattttccctctccttgtaagtaggggctatttggagacttgagaaactgcctttagtcattctggtccactttgagcaattttccttgtggcctaggagataggcttatcctgtcgttggccatgctggggccttctagggtcacagtgcacagcaggcgtggggccttcatctctgtggcatgttgcacttgtacctggagagtcggcctgggcatgaggccaacacaccgccctcacctgggcaggagaggcagccaggtaggaggacccaccccctgaagcagttccctctctgcccccagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtgaggggcagccacttagtctccagctcacgggtagcctcctctccctgagaactgaagcagaggtgtgaaaagtacaaaggaagtctcatgaaccagagaaaggttttaaaggtctttctttcttggtcaactcttttcttgtacaggtcttgtatcccttattggaaatgatcggctttagaagtgtttctgatttcttatttgtttggattttaatatatgtacatatacatagcagttgaacatcctagttcaaaaattctaaatctgaaatgctctaataaccatttcctttgcatgtcttgtctttgcccaaaaggtttttggattttggaacatttcagatttctggattagggatgcacaacctttatttttcatttttattaaaacaatgaatccacatagtaaatcaaatacaaatgaagagcacgtgatgaaagcaacccccttctttctacctcccagcaacactgcccggaggtgacttcttttagctgtttagatttcagtactcagtattcagtgttcagaaacactaatcagtatgtcttacaatataagttgcaacctactagtgagtcttaaaattcatttaggaagtcgtggccaattctttttaaaatgggatggaatggaatgggataggataggacaggaaaggacaggacaggataggatagatcagatgtcaagtattattttgtaaaacgtttgtttcactgatgagtatgggtatgtacaggattatgatgtaaaatatatgtttttactcagagtctatcaaaacagtttgaacctgcagctttctataatatgctagtatctctgatcttgcattatcaacttgagacatttatctattgtcttgagacactatatctgttgccagatataaaaatggggcttctattaatatttttaggtcagtgatgtagcttttgcattcacacctctattcttagtccctccactttccacagtatctcttgtcctcacttgtaaggtgcgagcattaggcctcacctttcctgcctcgggagaagctgacatctttccatgctgtgctcctgctgcttcatgcaaacctgaaggtcccgctcctatgactcagactatatgccagtttccccaagtctctgcacccactgtgatgaggcagagcccaccaacagcagggatggggaggggcctttgcaaggacaccagaactttccttccctcctaccagcctcttgagccagtaggagcctggcccctccattaaaaggcctggggacattgactcactgctgaggaggctgctgctcttcccttaggtttggaaatgatcttcacatttcaaataagctgtttgttctggatgctggggcttctgggtcaaaggacatgaaggtacttcgaaatcatctgcaagaaatacgaagccagattgtttcggtaagtacaccatggaaagagcctggacccctttgtacttccttcctggtttgcctctggtttcagggaactgcttcatagtaggacccagtaagaggtgtctgcctggacatgtctttatcctagtgccctgagaaaagaaaggaagaatagagaaacaaggagatgatgggagctgaagggttattatgggcaaggtggaccacttcaattttatgaaattcttaccgatttattggtttctttaacaatattttacttatttattttattttttcagagacaggatctcacactgtcatccaggctggagtacagtggtgtgatcatagctcaccgtaaccttgaactccagggctcaagcaatctgtccatctcagcctcccaagtagctaggactataggcacgcaccaccatgtctggctaatttttttgattttttggtagagacagggtcttactatgttgcccaggctggtctcgaactcctaggctcaggtgctcctcccacctcagcctcccaaagtgctgagattacaggtgtgagccaccatgcctggccaattttgggaaaaaaccaaaaaattcaaaagtgacttattgtggaatatttagaaaattcagaaaagtagaaaaacagtcacaaacttttttgaaagacagaaaagaataaatgaacaaagggaatgagactgtattcttgggttgcaagatatgactattttatttttccctagttatataaatgtaatacaatttcagttagcatctgaatgggttgaggggattgggatttttatcttaaaatttccatggaaaaattcattaaacctattataaagcccctgataatcaatacagttaaataggaggaaaagcttagagggtatagaagtaaatcataatatctttagaaatataatggaaaataaatatgtcatttgaatttaatggggtaaagattatttaataaatgaacctggcacaactggctatttgtctggaaggaaataaagttggattcctacaccctacaaagtccaaaaataaatggattaaagcttttaagtaaaaacatgaaacaataaataccttgaatagaaattgtggagagtgtattttcaaaataactagggactgagggaacctgttaaaccaagatctaaaaccctagaaattttaaaagaaaatatacctgtttgaaaatgtaaaaatttttaaaatttttttctagcaaacaaattaagtaaacaaagttgaaaggtgaaataggctgggaaaaagcattctcaatgctttggacagataaatggtcacaccgtaatgttcaaaaagctctccggaattggtaagaaaagggcgagcgtcccagtggagaagtggtggcattcactctggagtcttcctgctgccgaggcctgaggacaaatgcgggcagatgcctgtctccctctcttacctttgaagctgcctctgggtgtattttttttttttttttttaactgctttgctaataagaaaatgctgtgcttcccgcaccagattctggttctagatgtgcttccagaattctcgggaaaccctttcctgtctccagaaaaccctgcccttcacaccagatatcctcgttggggtcccactgtggcatcatcagaagatagggggtagtccggtgaggcctgggaggaatctgtcacagaaaccaggggcggtgatctgggaactaacagtggtctctgagggcccctgtgcttccccaccaggtctggattgaggctgcattcctgaggcaggagggagtgtccctggagatttttgagctgggctctggcatgatctgctgcttctcagacaccccccgcccaacccctaaactcctgagctcaggcaggtggagcccaccacatcaactgcactcacccctgagaattttgtttttgaatgcagagtggaatttagctgacacaaaagaatttgagaggggagtgcggaattaatggcacggtgtagcctgtggcttatgtggtttctaattcagaggtatgtggattacgtgagtctgtaacatatgctgatctaattaaccaagttaaaaggttaaaaatccacttcagcctacataccaagaatgggtctaattggaaacaatatttcaacaacagtccccacgaatgcctaatttactggtaaacactcactctaatattgatgatgatactcattctcttttcctctgttcataaagtgatcattgcctgagtgaaacagtcacgagagagagagcgagggaagaaaggagggagggaggaaaaagtgagggagtgaaacattaggagttggtgaacattagttgattgagtgactgagtccacaattccaaaaacgttcctagaagactcaaaatctatttaacatgaactaaagagcctttataaaactttatatttgagcaatagatgaggcttaaaagcaagtctaaaagacaactgccccagtactcaacccaaaaaacacaaactagccagacacagtggtgtgtacttgtagtcggagctactcaggagactgagacaagaggattacttgagcccaagggtttgagaccagcctgggcaatagcgagacccagtctaaaaaaagaaaaaaaaacgtcaacaacaacaaaaaaacccactcgttcatcaaatcacctgcaaggcgcctgaatgaaaggtgtcctttccactgtggctctgctcagggcacccacagctgcaggtgagttaacctgtctggccctgccccctctaggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgaggtgagcccctgggagcccaggcagggggccgtgagaggtgccagggactcagcctgtcccaaattccagctcttggaagtggtgtgagcctggggaagcagtgtggaaatggtccagctaacctacaacatttccacacgtgtgacaaacacagcctcaagtgacgctctgaactgcagttctcggctcaccttaggagctgtcattttgtcttgtcgtgttttgcttttatttccagagtctgttagtttgggagtgcagtgcccactgccctgggtgactgggtctctcttcactccccctgggcaccaggaacttaatctgctactcctggcagccttcaggatggcttctttgtatcagcgtggagtcatcagctccacacagatctcctgggtgggaaaacagttgagaaaaggcagtgaggtgtccttgtggaggcaatgtctggagatacaaagacagagaactctggtgcacagatacacagagtaatcataattaaagatgcacattaaaaaactctagcaagcaatgcccagcagaaatgattgagaatgggaggctttgctctggttctgtgacattgagcaccagggcgcggtttggaaaccctgttctaatggcatcatatgcctgtcccaggaacgggggcagtgccttcgtgtttctccaccatgtgaaattgggagcctacatgaactagtgtgggccaagaagagcggttctgaatattgcaactaaaagcagctctgagattattaaaagccagatgcttacctccccaatctcaggtgccaggtctggccctatagccagtttgtatgagtcatacaaatttcttgaaactaaacctgaatccacaagccagtgaccttgaaaactggagtcgccgggcagtaatttcatcagcctttaaactcccagttaaatggccagagaatctgccaactcatccaggaatactttaaagtgattgaatccaaggaagaacacaggtgaaggaccacatcttagatgacaagatactgctggatgtaaaaaatgtgtcaattctaattctaaactcctttggcacaggagtcccttgctttctagtagtagaccagcaactttctagatcatatcatatagtctcctttatttgtcattacatccctgcttgcccttgagagtttagtaagtaaatgaagatgtaaagaaggagggtaattaggcagcaggaactacattgtgtggcccgactttgattggccccgggcctcctccagacctgccttccgtatctaatttgcagatcttcagaactccccagtggcccttctgactctgttttctggcccagggtcccacactacgtttagctgactgtcttagctccctgttctcctccactatgggacagtttcgtctttcctgagcctgaggcgatgagcagtgtttaggaccaaactgcaaatggtattccagcaaatgctgtatcaggaactagatcaatattggctctgccctccaggaattttcaacctaggttcaattctgaatagactcttagacagggggcatctttcaggtttaagccagactgtgggcaggaaattactgtgtggtcaccggtggggtcagagcctccaagtgagggagtccagggcgatggccactctccaagaaaggaagcagaactcttccataaagggaaagttccttctgttttttgtcacttttttttcctttctttttatttttttaagaaataaacacaaccaaaaagctaaagtccccttgggccatcatctctggtctcactcctctctccccttctcggaggccaactattatcatggcagcatatcctttcaggccttttctatgtgtgtgtgttaaacattcacataatggtataataatagaatgttctgactcttttttgaaaatgttctcaagcctttagagaagttgcaaggatagtaccatgaactctcatataggctacatttatttatttttttaattaattaattaatttttttttttttttttttgagatagagtctcactctgttgccaaggctggagtgcagtggcacaatctcggctcactgcagcctccgcctcctgggttcaagtgattctgcctcagcctacagacacaagccatcacacccaactaaattttgtatttttagaagagacagggttttaccatgttggccaggctggtctcaaactcctgacctcaagtgatccacccgcctcggcctcccaaagtgctgggattacaggcatgagtcacggtgcccagcctactacatttaagctgatcagttgttgacattttgctacatttgctcgattcctttcctttctatttatttacttatttattttgcagacatgatgacatttcttccctaaataatttagcctatatctcctaaggagaaggatattttcccacataacccaatataattgatgattccagaaacataacattaatatagtactatgattgaatatatcatcctcatacaagggtttgccactggtcccaataatttcttttaaagctatttttatttatgtacttattttgggattcagaatccagtctaaaatcactcattgcatttggttgccatctcccatttttttttcttctttcatttcgctggcctttttgaagacttcaggggagttgtttttcagaatctctattctgacattttcaagctgcttttctccactcggtgtttggtttttgagacgcatccacgtggaatggccttgggtcactccttagagcatctgctcagcctctgttgccggcatcaggccctttagtgctctaagtggctggtgcacctggccagggctctgtccctaagcgtgactttctgttgtccccccgcagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgcattagtttttttgatctttaattcaaaaggatttctttttacttgttgtggttttactgttgtcaccccacatagcaggacaacccagtccaaaacctagaaaatcattacacctcaactctcagggttattgagatgccgattattactcaaattaggaatggtgtgggaaagtgaaaagagttcagataattttcacatttcttcccattgtaaataaaacaggccccttagatttttctcgggtgaaccaaaaaaccaaactgactcttttagttttggcaacagggaacagaggaagctttgcgacttctacacaaaaatgatggggatggcaccaggaggaagagaaaacctacagcaaaaagaccttcgtgcctttcttacatttatagttcatttatgtttcaagcaagttgtccacaataaacatgattaactttcataatgagaaaagaagtcctgatgaataaaattaaaactagacataggtgtgtctacaaaggatgagactgaaagggaaactgtggtcgccttaaggagcggaaactccttttcttgtctcagctccttcctgagtgttggcttcactctctcctgcttcaaaagactgcttcctatagcggcaggtaagctaaaaaccagagagaaggggtttgtctcttgcagcatctatatgtaaaatcccagagtgggactctgattcgattagcttgtgtcacatagctatccctgtgcaaatttggaaaagacagagttactaggattggcctcatcacccaatgagctgttgggggagaagcagttctccccaagactagggttctgttagtagaagaaaggtgagggaggatgctggggagacacatttgagttactgcaaaagtcttaatactttttttgagagagagggcttggcttctgtgacccaggctgtggtgcggtggcatgatcatagctcactgttgcttcaaagtccagagctccagcagtccttccaactcaacctcctgagtagctaggcctgcaagggcacaccaccgtgcctggctaattttttttttttttttttaaggagatgatctcactatgttgcccaggctggtctcaaacttctggcctcaagtcatcctcccacctctgcctcctgaagtgagaggattacaggcatgagccacaatacccagccagtgcttttgttttatgcaagtcctaggacaggcacctgttcatatgattgtggggtccccgggctcctgaaatgttgggaccacagtcaggaatcattgcaacccaaaggtcaagagcttaaggatcactcaattcactgccccatcttgggaaatgccctggggcactcttcagggggcagtttggagtctgtaccaggagcttctgtaccaggagctctggtcaggctgaaactggccactgcccactgtatgcagctggctctctcccctgcaggtgggaggaaacaagaccatagcttacctcctgtgtccatagtgagaatcaaaaggtgcaaattctaggagtcagaaagaaaagccaatcatgggaccctgtctcttagagttgctgtgaaatgcactcagttgccatgttcctcgtcacctctttactatagtgtaacagcctctgggtaccacgtccaaacttgggccaccttggggtgcctgaggtctccagtgtggacaaaagtatcccagggacccaaagccagtacggtgtgggcttgaaggcatttgtgggagttgcaatgggttccaaaatctcaacccctacaccttctaaaaggaatcagaacttggtggaaattttgctggtctattttgtagaaaagctgttagggtgacaactacaggattcacaaaaatcataaaactatatttggccctgtcgctgttcagagtccacactggtcttactaagccctgatagagtgaccacagaaaagtcactccaaagtgaggggcccagcgtggctgttcttgca

SEQ ID NO: 773 - DNA, 25513 bp, Human
tgaaaataaaacgctttgacctaggaatgatatgcatccttcttgtcatagctcacaggccagaactagtcacgtggccctgcctgattgcaaagggaaatggtatttgtaagtttcctgtgtgcccaaggcatggatgagcactaaaactctctcctatattgaataaattggatttgaaggagtaggaaaaggccccttgagggcacttatgaaaacaatgtaaagaaacatacacagaacacctaatctttttgaaagcctggtgctggagtctctcacaatagatttttattattttatactgacaaaagcctggtaaggtagacattatccccttttttatagtttttggtcattgtagttcatggaggttatgtaacctgccccagagctcacactaagaagtggagggaactctgattctcttgctcttccttttctccagctctcaatttcatataatgatcttttcttccatcccataagagatttaatttttaagaggagcttctagggagggatacacaaaggctggcaatgttttattttttaaagctgggtggtgagcacacagatgtttgtgctctttttatgtcttaagtgtttcaaaatacaatcttttaaaagggggttgacagaacctgagaaccagtgataaattcttcttaaaaagagaagcatttttaatgaatattggcagccagaaagtaggacatatagtattggtaacatttattgagcccatactatgtcctagttttgggtttatttgtttgttcgtttgttccttgagacagggtctcactctgtcacccaggctggaatgcagtggtgcaatcatggcttactgtagccttgactgccagggctcaagccatcctcccacctcagcctccagagtagccgagactacagatatgcaccaccacacccaggtaatttttaaattttgtgtaaagatggggtctcactatgttgcccaggctggtctcaaattcctggcctcaagtgatcctcctgccttagcctcccaaagtactgggattataggcatgagcctatttgtgcctggccagatagttttaaataatttctttacatattttatctcatccttccaacaaccctgtgaggtagatactattattatccccatgttaatacgagatgagaaaactgaaacaagtacagattaagtattttacctgaatcacacatttattataggaaaaaccggattggaaccaagcattctggcttcaggatacatacgcatgactactatcctggaaaacctcccctaagaggtggacgatgaaccaaatatgcagaggtggatgaaactcttttgtgcttctccagcaaaacgcgtggtacattctctagacgtttatgaccagttaaacagggaatttaaaatagttttcccatgacagagaaagacaaagcgctggtgttcttggcaggaaattcaaagaaatatttaaggcaagggctgactcccttggaccggatgaaggggaagagcaggtaataatagagggttctatggatcgcagaaacttcctgggcaaggagggtggagctggggaggggtttaagaattcctgaaggtcaagcgatctagcccagctggggttttctcctgcttggagaggggtgctataaaagcgcagtttgggattactactgtcgccactgctcaccaaattaagttattccgggagggatcttctcgtcgccatcctcattccaacacacacccattgacacactcgggttcggctgtgcggtgcaacgaattcccaggtgggacacccgagcaggaagaaagccaggctgcggggctgggggcgccgcccggcccgcgccacagtccgcctggaggatcaccgccagggggcactctctccgaactcggccgctctgtctcctccccggcgcgctccctgcccctcgctccccgcagccagcagagaaggcggaagcagtggcgtccgcagctggggcttggcctgcgggcggccagcgaaggtggcgaaggctcccactggatccagagtttgccgtccaagcagcctcgtctcggcgcgcagtgtctgtgtccgtcctctaccagcgccttggctgagcggagtcgtgcggttggtgggggagccctgccctcctggttcggcctccccgcgcactagaacggtgagtctccttcaggcgcctcctcctggcggccgccgcctcgcttcccagcggtcagggacgccgccccccgccccttcgctctcggcaggtcggggacgcagtccctgtcccctcgcttcccaccagtcggggacgcctcccctgtcccttcgcttttcacaggtcagggacgccgcccctacccgcttgcttcccacgggtcggggacgccgcccctgtcctctcgcttcccgctggtcgaggacaccgttccctgcccctcgcttcctgcaggtcgggacgcagcctctgtccccacgcttcccacaggtcggggacaccgttccctgtcccctgacctctgctccccaggcctcctcttcctcgctcattccaccccctaaaaaaccccgcgtcgccttactcaacctcgctcccctcaactccgctttttccccttcccagataaggaaattgcctcctgcagttgtccgctccttggagcaaacacctgcttaaatttttaaaaaatcctttacgttcctggcgactccggctgtcactgtcatgggaaagctatttttggattccctgttgaactctatagaagtctcaggcagcgagtttaaaaaaaaaaaaaggctcagatgacacgaatgttttctcccccgcccctaaactcggtagttcgagcgattgttccagacgccgggttgataaagctgttcctagtatttggcttaaggggaactccagctgagttaggactgtcttgaatgtgaacagaaagcacctaaataaagtattagcagcttcgctgtatggtatttaattgtttctttctctgagagcagattactattactgaatgtcttgttacacaggttccatgtagaaacgagaaaaactggtaaagaaattctgtgttggccttgtgaacttggccgctatcatttcattcattctcctttcattactagggaagggagaggggcttttcaaattttgaggttgagtgtataggcaggaacaatgtggcctcttttgtgactctaggaaggagtccggcatgtggtgggtacaggatcacatcagagtttcagcctgcatgcaccacaatatttcagaattgtaacatgagctcttctctgtgataaatttgggcatgtgatgccggtaaacttttggacacttagatttggagagaagttcaaatccttgcctcctggagcagagtaaatagtgcccaggaaggggaatgccccttgaatttggattcaaagttaaggcacaacagttgagtattttgcagcatctcttggccattggagtacatttgtaggtcttcacactttagaaatttaagaagctggtaaacagtttctgtttctaaagctagtagcacattaaagataatttctcatattttctttacatggttttacttcaataagttacatgtttactcgtatgaatttcagttgacttaaaattgactcatttaagacataacttgttgacttcttttaacttggcacatacctccttagcatctgccttggaggacaaactttttgtggattatcctacttccccctcccccaagacatgttacagtattctcttttgattataatgtacacccagatactaattcgtgaatttaagtcttgatttatgacaaggctgctttcaatactactcattttacggctgaaataagttagcagtagttaacgttccacaatctttaaggtagtgcttatcatactagatttcgcaactgcaaaaggggattacagtcaggacactcttaacatacaagttaaggaacaatttatactttgttccatcccttcattaattcctgtagaaagccacgtaagtatactagaatagaggctgtaagaaatttttattttaggcctggcataatggctcatgcctgtaatcccagcacttcgggaggctgaggtgggaggatagcttgagaccagcctgggcaatatggcaaaatcctgtctctacaaaaaaatacaaaaattaaccaggcttggtggcacacacctgtagtcccagctacttgggagactgaggtgggaggatcacttgagcccaagaggtggaggctgcaatgagccatgatcgtgccactgcactccagcctgggcaatagagcaggaccctgacaaaaaaaaaagtgtgtgtatatatatgtatatatatacacatatataaaatacatgtatatatgtgtatatatacatatatataatatatacatatatttgtatatgtttatatgtataatacatgtatgtatgtgtatatatacatatatacacgcgcgtgtatgtatacatatatacacgcgcgtgtatgtatacatatatacacgcgcgtgtatgtatacatatatacacgcgcgtgtatgtatacatatatacacgcgcgtgtatgtatacatatatacacgcgcgtgtatgtatacatatatacacgcgcgtgtatgtatacatatatacatgtatacatatgtacacatacatacatgtgtacacatgtatacgtatacacatgtgtacacatgtatacgtatacacatgtgtacacatgtatacgtatacacatgtgtacacatgtagatacacgtatatatacatatatacatgtatatatacatgtatatatacgtgcatacacgtatatatacatatatacatttatgtatgtataatacatgtatatatacatatatacatttatgtatgtataatacatgtatatatacatatatacatttatgtatgtataatacatgtatatatacatatatacatttatgtatgtataatacatgtatatatacatatatacatttatgtatgtataatacatgtatatatacatatatacatttatgtatgtataatacatgtatatatacatatatacatttatgtatgtataatacatgtatatatacatatatacatttatgtatgtataatacatgtatatatacatatatacatttatgtataataccatttacgtatgtataatgtatatatatacatttaccgtatgtataatgtatatatacattatacatttacgtatgtataatgtatatatacattatacatttacgtatgtataatgtatatatacattatacatttacgtatgtataatgtatatatacattatacatttacgtatgtataatgtatatatacattatacatttacgtatgtataatacatgtatatatacattatacatttacgtatgtataatacatgtatatatacatatatacatttacgtatgtataatacatgtatatatacatatatacatttacgtatgtataatacatgtatatatacatatatacatttacgtatgtataatacatgtatatatacatatatacatttacgtatgtataatacatgtatatatacatatatacatttacgtatgtataatacatgtatatatacatatatacatttacgtatgtataatacatgtatatatacatatatacatttacgtatgtataatacatgtatatatacatatatacatttacgtatgtataatacatgtatatatacatatatacacgtatatacatttatgtgtatatacgtatatatacaaagcactttttgttcttctcttagtgttagttatcgttataattaagttaggtgatttttccttaagtcattgcagttcttaaaactaaagggacaaaatgttttaccaaagaaagaggaaacaaaaatgctaagtggcagtcaagaattgtttttaacttaattttccctttatgtctagttacatgaaactaaatactgtggacttaaaggataactatatgaaaaagtttatttggaaaatagaaagcttctggattgcatcttaaagcatggaaagtaatgtgaaacttgaaggcaaatagattttgaacatgctcacttttatgtgtcacactgcattcccacagtggagttccttttaaggaattataactgattagacagattttcttaggaacacattagctataaaaggtctcttcagacctaaagaccttcaagccttttgaactggactggaagcaggcagtgtatagactatccaataaactatattttaaactggacatttgggcagaaaagaaaagatacacctagcttcataatttctgcctttgtcttgtggccagcacttggatatatgtcatacaccaaataacaaatactaatttctcaaaagtgattttacttaaaaaaaaaatggttcaagactgaaatatacctgatgttgtcaagcgtagagaaaatggactcttgcatatatactgtgcttgtgtgagtggaaattagaatgtctttgatacatattagataaccagcattatctatcagaaagcttaaaaagttacataccctctgatccaacaattctacctctaggaaatttacctaaggaagtaattggacacagaaatgtacagatatacctcattttatagcactggttttttgcacttcccggatacttttttgtttttttttttaacatattgaagatttatgtcaaccctgtgttgtgcaagtctttgcacgccatttttccaacagcgtgtgctcactttgtatttgtctgtcacatttttgtaattcttggaatattttaaactttattatgtctgttatagtgatctgtgatcagcgatctttgatgttactattgtaattgttgttttggagtacatgcaccacacccatatgagatgatgaacttaataaatgtgagagctctgactgctccactgaccagctggttcccttactgtccctctcctcaggcctccctactcccctgagacacagcaatattgaaattagaccaattaataatcctacaatggcctctaagtgttcaagtaaaccaaagagccacatgtctgtcactttaaatcaaaagctagaaataattatgcttactgaagaaggcacatcagaagtcaaaatgggccatttagccaaattgtgaatagaaaggaaaagtttttgaaggaaattaaaagtggtactccagtgaactcactaataagaaagtgaaacagccttattgctgatatggagaaagttgtaatggtctggatggaagatcaaactagccacaacatttccttaatccaaaacctaatccagagcaaggtcctaattctcttcaattctgtaaagtttgagagaggtgaggaagctgcaaaagaaaagttggaagctaacagagattggtttatgaggtttaaggaaagaaacgcatctccgtaacataaaagtgcaagatgaaagagcaagtgttgatgtaaaactacagcacattatctagaagatctagctacgatcgttgatgaaggtggctacaccagacaacaaattttcagtgtatacttaacagccttttattggaaaaagatgccacctaggatgttcatagctacagacaagtctattcctggcttcaaaattttaaaggacaggctgatgacgtttttgttaggggctaatgcagctggtgaatgttgagttgacaccagtgctcatttacacttttgaaaatcctagagcccttaataattatactaaatctactctgcctgtgctttataaaggtaacaacaaagcctggatgacagcgtatctgtttacagcgtagtttactgaatatgttaagcccactgtcaagaactgttcaggaaagagagatgcctttcaaaatattactgctcattaacaatgcacctaatcacccaagagctctgatggagatgttcaagaagattaatgttgttttcatgcctgctaatataacattcattttgtagcccatggatcaaggagtcatttagacttccaagtcttattatttaaaacatgcatttcataaggctatagctgccatagagaatgagcccccgatggatctggacaaagtaaattgaaaactttctggaaaggattcacctttctagatgccattaagaacatttgtggctcatgggaggaggtcaaaatatcagccttaacaggagtttgaaagaagttgaacttgaaagaagccctcatggatgactttgaggagttcaggacttcattagaagtcactgaagatggtagaaatagcaagagaactagaattagaagtggagtctgaagatatgactgaatttctgcagtctcatggtaaaaaacttgaacagatgaggagttgcttcttatggatgagcaaacagtggttttttgagatggaatcaactcctggtgaggatgctgtgaacattgttgaaataacaacaaaggatttagaatattctacaaacttagttgataaagtagtgggagaatttgagaggattaacgctatttttgaaagaagttctcgtggggtaaaatgctatcaaacagcatcacatgctacagagaaatacttcatggtagcaaacttcattgttgtattattttgagaaattttcacagccacctcaaccatcagcagccaccaacctgatcagtcaacagccatcaacattgacgcaggaccctctaccagcaaaaaatattatagctcgctgaaggctcagatgatcgctagcattttttagcaataaggtgtttttaaattaaggtatatacattgtctttttagacataatgctattgcacacttaatagactactgtatagtgtaaacataactttgtatgggaaacaaaaaaattgtattacttgctttattatggtatttggattattgcggtggtttggaactgaatccaaaatgtctgagtatgcctgtatatgggaataaaaataacaaaggatatataccctagtgtagcataacagcatcatttgtcctcagatttggaaggtataaagggggccctataccgtattttacgacccagctgtagtgactagttctgctattttctgctgtcttgccattgtttgcttcctttcaatctgtatgaaccttccctaggagtccacatcagatatagcaaggccatgggagctatttttaacttcgggaatactgtatcaaaactaaataaaccacagccgggctcgggggttcgtgccttaatctcaacactttgggaggccagggcaggtggatcgtttgaggtgaggagttccagaccagcctggccaacatggcaaaaccccgtctctactaaacacaaaaattagttgggcgtggtggcgggcgcctgtaatcccagctattggggaggctgaggcgggagaacccagaggcgggggttgcagtgagtcgagatcgtgccattgcactccagcctgagcgacagagtgagactctgtctcaaaaaaaaaaaaaaaaacttaagtaaaccacatgccaagtttctttgcagattctttggaattctgtcaatgtagtgtagtagtgctggacagaccatgtttaatagcagctgtggccagcactttagtgtaataaaataaaggcaaataaattttaaatgcagcttcatggacaaattggtcaaaacatggataaaagtagtgtattacaaagtgcaaagctccaaggtcaggtagacgtgggttctgatcccaactctgttacttattagttgggtaatcttaggtaagttacttaaccttttaagctccatagttaccactttgataagtggtgacaacaaaacttaaatactacataaagttgttgtaataattcattcttactgcctggcactgttctaagtgctttgcacatattaacacatttaatcttctcagtaactcaagtggattttattgttagaaccattttacagatgagaaaattgaagcacagaaaggttatataatttgcccagctcataaatggaagaaaagagttaaattcgtatcattcaattccagcacctgagctcatcaccacttattagcactgcgtttccagccagaatagtacctcattgtaggcggtcatcaagtgctactcagaatctttgaaaagaataaaaaggtatttgtagtggtaaaaggattgagtactactgtcttaatcctcgatttggtgaagtggcagccaggaattttatataaaagtgagacaagcaggagaatatgactggaggcctacattctgtttcttgaatgatatctgacacatactagaaatttttttcaaaagtaattatttaaaatacagttgtggttacatgggctgtgaattgcttttaaatattagcttctcgcctgtaaataccataatggtttagaatttgaggatatctcatctgctcatgaaaccaatagttttccataggcaaacaaaacatcacttgtttttccagtcattaataatgaaacatagtcacttgacctgactgaaggcagaaggacataaaaatacactttttcaattctatttttaatacctaatagaaatctccacactgagcatttggaagtccttatagaattttagacctagaagaaaaaaccaagatctaaatggttaagtaacttgcactaaatcacacatctaacagtggcacatgatcacctgattccttgcgtactgcttttcctggcactgagctgctagccatactattcccttcagctcaggatacttcaaggaacttcaacaacatggataagttctttagcgatgcttagtgaacacttactgtatgaaaaatcgtgtgctaagtactgcggaaatggaaattaaaatatttagctcaatcacaggaaacaaacatgtaaacagataattgtgatatagaagagtattacaactgaggtgcttctccttttttaactttatatgctgtcgttctactagatcatgaacttctgaagggacccagctttctttgtgtgctccaagtgatttgcacaaataataatatatatatttattgaaggagagaatcaggtaacttataatagtcatgaaaaagctcaaaacacttttaaaagttttctgtaaataacattaatacagctgatgtacatgaattaaaaagtgacttgtatagataagctatgatatatatgtgtggggtgtgagtgtgtgtgttacttataaaggcatttttttcttgctatttctacagagcaagtgataatcaagttactatgagtctgctaaactgtgaaaacagctgtggatccagccagtctgaaagtgactgctgtgtggccatggccagctcctgtagcgctgtaacaaaagatgatagtgtgggtggaactgccagcacggggaacctctccagctcatttatggaggagatccagggatatgatgtagagtttgacccacccctggaaagcaagtatgaatgccccatctgcttgatggcattacgagaagcagtgcaaacgccatgcggccataggttctgcaaagcctgcatcataaaatcaataaggtacgtgagcataagaaaaaatggtgtcctataacagaaccagatgcagagaacattgttacatagaacatggaacatcccaaaagtagtcttacacataaaaagctacttaggaaaaaagaacaatggacagaaaattgagaaagttagattcttatcccagtttccactgttgtgtgaaaagtgacttgaatctcctcctctcttgacccttggataaataagtaaataatttgctacttttacttaaagcaattctaatgcagactggggagtgactctatgctttaaagaaaatagtattttttaaatgtaccttaaattatgatgctactagataaggataatctcaaccacacaaagaatactgactctgtaagtgatcagttattgtgattttaggcatgttaaatcttgtttattacctaaagtgtatggtcaactgtaaaattaccagtatttttaaagaaagtattaactgaaggctctaccttcataatatatccaaaatccagtcccttctcacttcctccctctgctaccaccctgttgtgactcaccaccagctctctaacaggcctcctgctttctattcttgtcttccaggctgttctcaatacagcagcgggagtggacctagtaaaataagtaagatgatgtcatctctgctcagaccattgtagcagggtatctgggagtaaaagctaaaatccttataagaccctgtgtgataggcccatgattcatttcctgacctcttttctgctgcactctttgtccttctacccattcattccctctttgctatcccttgaacatgtcaggcatgctcctgccttggtgagtggtggctttagctcttctgtttgtaacactcttgccacagctaaccccttaactcttccactttggctcaaatctcaccttctcataggtcccctcaccaccgtatttataccacagtgtggttccacctttcttgccgaacaatcccaatctctccacctggccctaattttcttttttcccttagcactttctgccttctaaagcaccaaataatttatgtgtttattgtctgccccactggatgataagctccttgagagcaaagtattagatctgttttatttcttgatttttcccaagttctggaaatagtgcctgacccatagtagatgatcagtaaatcatggttgctttaactgaatgaaagtacttgcaatttccatggaaatagatacattttactataattcaaaagtacatgggaattttgtaggtaactaaggagtcctatacaggacaaaaaattggatgaaggggggcagattttatgttcttcaataaatagccatctagttatattagtgaattcattataagtctgtcctggcaatttgttagtctccaaagtttttatctgccaacttttacattaacttttctataaaacttgaatttaagagtaactacatccatactcgggacttggcttaatttaaatcacaaaagataatgtctgctgtttcaattttggggaaagatgtattacacagcgctgacttaacaagatctattttgggtagatttttctcaacctccacattattttatttttgagatggagtcttgctctgtctcccaggctgaagtgcagtggcgcgatctcggctcactgccatgcccaggaaggtagctaatcttcagcagctttttaatagcaagatgttcatgaaagtagtgggacagtggtctgaaaaggaaatacaacccacaaaaagaagtctgaggcttttttttttctgtctccctgtaagctttttaaaaatgaacacttagccccagtgttcttaaaggaactgctctgaaatttctcattgagtatgttcactcaaggaatcaaagtgcatctcaatacaatcccattttctttttctgaggatagttttttccatcataagaaagaataaaccactgagaagcaggacatagaggtcctttaactttctgtaacattggaccctagacatacaaataaaggaaacttttgttgcctgttagctggagtgttatagtgactatttcagagtaaactttaaaatgtgacctcacggaggtactgctaagtgcttaaatttttacttatgactgagcaattgcattatagacatgttattggtactgtgagcagcatattccatctttctagtgtattatataggtgtgacaacacagaggccagactgccaaaattcccattctttcacttcattttgtaccaatcaaaataccttattcagctaatttttctcaaaaagctggaatctatcccaccatataaaaatcccttagcttttgataggttatcagtatgctagttgtactcatttcataaaagaacagtttgtaagctctccataaaaggacagtttgttttggtgacctgcaatataatatgttaaattgtttttacttatgaaacagtaaatggagaatttatatatggtgaattaaagttgtttggattttctaatgtgagtctttaaatctaattgtgtgtattttgtttctgttagggatgcaggtcacaaatgtccagttgacaatgaaatactgctggaaaatcaactatttccagacaattttgcaaaacgtgagattctttctctgatggtgaaatgtccaaatgaaggttgtttgcacaagatggaactgagacatcttgaggtattaaagttcttttctagctgttagcacatgtataaaaggaagttcctacagaatagggactttgctgtgtccatctgtgtattgccagtacctagcatatgatgattggttaataaattcttgctgaattaatgccaaccctttaattattgaatataaatgtaagtagaaaccagaaatatactgttttatctactctggctttgcccagcagtaatttttttaaaaaatcagtattgtttcataagcttttggtaagctttatctgcagtaaacctgaggagcattttaaatacaggtgtcggccaggcacagtggctcacgcctgtaatcccagcactttgggaggctgaggcaggcggatcacgaggtcaggagttcaagaccagcctgaccaatatagtgaaaccccgtctctcactaaaaatacaaaaattagccaggcatggtggcgtgcacctgtaatcccagctactcaggaggccaaagcaggagaatcacttgaaaccaggaggtagaggttgcagtgagccgagatcacgccactgcactccagcctgggcgacagagcgagactctgcctcaaaaaaaaaaaaaaaaaatacaagtgtcacattttaatcttgcaatttcatttttgtcattttgaaataagcagtaattcccaagtaatcatctcagtatcctcattatacttttttctgtttttctaaattgtgcattttattatgaactaagtggaatacgcctatagtttcagattaacagaaacaatcagattataaaataatttgcttttatactaaatagatcaattattagcttggtgatttttaccagaaattaaatttagtgttatatttgaaattaaatgtttaaggcagatatactacttgctccttttacttattagctcttaaaagagagtggcctttttgacacagtaataaattgataaataggaaatctgacttctttccaacactctttgctagttggatgcatgaacttgagaattcacatcctttgtataaatttgcaacccatgaccattttaaaaaattcgctaaagacgttcatattgtgaatggttctgtggtgtgcattagacaaagtaggttcagtagcctgctgaaagagaacagtatatgattaggagagcttatatgtagaagacttcagagttggctaatgctaatccattattttttttaattataggatcatcaagcacattgtgagtttgctcttatggattgtccccaatgccagcgtcccttccaaaaattccatattaatattcacattctgaaggattgtccaaggagacaggtttcttgtgacaactgtgctgcatcaatggcatttgaagataaagaggcatgtactaacttggatttgttaaattcactacttcttaaaatattgttcttaaatgtgtacttgagggggttagcagtagataaggatgtgactccgactctgagtctacattatcaattttgggaaaaatgatttttaagaaaaagaaggttcaataagccattttagtacataagtgtagaatttgttttgcatgtctttcttaaaaaaacatttatactagttatcactattgtagatatgcaagtaacagaacttctaagaaaggcatatgccgatcagctttcctgtgtgatattttaataaccaattttggattggagacaaacaagtagattaagataagatctacacaaaattattctgagaaacagaataggttgttctaactattacaaagaataaatcaaacccacaaagtatgttttcttgatgatactttatcgtgcagcgtatataatgtatttacttctcattttgtatgttaaatttaaaagtttatccttttttttttttctttttttgagacagagtttcactcttgttgcccaggctggagtgcaatggcatgatctcagctcaccacaacctcagcctcctgggttcaagcgattctcctgcctcagcctcctgagtagctgggattacaggcacgtgccaccatgcccggctaatatttttgtatttttagtagagacgaggtttctccatgttggtcaggctggtctcgaactcccgacctcaggtaatccgcccgccttggcctcccaaagtgctgggattacaggcacgagccatcatgccaggccaaaagtttatcttttaaaaagaaacttggtagtgcctaacagcatcatgattataggacagtttttatattcagaaactgagatagattaagtagacttgtattaatattgccaataaaaaaagctaaccctgaaatcgaagcccttgatccctatcctatgtatacttttataaaataacctacatataatttatgtttttattctgttacttagatacttccttaaactatagtttttataaattcacgttggcagtttttccccactttgagatcaagcatattttatccattacattgataaaatattcaaaaaaagttagctaacttggtataaatgtagagaagtctcagtcataattagagtaaaatgacaactcctttttttctttatttttttggagatggagtttcactcctgttgcccaggctggaatgcaatggcgcaatctcggctcaccacaacctctgcctcctgggttcaagcgattctcctgcctcagcctcccaagtagctgggattacaggcatgcatcaccatgcccggctaattttgtgtttttagtagagatggggtttctccatgttggtcaggctggtctcgaactcctgacctcaggtgatctgccctctttgcctcccaaaatgctgggattacagacatgagccaccacgcccggcccgacaactcctttctaaactttagtaaattagattgacttaacctggaaggctaattatttctcagcacatcaactaaagtcattatattctagaaaataaggcttacccttctggggcatatgagaaactgagcaccaaatcctcatgtcctaataaaagatttgttctttaactctactgacaagaaattttaattaaattgtcatgctgctgctgaaaatttttgtaagattacctttggagaagtatagcctcggcagatgatgtccaaagtagatacaggtgtaccacctcaggataaaaggaagggatttgaaaaattattttttatatactaccctgctcttttaaagagctggaaagttgaatgaatctcattattacactgggaaagagaaagaaaatagcctttatatattactctcactttcactcacttttgctttgtacaaattgatgtccttatttgtttatagtgaaaaattgctttttatcaaaattagttgttttcactttttcagatattctcatgctttaattatatttctctaataaaattcagatccatgaccagaactgtcctttggcaaatgtcatctgtgaatactgcaatactatactcatcagagaacaggtattattcattttcataaattattattttcataaacagcttaaagaagtgaattaggttttttaattgaaaatttaaatcaataaggcaaagaaatacagattgaagaagtattagagctgtgtgaaaattttttatataaattaatataagtaataaatactttcagggagaacaaaacatccagccctttttaagtacttaaaattcctaagtcattaacataatacctgtgcttttgtatattcataaaaattcccaacaaaaccaattttaagataaaaataatcaaaagtaagggtccccatttaaagaaagaaaaaactaagatatatatatatatatttacacactgtgaaatgaggatctcaagtgtccagagattggctgaaagaataagagggaacagcgaaataaaggaaggcagttctgttcagtaggagaataatatttgtagctgtaatccctgaggcatacagggaagttttcagatttttaggacctgtagcccttctgttcagttgtcctgtaggccactgaccgggcatcattagaagtagtaattgtaatagaaaattatatggtggggtttttttgtttcttgagatagagtctcactctgttgcctaagctggagtgcattgacacagtcatggctcactgcagcctcaaattcctggctcaggcgatcctcctacctcagcctcccaaagagctgggactacgggcgtgcaccaccatgcccggctaattttttatttttttagattttttgtagaaacggggtcttgttatattgcctagactggtctcgaactcctgagctcaagcaatctacctgctttagcctcccacagtgctagaattataggtgtgagccaccaagcccagcccaaagattgttttgactattagtagagaaaggaaaattccatctgattgctatcttctgacatttggggagtttacccacaaaatatgaatattaaccattaaatatttatatacccatgaaatctgtaaacccagagatcattattgatataccttactgagaagcagcaagcaaaacctgtcactggacaagtttgttaaccttaaaactttttcattggtttgttaacagtctcttaatttttccaacaaagccttaatttgaaggtgttaaacatcttttgcttatgaagtcctaactcgttttcctttttgctgtcttttaacatttaaaggaaaccatgcaacaaattaaaacccagcaaaagaaaatacaagaaaaaaccctaggctaagagtcagaaaacctgggttttagtcctaggtttaaactgtgattttaactgtgccctctcatctttaacaagttgacattctaaatagatctgggatcagcaaactggcctgccagctagatctgtctctctacctgtttttgtaaataaagttttattgaaagacagtcatacccatgtgtgtatgtcttgtgtatggctacttttgtatgacaatggtagagtttaatacttaggacagaggcagtacagcccatatttactatctgatcctttacaaaaaattttattggcccctgttctacactgttccctcttgagaaatgaaggattgaattataataaatggtctctcaggtacttcctgtttgaaatatctacaactatagctacattaaatttctaaagggaatttggcacctctttgaaaaaatatgattgagtataaaggatcttaccttagagaatgtgtcttagagtcccaaaatccaggactgagactttttttagagcttctattaatgtgtttaaagtaccttctaacatctgagtctccccattgtagctaaaatatgcccagcttaacaaaagttaagaagattgttgaaaggtggtcaaagatgatttttgagaggtggtcatgaggcaagtatgggtgtagtcagtggcttcagtgcatgcagttgactggttcctattaaatggcctagaccatagtgggagtcttaatccagtttgcacttgtagctattgttaggtgttttttctgtaaagtgccactagagggtgccagttcccagcaagaggaacaaattcattttcttgaaatgaattttggataattggaggggatattatgagatgttgatatttcctttctctataacttttgaaagtagatgttcttttaatttttgtgggtgatggtttatgctgcacctattcagctgccaatgtggtacaaagcagccattgacaatacagtttaaatgtgatcgcatcaaactagaaaatgatatgcaaggaagagatttttcagcctttgttttggatttcagatgcctaatcattatgatctagactgccctacagccccaattccatgcacattcagtacttttggttgccatgaaaaggtaaggtttttttttcttttaattcttgaatataagtaaaaaaaaatatttacatcatgtagtggagaataacaacaagaatgtagatgtagttgtaaagcagtgtaataagtgatataatagagttattcatggatgctgtgagcagaagcaaaggcatacttagcaatgcctaaagcattcagacagacttgacaaaacatgatgctttgggctgaatcttgacaggtgaaatagttttccaagaagacaaaggagagaagaccagtgagaaagagtgagcatggtgatttgaggaactacaagtagtttgtgttgtgctagttcaacccaatagcaatgtagatgatttgaggtggaggtgggggtactagtacctgagctgttggaatacctaagtgaagacagcttgaattatggcgatgaccgtcaagatagacctaggagccagtacatatttaggagagaagatctactgcctgtgtgactaaataaatgtgatgagtgaaggagagggaggcgtctagaatgactcttggtttctggcctttgtcactgggtagatggaagggccattcggcaaaaaagagtgaacacaggaagaactgactggaggtagagtttaaaaaaaaaatctgttttaatgtattgaattacagataatgacttcacccagctagggaacaggtgggatgactgacatgcattatgtgctgtcttaagccccaaagagaaattaggactcagagtattgatttgggaaagtgatttgtggtaataatggaagttgtgattgagatcatatggcgtatgtacaggaaagagaagtatgccaaggaaaagagccatgaacaaacagtataagaaacagatgaaccaggcaaagagaaagtagtattatggtctccaaaattagtttcaagattcatgatcagtagtgtcaaatgtctgagattgatcattgtttatgatatgtctttctttttggagagtgcagttacacttttggttttccattatacttttttttccctgacttatgtgtaacaaacatacatttaataatttaaaaaataaaatgagcaaaatggtatggttgtattttgtgggaaaattctgtattgtgcttagagaaaaagaaagaaataaaatgttaatggaagttaggtgagatattaggtaacaccctttttggtcatctatattttctaggttttttaaagactatatgaccttttataataaaaattgttgtattatgaatgtttttcgtataatagggtgttcttaatgaccttagaatggcatggtgccaggagaaattccaatttgcaatagatttgtatactgggaattgcagacaatacaggtagactatattcttgactttaaaaaaaatggtattaatattaactagagagagacaaaagctcttcagagaggtttgtccttttttgatgggaaagacttcaataattgtattctaaaggaaagtgttagaggaagagatgtttaaagatgaagaaaaatcactgagtaaaatctctggggtgtcgcaacaggtcaggtaacatttagagcacaggtagaatgttaatcttggagaggacaggcatctcagttagaaaagaaggatgtgtgtaaatacattttttgtaggtgggagggagatttatgtgagtgaaagctgggagagtagtcatcagatagtctgtttttcagtgaactaagaggcagagtcgcctcattggatcaagaatctgttgaaggcaaaggaaaattgtagagaattgagggaagtggtgtgactacttgaaaacttcttatttgacctggccaggtccttttcctactcctcacggtatctattcccagcctaaggcttgtgcttgatttttagatgcagaggaatcacttggcacgccacctacaagagaacacccagtcacacatgagaatgttggcccaggctgttcatagtttgagcgttatacccgactctgggtatatctcagaggtccggaatttccaggaaactattcaccagttagagggtcgccttgtaagacaagaccatcaaatccgggagctgactgctaaaatggaaactcagagtatgtatgtaagtgagctcaaacgaaccattcgaacccttgaggacaaagttgctgaaatcgaagcacagcagtgcaatggaatttatatttggaagattggcaactttggaatgcatttgaaatgtcaagaagaggagaaacctgttgtgattcatagccctggattctacactggcaaacccgggtacaaactgtgcatgcgcttgcaccttcagttaccgactgctcagcgctgtgcaaactatatatccctttttgtccacacaatgcaaggagaatatgacagccacctcccttggcccttccagggtacaatacgccttacaattcttgatcagtctgaagcacctgtaaggcaaaaccacgaagagataatggatgccaaaccagagctgcttgctttccagcgacccacaatcccacggaacccaaaaggttttggctatgtaacttttatgcatctggaagccctaagacaaagaactttcattaaggatgacacattattagtgcgctgtgaggtctccacccgctttgacatgggtagccttcggagggagggttttcagccacgaagtactgatgcaggggtatagcttgccctcacttgctcaaaaacaactacctggagaaaacagtgcctttccttgccctgttctcaataacatgcaaacaaacaagccacgggaaatatgtaatatctactagtgagtgttgttagagaggtcacttactatttcttcctgttacaaatgatctgaggcagttttttcctgggaatccacacgttccatgctttttcagaaatgttaggcctgaagtgcctgtggcatgttgcagcagctattttgccagttagtatacctctttgttgtactttcttgggcttttgctctggtgtattttattgtcagaaagtccagactcaagagtactaaacttttaataataatggattttccttaaaacttcagtctttttgtagtattatatgtaatatattaaaagtgaaaatcactaccgccttgtgctagtgccctcgagaagagttattgctctagaaagttgagttctcatttttttaacctgttatagatttcagaggatttgaaccataatccttggaaaacttaagttctcattcaccccagtttttcctccaggttgttactaaggatattcagggatgagtttaaaccctaaatataaccttaattatttagtgtaaacatgtctgttgaataatacttgtttaagtgttccttctgccttgcttacttatttccttgaggttacgaagtagcatcttccccagagtttataatgctgagaaccacgtggataccaactgctcattgttatgctatgtaaccctttttgtctattcagtgcagagtgaatttcacagctctgcatatgtcttcatttgtttaatgcttacaagacaggagatgcacacatacaatcagcaacataaaaattaaaagtgacccaagtagtcagcgcatgtggcatctcattggtggtgacagaagctatgtgagccagaagttttcagctcttttgaataccctctggtttatttcgattaaaaagaacaaaattgatttcctaaaatcagaattttttaaaacttgggagatgattggagatacctaggaggtcaccaaactaggattagaagtcacagtggttgtatcacaacttagcttgagtatgttgctgtagcctaacaactgcaggttctgagaaggatcctgtagaatcctggaagtaaccagattttcctaatagggagatgatttttttgtgtgccatcatgtatttgttaaaggcctatatatagatataaaatatcgtggaatctagttctcagggagacccgcaactagtataagcttataaaggatctaaagatccatccaccatttaaagttgtctggtaatgagagatgacattgtatcccccagagaggccaaatcagagtcgccagccagcgttctagatcagccttaatttcaagagaaagccaaggacctcatctgcaggggagtgtggttttcagccccagcgagtgtcactttgaactttccctttgcttttttctctcttctccctccccacccacccttaggctcctgatctggtgagtttgttatggagtgaaaataaaagtcaagcagagaccttgtttcccgtgccaccattagtaccacaagctcatggctagttaccacattacttcctggcagtttgtgtccctcagctgtgccttccaaccagcgcctgagaatcactgcataccaccctctaggtagggaaacctacactgctgctgttcctgtgattattttacaatgaataaataattgtcaagttccatttaaaaactgaacagtagtatttttgtatttgcgtagaaaaagcctgaaggaaatatactaaactttttgttggcttattttcctttgcgcttgcttatattttttacattttctacaataaatgtgtacttttatcggagaaaaaaattaaatgttgccacaaaacatttaatctccacgcccccagctcaaaaaaggaaatgatatttaaaagcttcctggtcagatttctattaaaagcactggctgtgcattagatacaaagaggagtcatttcctgccttggtgatactatttttttctactaactcaagagtctttattaaaaaaaaaagttgttttgcctaatttcagcttttagcaagcttcccatctgtaaaatgatttggaccagatatttctagagtcccctccagccataacattctgtctcaaattaagttccaaccagcagaacactgacaatacttaggaaagtattttgccagtataaaatgtctttaacttactctttgctgacactgatactttcctctaatttagtgtctatcagctgggtcacatcttaagtaaaatgagcaattttaacccccaacatttggcattttgtcataaaccagccagttattttatgctggtcat

SEQ ID NO: 774 - DNA, 56375 bp, Human
aaatgtatataaaataaaatcacaggatagcttttacatcagagcagcaaaactggcaaaatttaaaagcctgacattaccaaatattggtaagaacatgaagcaatgaaattcttttcctctaaaggacatagctatggaaaaaaattagggcttttctaatacaattgaggatgtacctacccaatgattctgcaattccgttcactaaatggcctctgaaatactcgcacaaaaggacattaccagaatctttgcagcagcaccgtttataagagcaaaatataaatttggaaaaacttaaatgttcgaaggagatgaatacatttaagtttttttttttcaaggtaattgagaacctgcagtaaatattatggtttcctgttatttttaattgctaagtttacaatacccggaatcagttctgccttcaaagccaagtgttcattttccacgtatcaggaaacacatttggcatagagaccatcccaggaagttaaatttcagattctcagaattagtagcaaagtgcaatgtcagaagtgtccagtgagaggcactgcaggggactgggatggcctgtcttaacttcatacattttggggcaacaatacccattaaacttggcatatatactagtcctcaggctaagaaataagataggacacaaatgcatctattcataaagtgaaaatgaaaaaagatagcataaagatttagaaatacctttcaacactgctcatagaaataattctgaatgcaaatcatatgacttttataaaaatagtaacacttttgttttgttttggatgaggacataaacgctgaagaatatacatatacagaggaacctcgtttactgctgatagtaggggaaataaataataatctctatttatagcttaagaaagaggtcctcaaagagtgggagccctatgggtccctgagagacccttcaaaaagatctgtgaaatcaaaactatgttcatcgtaatattaagaccttatattccttttttattctcattctctcattagtgtatggtggaccttttcagaagctatatgacatattatatcatgacactgattgcagaagcaagtatgagaatccagtcatcttctagtaagccagacatcaaagagatctgcatctatgtagaacaatgccgcttttctcaataagcctgttttagaaagtagagttatttttcataaattgtatgatatttgcgttaacatgtaatgggtttattgtcacttaaataagaaagtaaacgtttaaaaattctccctttaacttctaatgtagtaatattgacaggcataacctacatagacaaaagcactttggaatcctcaatactttttaagagtgtagaaatctacaaaccactgaccttcagcctatcacaggaagctttgctattagcacaattattgcatctctgctcctatggttgcttttgtctcactgtctctgatctttcaaagaccgttgggaagagcttgaccagtaatctattgaatggagattacattttgaaccttttcctacaactcagtgccctgtgggatgactctggggtgtctcctgatggctagggcaacaggtccctgttgacatcaccttatcgggaagttttagacaggaacagtcttcaggctctgaagtacttgaacaccatgggattcctgccttacagaagttaatgagcacgactcaggcagattcataattctccttagaagccatttgggatggcttccactttggggtcattccacataggccaatgcagagcatgcagtaactgctcaaataggatttggaaaggaatgaataattcatttagacgttcaacttggaatagacttaagcagacactcctggtgatgaaggacttagatgccagaaaatcaggctcaaagactttcaagccacttcctagtgtgatgtcacattccttcctacgctccactggggaaggcaggtctgccccgcccacggtggcggggaaatacctaggcatggaagtggcatgacagggctcgtgtccctgtcatattttccactctccacgaggtcctgcgcgcttcaatcctgcaggcaggtagacaccgggccgggagtctggctgagccaggcatgggtggggccctgacagtaggagaggtgtgcaggaaaagacgtggcaacaatgtgtgccaccgcaggccagggatcaggccccccaggccggcccccgaccggctaggtgaccatgggggagccgactccgtctctgggtcgaggagtggagctcgcggctattttcagctccagcggctccctgccttcctttctcctttcccgctggcccttgccaggtaggcctgccctggctgctccccagtgagcgggtgtttggggtttctgtttagaccgccaggctcgggtggatcccgaggacacaggcgcgcaggggaggctccgtgcgccgcgagcggggttggggtcccacgtctggaacccaggccgcaggctgcgctggggggcgccctggccctcacgggggctctggacaccagcctgcttcgctgtcaggtggcagaagcagctaccacgcggtccccaccgccgccgccgcctactcctcgcccatcctcctctgcggcggggcgagctccctgccctggatcctggtcgggcgcccagacgaaggagacaggggaagggcagtctttggggaaacgtggggccaaagtcggagggctccccaggaaaaagggaaggtcagcggcctgggcggttgtctttgagattccgaggtcgcccacgccggcgcctcgggcccgccctactgcgtcctcccctcccaccctcttctcccttccttgcagcccggtttggggatgtggtccttgctgctctgcgggttgtccatcgcccttccactgtctgtcacagcaggtacgttccgtgtgtcctccgttcccagaggctgcccgagtccacaggctcctggcctgtcattgggagcccccggggatcgcgtcagcccgagcgcggctccttcccctccccagaccgccaggcggagttccgcggaagaggaaacagagaaccagctccacgtgctcggatgctcagccctgaatgtcgcctttgagcttggaggtgacttcggggaggggaaggagttaggcaaattccaagtgaagacttgagtaacaatgctcaaatggaattactacaggctattttataagataaagcgttattttatgacacaaggtgaaagcaaggaaaccgtcaatagaacaaatttcttctaagaaatttggtatggccgggcgcagtggctcatgcctgtaatcccagtactttgggaggccaaggcgggcggatcacgaggtcaggagatctagaccatcctggctaacacggtgaaaccccgtctctactaaaaatacattaaaaaaattagctgggcatggtggcgggcgcctgtagtcccagctactcaagaggctgaggcaggagaatggcgtgaactcgggaggcggagcttgcagtgagccgagattgagcctctgcactccagcctgggcgacagagagagactccgtctcaaaaaaaaaaaaaaaaggaaatttggtagaaatgaactttaaaagtgaaccaaattttttttcttaaacaatcgttttgggatgaaataccttttactcaagacagagtaaaataactgggtggcagagcagaaacagaaaagacaagaagggttgatttactctgtaggtgagtacagagtaaagaactctgtggatgaaaagaactaagggtcgtagaatagaagggaaagagggaaatcactcccgatggggaggtttgtgaggagggaacggagtaaattctgttttatggatacatttaaagaacttggaattatactttataatcagcaggctatttttaggaaacttccagactcaagaaactcccaaataaaatttcaaattggctggaaaattgaagaggcatttaaaaaaactaacagtaaataaaactgaagttttctttcatggataattgttttgttttgtttttctttccctagatggatgcaaggacatttttatgaaaaatgagatactttcagcaagccagccttttgcttttaattgtacattccctcccataacatctggggaagtcagtgtaacatggtataaaaattctagcaaaatcccagtgtccaaaatcatacagtctagaattcaccaggacgagacttggattttgtttctccccatggaatggggggactcaggagtctaccaatgtgttataaagtaagttcctaatttaaaatagaactaactcgtgtgtgtatgtataaattattttaggaaaattcttaacgaacatagaaaactcttgagaagaattatgttgttgtatgtttttataattgctacaagacaatttccagtgaacacatttttaaacagaacagatttgtaaatcatttttggaacctgatatgcatctttccctatggaaatggcacctcagaccagacccactcacaaagtgtgtttgtcccagtattattgctgccatctttctttcctgttttctttttcttttcttttttatttttcttttttattttttgagatggagtctcgctccgtcaccaggctggagtgcagtggcggcgatctcggctcactgcaacctccgcctcccaggttcaagtgattctcctgcctcagcttccgaagtagctgggattataggcgcttggctatatccgaagtagctgggattataggcgcaagccaccatgcttggctaattttttgtatttttagtagagatggggtttcaccgtgttagctaggatgatctcgagctactgaactcgtgatccgcccgtcttggcctcccaaagtgctgggattacaggcctgagccacctagcccggccgctgccatctttcttgaaatgccaaaagtttttgtgggaaatggcacatccagataggaatgagcctcctatgagcgcttttcacgaggaatctgcttaaggcagggagtaagcatggagtatgttccagacctcactggagaacctgtgctaagaaatatgaataacacaggcctgctggtgactgtggtcagctggaaaacacatgcccctcaaaggtagctgtctattcaggtcaagcccatcttctcacttttcaagggaatatggaaatcggaatttgtgtgtgcaactttttataatttgtaaagctttgtggggcctgaataaaacacatctgtagaacaaatttagcctgagggcccaatttcgtgactttcccacactggcttgcatgaccttaacaaattacttgatctctctgagccttggtttttttctgtaaaatggaagtaatgctggcctgataggcttgaggtgcaaattaactgagatcaggtgtgaagtaggtactccattctctcgctcttgttttgattccgcgatatttgccagcccctttctgtgtcccagcatggcccctgtcccactctgattgctgctagattcctcatttctaaacaccagacagactaaatgcacaaaattgagtggttcacaagtggaagtggtcgttagctctgcctggctcctttccacagatttagttgctaataaaccgctcagggcacgtggaggtctgctgtcctattttagcctaggctgtgaattattaactagtagcctaggctgtgaattattaactagacttgaagatcatacatcacataaatgaatctggatgtcgaagctagacttaaactatttaaatctgggagctgtgaaatgaggaaaagtaatctttaatagaaattgacgaagatattatctgccatgaaagaaaatgaacatgaattctccaagacttttattactaacatccagataggatacgtgtttaggaaactgtatatttttactttttgctttgaaataattttaaatttaaataaattttgcaggaatagtatcaagaacttccttctaccctttatctagattcctcgtttttaagaatatatttttacatttatcttataattttctctttcacaatatatatgatataaattacaaacaatatttttctcctaaaccattttttaaaccatttcagttgaaaaaactgaatactgccttagcccttaatcatcataccctcttagcccttaatatttcaatgtatatttcctatcaacagtgtatgtttcctatttcctttcaatgtatatttatttatttcttacataatcatagtatagttatcaaattcaggaaacttaaacatcatataataccttaatctataatctatattctaatcttatcaatgatctcattgaagaccttttataatgtttttctttcttttccagtacagttaccaatctgggatcatgcattgcatttggttgccatgaatatttaatttcttttaatctggaacagttcctcagtctttgtttttcatgatactgacatttttaagaactgtaagcaattattttgtattacctccttcattggggtttgtcaggtatttcttcatgagtaggttcagccattttggctggaatgctaggtgaggctttgtgtcctcttcagaatattactcagaggcacatggcgtccacttgcccctagttggtgatgtccattttgatcactcagttaaggtgttgtccagttcctccactgtatgaataccatttgtccttttgtgatgaatcatttgtggatgcttagtgctttgttagaggcagagggtttgcacagtgctgtgaaaatgatttgaaaacatttgaaaatgagtggaattatttgattttgtgatttgttttaaagagtttatgaggtctcaatctgtcttacaggggtagagacagctgtcatagaatacatgtaaacctaactgtttttgaaaaacattggtgtgacacttccataggtggtttaccaaatttatcagatgagtacaagcaaatattacatcttggaaaagatgatagtctcacatgtcatctgcacttcccgaagagttgtgttttgggtccaataaagtggtataaggtaaaaaagaattttcttattgatatttttcctccttttctttaaaacccactgttttttataggttaagttgtattttttaaggcagaattggtaaagaaagttgtgtgcctaagatagattagttagctagcagtcattgataacgttaccttcctaattactgtttttaaacatttttggttattatagctttgtaatattttattatttggatccaccaccttcctccagttattcttatttttcaggcttttctttatttttctaacattaattatatttgtttaaatgcatactatgtgcacatggttcaataatcacaaattctaagaggtcaccccctggaaaacctctttcctgctaccgttccatatttgttctgggctcatcacaccttcctcaactgtggctaccatgattagtgccctgtgattattcttgtatgatgctatactagcaaataaaaatatatagtctagctctttctagcccttccttttttacgctcatctttctgcactttgtgttttcatcttcaaaagttctcttttcttgatgatcctggcatatgttgacatagaaggtaactcttggcatggaggagcacaggctagtcatttgagattggaattagtttttcctgcttgttaacgcctgccagcacacccctctgggtcatgagttttctttatgggaagattttcatctattgattcaatttctttaatggtgaaagaattacgcaaatttcttactttctcttgtgtgagtttggtaagattttgtgtcttaggaagtttctcatttcattaaaggtctcatatattctggaaaattgtttagcagctcttctcttttaatgtctgcagacatcaaaaccttcaaagtaaggttcaccttcagtcattattcattctctcttacacacatacacacacacgtgcacacacacacacacttacttgattagtttcatcagagacttgtcagttctagtactcttttcaaaagctaacttttgactttgttgatcctttctgttatatgtttcatgttcatttaggttgtttagtttccctcttttacaagaaatgtggaagtgagtgtccttatacctgtattttaaggcacgtttgccagtgaatgcattcctttaagattactagccctagaattgctcatttgtagggcatgcagatgaacaaagtattcaactttgttgatgttacacaaattgcttcacagaattttgtatcagtttatacttttgccaggagtattttattttactttattttatgacagagtctcactctgttgtccaggctggagtgcagtggtgtgatcatggctcactgcagcctaattcctgggctcaagtggaagcccaggtaattttttaaattttttgtgtgacagaatcttgctatgatgcccagactggtctcgaactcctggcctcaagtggtcctcaggccttggcctcccaaagtggtgggattacaggcatgaaccaccatgcatggctcaccaggagtattctagatttcctacaaccttgtgttgaactttgtattataagccgttgatttttaaaatcaatttggtgggtataaaatgtacctttttattttattttgcttttccttaattattagtgagattgaccacatttttcagtttattggccatttctggatcctcttctgaactgcccactcatatcttttggtatatttcttattttacttttcatgccattttcttgtgacttataggagattttatatatttatatatcctgggtatgattgtttgcaatgcattaaaaaaaccccttttcattgaagtataacgtatacatataaaatgcagaaatcataattggacaagcttgttggattatcagaaagtgaacataccttttaattaccctttcccatgaaagttaagaaagaaaacattactagcacctccgaaggcccacctcttccatcttgcaaaaactatgcctccctagtcccccaaataaccacttccctgatttatgctatcatagattggatttaccagtttttgaattttatttaatttgaataaaatcatatgtagtgtttatgtctagcttccttggctcaatagcaaaacagtgggaatcatctatgctgtttcatgtggctatatttcatccattttctttgctgtgtactatttcattattattattgttagactcttgagtcatttccaacttctgggtcttagaatcaaagctggtatgaacactttcctcacttatgaatgcaattttgtgggacatattacatgagagtgaaatagttgggtcataagggtacgtagaaaatgccaaaccattttccaaagtggtgccaattaacagttccagcagcagtgtataagagttatttatgcccctatacctgacaacacatggtactattagtctttttaatttttgctatttggataaatgagtaattgtgtctcatttcagctttaattaacacttccctgattactgataatgttgatcttctttaaattttcttattggcacttggatgtctgtgtgtgtgtgtgtaatttttttctttgagtgcttgcttgtgaaaattttttttgagactagctcttgctctgttgccccggctggagtgtggtagtgcaatcatagttcactgtaaccttgaacccctgggctcgagtgacccttctgcctcagcctcctgagtggctgcgggttaccttgtccaggaggtatcatttttttttttctgtgaaaagccaaataataaatattttaggcattgtaggccggatggtctctgtttcacccactcaactctgttttggaagcacaaaaacagttgtagacaatgtagaaatgaaggagtgtggttgtgttgcaataacattttatttacaaaaacaggtggttagccacatttggcccgttgtgtggtttgctagcctcttgtctatttctcattgatttgtagtagttctttatagatctggatatcagtaattgttacaatgtgtccttctaagcaatggctaacctttctactctggtaatgaggtctcagacttcctagttttaatgcagtctgatgtattgattttcctttgtgattagtactttctgtgacttgtttaagaatctttttcctacccctaagtaaaaagaccttttttcctatattttcttcttgaagtttcattgtttttctttttccactgatttttaagtgtgtagtgttggtagggtcaaatgtaatttttttctctgtggacttatagtttacctgttcttttcacgttgctttgcatgcaacgtaaatcatattggtctttgtgtgtagatctgtttcagaaccctctgtagcattcccttattctatttctttctttctctttctttctttctttctttctttctttctttctttctttctttctttctttctttctttctttctttctctctctctctctctctctttctctttctttctttctttctttctttctttcttctttcttccttccttccttctttctttctttttttttttcttttttcagatggagtctcagtctctctcctaggctagagggcagtggtgcggtcttgactcattgcaacctctgcctcctgggttcaagccattctcctgcctcagcctccagagtagttgggattacaggtgcacaccactatgactggctaatttttggtatttttactagagacaggatttcaccgtgttggccaggctgtctcaaactactgacctcagatgatccacttgtctcagtctcccaaagtgctgggattacaggtgtgagccagcgcatcgggcccttatgcttgttaattattatggcattagataagtcttaagttttgtataagtcctctgcttttcctttttctgaaatgttgccttggctattctaacttctgtttctgcagcacttggagatggactcagggctatgactagcaatcctaagtgagcatcggatttgatcctctggatcttttaaaaattctgatgttcagcctcaccttctgctaactgaagcaggtcacccatgggtggcgcttagatgcctttattttaaaaacaacccctgggcttgcaaatgtaggcaaaagctgagggtcagcagtgtaagcaggaggggtcacctgatactataccacctgctcagatttggtgatccaggtatggctgtttttgccactaccatgtgctcagacctggaatcactctttgggcctcagtgttgtcatctgtaaaaccagagggttggaatcaattctgcaatatctggagtctgtgatcttcttggtgctgtgccaagggatgtcatatgtcttcaaagaagttacaatttatcagaggaagcagacaagtaaactaagaattttattacagcatgaggtgaacataaagaaagcaaaactagagcagaccctgggaatgtccatggctatgcttcctggaaaaggtgactttgaactgtgcttgaagagtgaacacagttagcctggtgggtacggcaaggaaggtcagtaattagagggaagcagcaggtgcaaaggcgttgggtgagaaagagaatggtgtttgggggccttggttagagtttagggcacatgtagaaagatggtgctagaaaataaacaccatttatgccaacctaaagcatttcaacagtgaatcctaccatcaggagaatggcatgagcaaattcacatttgagaaaagtccttctgtggggctatagtgaatacattggaaggccttgagaatggtggcatgctgatcatttggactatcctagaaatcaagttaagaagtgcggttcatttcagaaagttataaagtagaactgaaaaattagggaaaaggaggaactcatgtctgagggcccctaatttttctaattgtaaggagatgttatggggaaaatttgaaagagtaatgtaagtaaatagatggagatgtaatgaatttgtagtggtaccaagacccctgtttatgtgattatctcctatagtgctctgctctctggttgaaggcttgcaggagagggatgaagggatccatcagaatgggtctttgcaggtgaagatgctggaaggacggagggctgcagagttgaggtactggaagggaagtgattcaagtgatggacacgtgaatccaggatggacaggaaaggaaatgatacctgaaagagcttggaaattagacaaaagtagagaggtcaggtgggctaattccagttaagatagaaaagtgagttgaatggatagaaagttcaggtggaaaagtgtaatgcccatggtgagtctttttatcctgtagaggccataaaactaaaaagacacaggaacaaaatgaccataccaccttacattttgctgagtcacctactgctaaggctctggatggaattccatgtctccagctggctttgctgaaaggtaaaggtgaggatggaggatcttcctgctctttctgctggaaagcagagccctggagacacggaaatttctccagcagcattgaagtgtccagtctccagttctgtgggagctgagtattccactttatttgttggggtggctcttcctgatgtggcattacttgacacactggagttgcataagcggcaactcctggtctctgaattgcaggtggtgtatttcagagttgattccccactttccagattgtggtagaggtagcggctctcagggcaagctacttctgcagtgtggttctggcctcgatgccacttcctgagtactttcacagatttagcaaagcacctagtatcttgtcttgaatccttttctgcataaaatatagaatgatttttgtttgctaaatccagacagagatatatggcttcatggctctgtttcaaagattaaatgatctaatctatccacgaagcatttagttcagcatgagtacataataggtacgtaataaataaatattagagattattatgttacaataaaggaatgaatgagctggaatagggaatcagtcagaaagtaataaatttaattttaagaattttgagacagaggttctggataatggcaaatccctacgaaaatcctggcttacgtctgggagaattgaaaactgaaagtccccaggaagtctttgaaattgaagagcttacagaggacaaggtttgggtattaagacatctgtctacacctggaaaagtggtaatgtccccaattttgtttttgtttcaatcccaaattactcctcagcacagtggttttgggtccctatcactgtgctcaatctgaacttgctgaagttacttcgcgctcttcagttgctaaattgacattcattttcaacctgattgtggcattcaacattgctgggcactcccatcagctaggaactcctttcccatttccttctaagacttattctttgtctctgtttatcttttttatttttatttttttctggtgcttcctttgtaatcatcactgagttcttttcctctatatttgggtcttaggatttgaggttccccatggtttcagctgcggtcatcttctgtgctcgcttttgcttacattcaagtggatgatttatagaaccatccgtttggctctatattctccatatggctcccagttctcttccacttggacctttcttccaatctccagatttctttgtccaaccgtctaatgtacagtctccttagaccctcccatccccaccactcaccccatgcaccatggttagatctattttttaatcttaccctaaataggatcattttcttcatttctttgcattccttcttcttcttagtaacacctttgcttacctaagactgtagaagtcctgctccctctgcatattccaaatttgtcactaaattctgtggactggaactgcttaaaataattgttttttgttttttacttgctatccctacttccctgccttagtttaggttccatttggtctcagtttatggaaataaaatctaaatggtctttagcattgcactattttaatcctttaaactacacagcaactaaaggatctttctcaaaagaaaatctgattgtcttattctcttgctcagaaagcttctgatgctcgtctcctcttcatggttttctgtgacaggtctcctgactgcctcaccagttttatctccatcactattctgtacccactgcatcttagtaagaattctcaaggctattttgtgtttctgaaatattgtacatgctgggtcaggagttttcttcacgttgcctggaatacataaggcattcaaaagtggacgctattgttcttaacattttaattttaaatcttgttagtgagacattaccctaaagattttaaatttaaatccaagctcattgagagtttaaactttgaaataatgttccagtggatcagaatagaggtagtctaagttatagcaaagcgacagaatggccctcagctgcaaggctgaactttaagatgattaaaatatgtatatcttgaaagaaagaatgaacccatcagaaagaggactgctcagccatggaagcacagcaagggaggcccagagactgtgcctagccagagactatccagggcagcctgtccagggaagaggtttatgaaatgtgaggactagacattgtactttgtttgggctgagttcagtggcttatgcctgtaatcctagcactttgggaggctaaggtgggcagactccttgagctcaggtgttcgagaccagcctgggcttcatggtgaaaccccacctgtactaaaaaaacaaaaaattggggtgtggtggcacgtacctgtagtcccagctactcgggaggctggagtgggaggatcccccaagctcaggaagtgggcgacagagctaagaccctgttccagaaaaaaaaaaaaaaaaaaaaaagtgcttgtctgtatcctaaagaaggagacatcacaatatcagagtctgatccctttatacatctaactctgattagtaattcccattttgtttgataagcagttgtcagattatgagttggtttcccatatcaggtatttatagggaaataatgtaagccttataggaagtagcatttcacattataaataaaccaatgcttgtttggcattaattatttactgcatcctgctgggcggctctattcatgctgttccaggggtggagaatgaagtgtgactctgaaccatgcctaagtgaggagagagcctaacacttgggcaggtaaatatttatttaattaggagtttgcatgttgattttatcttttagattgtgcacttcctgaggagagggattgcatcttagtcctgcatggccaggcctgtcacagtgcaggcaaactgcaggaattcaaatgtttgaatgaacaaatggactcaattagctaagcagtcactctgtggactgcagcttcttggaggacagggagcaggtttgggagaattcagaaggtggcccaagggatggaagaactggtgattagcatgagaatgtgagcctaggacaggacagagaaacagtgaggcttgccctctgggtggttgctgggagagaaagcattcctgagactcactggtcttctggttggttgggtgtgaggttgttgccttgtccatggaggaggcatgggaagcgggagaagtgatgtgacatctgcccaccataaacctggccagcttcctttgatcactgttcagaccttcaaattggatgttggtgaagaattattttggacttctataaagtccaatgcttgataagtgcagaaagtgtaattgggcccgcaaggcagtgggagcagttgttattcacctgggtttccagtcttggcagagggtcttgggccattaagcgggagtccactggcagacatgggcccctgaaggtggaggacattcctgcctgttcatgtcctcctgcaaaaaactgacccaggctcagttttcctccatgaagtcttccttccaactcacgtaggccactctcctctcaagtcctactagacttattgtttgtatcattcacttcagcctgtaaaatatcctttgtcaaatctgtgtatatctatatacacacacatgcacatatatatgtacacacacacacatatatacacattatatacagactaggcagggaattctgctgcctatctatccatctatcatcaatctatcatctacctatttttctatttacctagctagctagctatctgttgtcttccagttagactgtaaattacctaaatactagggatcacacaggtttctaagtattcattgaattgaattttgtttttatttgtattaggactgtaacgagattaaaggggagcggttcactgttttggaaaccaggcttttggtgagcaatgtctcggcagaggacagagggaactacgcgtgtcaagccatactgacacactcagggaagcagtacgaggttttaaatggcatcactgtgagcattagtaagtatgctcatgtatgcctgtcgccttgtattctcttggctttgtgtgaactggcttctggctttgggttttgggctttgagcaggagtgattctaggtcttggtttccctgaaggctagtaggctctcagacctgccactgttagaatcagaaggtgggaagagtgaggcagaagggcatgagcagcttagtttcctcttctgaacaacagaacactcaaaactcttggttgatttgtgaaaattaaatgagatcatgcacatagactagctgctggggtacctgatgaaacacaagtatctagacaatagtagatgtgatgaacatgactgtcattcacctcagccttcattgtcgtgaatattcctgcgggccttccagctgaggcctcccctgcctcaagtgccgcagagctcagagttctggatatggtcctgggatatcctgctgctcatggacctgtgttctcagcccagagcagccagctctcttgaacatatgcctggaggtttgaaagtagaatcttaggggaagaagaaaccctaaaagtaaattagctcaagccactaatttaatttaatttttttaattttcaatttttgtgggtacataataggtatatatatttatatatagtatgtgcatatattacataataataggtgtattatatatataataatgggtatatgatatattaaacacataataagtgtatatattacataatatgtgtatatttataatccatgagcatagaatattttttcattttttggtgtcctcttcaatttctttcatcagtgttttatagttttcattatagagatctttcacttctttggttaattcctaggtatttaatttcgtttaattcctatgtattttaatatttttgaaatgatgatatggttttatgtgtggctattgtaaatgggattacttgtaaaatatcttttcacattgttcactgctggcatatagaaatgctactgatttttgtatgctgattttgtatccagcaacttcactgaatttattagttctaatagttttcttgtggagtctttaggttttcccaaatataagatcatatcatttgccaacaatgataatttgaattcttcttttctaatttggatgccgtttatatctttctcttgtctgatttctctagctaggacttccagtacaatgttgaataacagtgttgacagtgggcatcctcctcgtgttccagaacttagaggaaaggctttcggtttttccccattcagtatgatactagctgtgggtctgtcacatatggcttttattacattgagacatgttctttctacttccagttttttgagggtttttatcatgacctgctgaattttatcaaatgctttttccgcatcaattgcaatgaccatatggtttttagcctttattctgttgatatgatgtattacattgattgatttgcaaatgttaaaccatccttgcatcctagggatgaatcccatttggtcatgatgaatgatctttctaatgtattgttgaattctgtttgctagtactttgttgaggatttttgcatcaatattcatcagagatacttgcctatagttttctctctcttttttttttttgatgtgtctttgtctggttttggtatcagggtaataactggcctcataaaatgaatttggtagtatcttctcatcctctatttttttgaatagtttgagcaggattggtattagttcttctttaaatgtttgttagaattcagtggtgaagccatccagtcctagacttttctttaataaagagacttctttctctttaataaagatactttattaaaatttctatattgttacttgttattggtctgtttaggttttggatttcttcctggttcaatcttggtaggttgtatttgtctaggaatttgcccatttcttctagagggatttcctattcattggcatacagttgctcatagtagccattaataatcttttggatttctgcaatatcagttgtaatgtctccttattcatttctggttttatttatttgtatctcctctcttttttgcttagtctggctaaaggtttgtcaattttgtttccctttttaaagaaccaactttttgtttcattgatcttctgtgtttttttcatttcaatttcatttatttcttctactaattttgggcctggtttgctcttgcttttctagttctttaagatacatcattagattgtttgtttgaagtttttcctcttttttgatgtaggcacttatagctataaacttttctctgagtactgcttttgctgtatcccatatgttttagtatgttgtgtttccattatttgtttcaagaaatttttcagtttccttcttaatttcttcattgacccactggtcattcagaagcatactgtttaatttccatgtatttgtatagtttccaaaattcctctcgttattgatttctagttttattccattgtggtcagagaagatgcttgatattattccaattttttcagtgtcttaagacttgttttgtgacctaacagatggtctgtccttgagaatgatccatgtgctaaggaaaagaatatgtattctacagccattggatgaaacgttctgtaaatggatctattagatccatttggtctatagtgcagataaagtcagatgtttctttgttgattttctgcctggaagatctgtccaatgctgaaagtgggatattgaagtctccagctattattgtattggagcctatctttctctttagctccaataatatttgtttttatatctgagtgcttcagtgttgggtgttatatcctcttgctgaattgacctttttatcattacatagtgacttgctttgtctttttttatagtttttgtcttgaaatctattttctctaagcatagctactcctgctcttttttttgtttttgattgtcatggaatatcttttttcatacctttattttcagtctatgtgtgtctttataggtgaagtgtggaaacaatcaatgggtcttgttttttcattcattcagccattctacatctctttattggagagtttagtccatttacatttaatgttattattgataggtagaacttactcctgtcattttgttatttgttttctgcttgttttggtcttctcttcctcctttctttccttcctgtcttcttttagtgaaggtgattttgtctggtgatatgacttgatttcttgctttttatttttttgtgactctattgcattttttctggtttgaggtttccatgaggcttgaaaatactattttataacccattattttaaccggataacaacttaatattgtttgcataaacaaacaagcaaaaagaaaactaataaaaattttacaccttaactttattcccctgctttttaactttttgttgcttctatttatatcttgtactcactacaccttgaaaagttgttgtagttattatttttgattggttcatcattcagtctttctaggataagaacagtttcacaccacagttacagtgttaaaatattctgtgtttttctgtgtacttattataaccagtgagttttgtgcctttgggtgattactcattgctcattaatgtccttttctttctgattgaagtactccctttaacatttcttgtaggacaggtcagtagatgaaatccttcagctttcgtttgtctgggaaagtctatttcttcttcatgtttgaaggttatttttgtggatatgctattctagggtaaacgtttttaaaatgtgtcatgccactcctggcctataaggtttccactgaaaagtctgctgctagatgtattagagctccattgtatgttatttgttccttttctcttgctgcttttagaatcctttctttatccttgacctttgggagtatgattattaaatgtcttgacgtagtctcctttggattaaatctgctgggtgttctataaccttcttgtatttggggactgatatctttctctaggtttgggaagttctctgttatccttttgaataaactttctactcttttctgtttctctacctcctctgtaaagccaataacttttagatttgcccttttgaggctatcttctagattctgtatgcaatgcttcattgttttttattcttttttcttttgtctcctttgactgtgtattttcagatagcctgtcttccagcctgctaattctttcttctgcttgatacattcctctattaaaggactctgatgcattcttcaatatgccaattgcattttttcatttccagaatttctgcttgatttaaaaaatcttatttcaatctccttgttaaatttatctgatagaattctgaattccttttctatgttatcttgaatttctttgcgtttcctcaacacagctattttgaattctctgactgaaacatcacatatctctgttccttcaggattggcccctggtgccttatttaattcatttgaggaggtcatgttttcctggatggtgttgatgctagtagatgttcttcagtgtctgggcatttaaaagttaggtatttattgtagtcttcactctctggacttatttgtacttgtccttcttgggaaggccttccaaaggatttgagtgtttcgatcaaagctgtatctgctttagggggcaccctaagcccagtaatgctgtggttcttgcagacctgtagaggtaccaccttgatgatcttggacaatatctgggagaattctctagatatcaggcagagacttgttctcttcccttactttctcccaaacaaacagagtctgtctgtctgttctgagccacctaaagctgatggtggagtgacacaggcaccactttggccatgaccactaggactgctgggtcagacctgaagccagcacagcgctgggtcttgcccaaggcctgctttacccactccctggctactgcttatgtttgctttaggccctggtgctctacaatcagccggtggcaaagccagccaggcctgtgtccctcccatcatggctgattgccactggcaaggtctctcaggccctgggtggatccagaggtgccatctaggagtgagggattagagtaaacaaaccttagaagtctaccaagtgtttttttgtactgcagctgagctggcagtcaaaccacaagacgtagtccttcccactcttccctcccctttccaaaggcagaggagcctcagcatccatagccagtgccacagccggccacaaggagtactgccagactaccgcagattttcccttaaggtccaagagctcttaagtcagcttgtggcaaatgctgccttcctgggactcactcttcagggcactgggctcccttctggcccagggcatgtgcagaagtgccatccaagattcaagtcccagaatcagggacctcaagagcctgcttcatgacctaccctcccctgtggctatgctagtacctgaagtgcaagacaaacttttccttctgcttttctcaagcaaaaggagttttgccctataatcactgcagctaataatgtgctcagtctcacctaaagccagcaagtttcagatgctcacccaaggcattcaatgtaatacctggataattgctactgattattcatggcacaaggactcttaagttagcaggtgatgaatgctgcaaggactgaatcctttccgtcaaggcagcgggtccccttctggcccatggtatgtctgtaaatgttatctgggaggcctggaacaggggcttcatgactctgatcattgttctctcttgctgtggctgagctggcatccaagatgcaagtgaagtcctctccgctcttccctctcctctccttaagcagaaggaaagcgtctcttttatagctgcaaggtgtgcagtctggggtgataaagaggggtgatgcccacactcccttggctgccctagatgggaatactgaggtatattgcatgtcccactccagtccaccgtctctgggcagcactaggactcacctaagagttgcagtccctgtggcccagactgcctctcaagtttacttagagacccagagcactttagcttgtggtggtaagatttacaggaactcaagttctgatcactgggattaacaattccctctgtctagggctggtttaaatgttccctccatgagcccgtggcagctgagtttggtccagttttcctttctgttctaacaagtcagcattgagttcagtgcctcacaattgtggtgtcctttctcctccagcaaccagagacactctcagtaccatgccgccactgtcaggggttggcgagagtggcattggtgattgaggactgctttttctatctcattggtgtccttttctgtgatacagatttaaaaccagatactatgagtgatttttggttcttatgaaggtgtttcttctgtgtagatggttgttaacttggtgtccttgtagaggagacaattggcggattcttctattctgccatcttgttccacattctctccccaagctatacattttacagagttccaggaggggagcaacttattcaaggtcacaaacctggttattgtcagaaacagagccagagctctggcattcaatgcccaggccagcattggtttttccaaacacactggacaaggagttcctgctgtggtggcttttgctctttctttagtagaaagttgttttctatatttactcatctagatgagaagaactaaaggctggatacttctttgatgtagaccttcctatttgtcactagtttccatcacacttcagagtactaggggagactgagctatttctgggtggtgtggatccctatggggatctggtcagcatgggtggctccctgctgcctatgcaggacagggccctttactctgtacagtccagtgactccctgaattccagctgttcttctagagagcccgttctagtcctcctatgttctttgcagcaactgctcatttgatttaaatattttggggtggttttcaattttaattgttcatgctaaaagcacagtcattaagaaaattaattgtacaaggtttttttgattttcctgctcttgggttttctgctgaccattatctctctgaaagaaagcacctgcctcatcttgttcacagttgaatccctggccctgagcccagtgcctggcctagactaggcacagatctatttattaagcgaatgattgactactataatgcattaatgttacattggtaactgaggggaaattttgtaaggtgaaattgctcaggtaaaatgaagaatcccttaagaagtaactgggttcagtagtcactacttcatgttcaataaacatttatttatgatctgttatatgccagtattatggaaggtcctgataattcaaaagtgaaaagcattgtttcttctactatgaaactgtcagacatggtgatggtgaatctaggggttaaatggatcattttaacattatgtgctaagggtagagccacagacagtgtttgcggagcaggaaaagaataagaagggtccgtgggtggcacgcaaatggtctgggaaggcttccaagaggaaaggagttctcagctgaattttgaagaatgaataggattcacaaaagtaaaggagggtgaggaggggtctctaggcagagagaacagagggaacagtataggacaaagcatggaagtgttaagcattatgtttatgttggatctaaaatgactttcattagatcctatgtgagtatggggtggggagggtgggagctgaggtcatggagttaagcagggcaaggtccaggggactgtttatgcataggctttaccatgcagccactgaagggccctgggacggtgcaaatgcagagtcattgggctgcatttgtgatgggagacatcagtattgagatgatttgaagccagagttgaagagggcctggcagcttggagaccacttaggaggctgataaaatatccaaaagagtgctgatagtctcaacttgggaagaggccatgggggagctctccttcaagcaatcatttaagaactctttgctgagtactgaacaaagctaggttctgtgccaggcagagagaacatggtggtgaagaaaacagccacccccactgctctgatgaagcttgaaggctgaaaggaaggcagagaataatcagataattcactaataagatgtgtaattatagggaagatgaaagcgtgaaggaaaggaaaaatctgagctcaaacagaccagggcctcgtgagaaagcagtggctcagggaaagctttctgataatagtgatgctgatggtcaggaagcattatgtggatgatggagttggggagatttttttccagactgaggaagtagcaaatgtgaagaccctggcacaagagggaacttggagtatctgaagagtagaaagcagggctagagtgatcctgaatgagagaaattatggcaggtgatgaggttgggtaagtagtcgggggccaagatcaagtaggaaccagcaattcagagtaagtagtatgaattttattctaagaacaatgacaagcagccagacagatcaaaagcaggagagtagcatgagttgattttcatttctgaaacagcagactggccgctgtgcacagaatgatccattccagggtggatcagaagtgcaggtacagaagcgcaggtaaggcatgaaggcacaggtaacatgatgtcattgaagatggagagatatggatgggttcaaggcaccttaagaggtaaaacccacagatttagtgttggactgaatatggggagaaatatggcaaggtcaaaaaagttaaccaggctttttgacatgcactattgactggatggtgatgctattcagtgaaggaaaatggctctggaggaaaaccagatttaggagtgagatcatgagtttggtcattgctacgttgagtatgaggtgcctttggatggtggaggtccagagtaggtcatggcctgtatgggcatggagcttagaggaaggactggagacatgaccttcaaagtcattggccttgaaatgatatttgaagtagtgggtgtgaatgagattgcttaggaaaataatggaaaatagaaggcttagaagtgaagaaaaagacagactgagaaatgaggaggcaaaagtagttgaatttggtgattgacaagttgaagaaggtgaaagaaaagctgttgcctagaatggcttctggattttacatgtgtgtgatctagtgggtgatgatacattaacaagctggggataacttttgtttgggacatgctgcatttaaatagtttgtggaatgcacatttattattgccatcataaaagatatgtatttttgcatttttcttagctcctctcttacaacttttccatatcccactccaaatatataggaggaatactggaactaagtaggtgatcgctaaattttggcagacaaatgggagaggaaagaagtagagaaagactgaggggcagggagtccagggagtcaatacagggagataatgctaaagtttggtggtaggatgaaagagttagaataatagtagaagaggacgggatataaaataatatggaaatgcagagttggaggaggaagaggaaaactgaagatatgatgaaccctcacagatccctcatccaactttgacaattatcaacttctggatagacttttttcatctttacctctacccattcccaccagttcccaagattattttaaagtaattcaaaaacatgatatgtatttttccatctacataacattcttataaggacaaaactatagaaataggaaacagattaatggttgccatggaacaggaactgcatgagggagttttttgaaggtaaaacaagagggttactatttctctcaagctagcacctaagccaggcctttgtctatagccactgcctgcaaagtgtttttggattattaagtattgagattttattataaaagcttattagtttatattataaagaatatagtttatggtttataccaaaatatggccaaaatgaactctcttgatagctcagcttctagcttattttttttttcttttttggcaattcagttacttctggttgaaaatgtgtatttatggagtgagattttgaccagagcttattgatggtctgctctgttgggcttcatgctattacatcaaagtacttgggaatgtatcatacgtgattctaatgcaatttcctgtgggtatgatttcttagcagaaagagctggatatggaggaagtgtccctaaaatcatttatccaaaaaatcattcaattgaagtacagcttggtgagtaaaattattgaagccattgaaatcaccaggggaagagctcattatgtttgcatattctggtgaatattttgaatgttaaggatgaagataaatcctatacacacccagtttccagctttggatatacgtgagctcatggggagaggaatcaaaataaaacaccagagagccgaagcgtggaaaagttgtggtagcagagaagtctggcaatgaggactatgggcccaaaatgattattataaatctgtttatgcaaaggcaatgaaaatgcaaataattcttcagacaatacataatataatataaaactactattaaataatgttgaccaggagttctggattatattacctcacaatgcaagatatattacaggagtgaaaaaaattatgatgttatattccttaatctatatggaaaaggatcaataagcattgcctcaatttgtgatctaagtagataaaaaggcatcaaattactttttaaattaaaaaataatcactagtggccaggcacggtggctcacgcctgtaatcccagcactttaggaggctgaggcaggcagatcatgaggtcaggagatcaagaccatcctggctaacacggtgaaaacctgtctttactaaaaaatacaaaaaattagccgggcatggtggcaggcgcctgtagtcccagctacttgggaggccgaggcaggagaatggcgtgaacccgggaggcagagcttgcagtgagccgagatcgcgccactgcactccagcggcgacagagcgagactccgtctcaaaacaaaacaaaacaaaacaaaacaaaaaaaatcactagtaaaataaatatgttgtattacatctgaaaaaaaagcaaattagacaaaaatctcaagatctcacaaaatagaaagttttatgtgtcttagtgtatcaaactatataatgctaaaagtctcagaaatacaatacaacaaaacaacacaattgtttcagttgtagggggagattttaacatactcttgctttgagaaatttactaggaaagtaagagtctacatggttcgaggaatatagtaaaagtaatgtgtctaatacatagatcactctcagaaacatctatgaaaaaccagagtccaaaagaggaaattgtacagatcatggggtataataacgatacagtaaatgtaaaaatttatatctaaaccaaaacaataaaataatcgcacttaataagtatgtgaagtgacggatttgttaattagcttgatttaattattctacaatataaacatatatcaaaacatcacatcgtacccataaatatatgtaattattatttgtctattaaaactaaagaaaaatttaaaaacttaaacaacaacaaaaaatctcttaattatttgcatttttgattagagagccaaagccatagttaaagaatatttagaaaataatgatagtgagaatacgtcatatcaaatttcatggcatatgaccaactctaaacaagtttatatctttaaataacattattattagtaagtgtggaaataattaaaatatacaactaaccatttgactctataaaaggaccaactaaacaacaagaatagaagtagaaaataatgaatttattaaaggaaaataaactaatagaatctgtcccagagttggttaagaacagaagagttgaggtgggggttggggagaaagttaaacttccagcaaatctaatccccaaagtgcagagacacccaaatataaaaaaattagaaatatgggaaagcttatataaaacaacaaatggtaagagataaaatctgtttaaatgcctctaggcccatatgattttaggataattcttttaaactttcaaggaaataataatacctataataaaggataattgtctacacattactcattatgtgaatagtcttaaaagacaaatttggctgttttatctctcttaattgactttctttctctactcctgtctttggaaattctagccaatgtatttagacaattaaaaggcaagagaaggagttttggaagtcttggagggaggaagataaacataacttttaaaacatgatctactggtttctacttagaaattttgagaaaattaagtaaaaaactataatcactagcattttcttattaatgttattttaatacaaaataaacattcaaagctaatagcatttttacatgcctgaaatagcatatattatgtaatcagggaaaacagcattcacaattgcaatacaagaaataaaacagtaaggaacaactgaacaagaaattaggaggacttgcctacatgattaaaaatgcagcattttatcattttatagatggaacataaaagaatatgtgttttagtgaaatttcaaaagatgttcctaaatagaaacactcagtattaaaaatgttatttctcttagattaatatacaagtttaatataataccaattaaattaccaaatatcctaaaacttgtcaaaacatgtctaaaatttctgtcaaaaatgctggaaacagttagccaagaaaaaattgaatagaagaaaaaagagccatttccttgtaagtattaaaatatattataaagatagagattattagtatgtcaacaaaattgctgactaggggctcctagcactaattcccgtacaaaagggccaaaatataaaataaatagctacattttgactagcgtgtctgaaggagggcgctggagtgcagcatggaaatgatggaatccctgtggagcacagaaacccaggatggcagcatagagaggggaggaaatcaccctttctctgtcactctgtttcccccaccaagattgacttggagccaagagaaacttctctttgcagggaaaaggtaagcagaaggcctctgccaccttcattattaccacagacacctgcagttcttgctacagaagaaagctgcagtcctcacaggtcctgagcccagtttggggagcagcctggagttctcatggctatattgctccagtgcaggaaactacattgtgcatacccttatcccctatgacccacgctgctacatcatgccactgtcttggaattatagctactgctagagtgagtcctgttctgggggccagtagccactgcatctctccatccccaatgctttcccgtcatttcaccatgttcatacaggtggctacaactccaaaatcctggttacttagagtatgggccctatgaaattactgtgatcctggttcccaaatgcacatggtgccctgcttcctgtatggacaggcagtcctgcacaactggggaagctttccctagccagcagacctactctgctcaccctcatacccatgagggtgtacatactcaccctcatcctgagaaccagcccagtagccctgcacctggcaagacgacaccccttttccattggacctactgtgtgtgcacacacacccttggcctgagaaccaacatggtagcccagcaccctgcaaagccatgccactgccagtacaaactcctgcagcctaggccactgagacactcaaagatactgcagatgtggattgtagctgaagaaactgcatgaagactacacttctgtctctgtctagaaccaaagccaacataccttatccaactgacatgctaggatgcatctacagaaaaagtctttctctaataaagctacttcataaaattagaagaggtgactgttgcaccagaagtgcagctatcaacataaggacacaagaaacatgaaaaaacaggaaacatgaaaaaacaggaaacatgatacctcaaaggagcacaataattctccagtaacaaacctcaaagaaaataagatttgctaaatgcctgaaaaggaaggaatccaaaataatgatcttaaggaaacccagctagatacaagagaatacaagcaaataatttaatgaaatcagaaaaacaatttatgatctgaataagaaattcaacagatagatattataaaaaagaaccaaagagaagtctgagcttaataattcaatgaatgaaataaatgcaattgagaattcaacaacagaattcaacaatctagtgatcattatataatgaccttctttgtctcttcttataatttttaacttgaagtctattttatctgatgtaagtgtagctactcctgcttgcttttgttttccatttgcatggaatatctttttttcatctcttcacttttcgtgtatatgtatccttactggacctactgtgagtcagtgagtaagtgagtctcttttaggcagcatatagttggttcttgtttttttcttttaatccattttgccactgtatgtctttgaattagagaatttaatccatttacattcaagattattattgattggtaagaacatgactcctgacattttgttatttgtattctggttgttttgcagatcctttgcttctttctttctctcttgtttacttttgtggtttggtggttctctgtagtcctaagctttgattcctttctctttttattgtgtatctgctgcagtttctatcattgtggctaccatgaggctaaaataaagacttttatggttataataggctattttaatctgattacaatttaactttggtcacataaaaatacccttgacttttattgtccccctaacagtttatacttttgttgccttaattcacatcattatacattgcgtgttctttaataaccaattgtgtctgtagttatttttgaccattttgacctttaaacttattactagagtcttgaaagatttacatagcgccatttcagaattgagatattctgaatttgattttgaatttatctctactggttagttttcacatgtttttatgatggtaattatcaccctttcactttcagttgcagcatttccttagggatttcttgtaaggctggtctagcagcaatgaattcccttagtttttgcttgtctggaagggactttatttttcttacatttctgaaagatagttttgctgggtatagtattcttggatagcagtttttatttttgttcagcactgaatataatatcctttgttcatgaattggaagaattaatattgttcaaatgtccatcctactgaaagcaacttacagattcaatgcaatccctactaaaataccaatgacattattttgacagaaagagaagaaacagtcctaaaatttgtataggaccataaaacaccctgaatagccaaagcaatcttgagaaaaagaccaaaaggcccaaaaccaaaaacaaagctggaggtatcacactacctgacttcaaaatatactaaaaagctatagtaatcaaaacagcatgatgttagcatgaaaacaggcacatagatcaatggagcagaatagagagtccagaaataagtccacaaatcaacagccaactgatatttgacaaaagtgccaggaacacacattaaacaagtaacagtctcttcaataaatggtgataggaaaattggatatccacatgcagaagaatgaaactagacccctatcttttaacatattcaaaactcaacttgaaatggattaaagacttaaatataagcctgaaactatgaaactactagaagaaaacatagaggaattgctcatgacattggactgggcaagatgttttggataagatctcaaaagcacagacaacaaaagttaaaatagacaaatggaattacatcaaaccaaaaagcttctgaacagtaaaagaaacaatcaacagagtgaaaacataatctacagaatgggagaaaatatttgtaaactgtgcatctgacaaggggttaatatccagaatatagaaggaactcaaacagctgaataacaaacaaacaaacaaaaaacaaaaaacagaacaacaaataatttgattaaaaaatggacagaagacattgcttctgggattcagacaatatcctgttttcttgatgaggtgaaagtgttacagatatttgcttatgataattcattaacttgatatttctattctatactgtttggtacatgtgtgttatatttcacaatcattttttaaaaaaatatcatttagaataaagaacactccttgaatgttagaatttactaagctcatgggacaaagtccactgagactataaattgatgaaatttgtgaatgtgtgtagaggcaagataagggaaagagagggaaagggtgggggttacatttggtgaagcagaaatatcactggatttggtgttagaaatctagagttcatatttcatttcttcctctaattaatttgggcaagtcactcaatctatctgaacttcagtttttgcatccttaacatgaggataatagcccctccccttttcctgccttgtaagattgttttgaagattcaaagactgaaggataaaatgcataaaatactttgtgaactgtcaagttctttgctagtgttactaggagtagaaatagcatttgtgtacctgatgatgtttggtaatgcatgtgtgtccctttacaatggttgtcctggaaggccacttgccccttgtggtctctctccagggaaagaaaaaagtagattaacatttgcctagggggctatttctggtaatcaaaaggtattcgaggctcgagagtacgatgcacttgtaatccagatgttaacaaatttgaaagtttgtagaattttcattgaatattgatgatattggttttttttaggtaccactctgattgtggactgcaatgtaacagacaccaaggataatacaaatctacgatgctggagagtcaataacactttggtggatgattactatgatgaatccaaacgaatcagagaaggggtggagtaggtgttttgcttttttgacttctctaaacgctagcaaggatttctccatctaagtgaatctggtatcactactgccttctcctcttgtttttgcctctcaatgattcatgttatcaatcccacctatcacatagttagggagatatggtaaaagaccaggtatccctgagagcagtaagatccatttctcttagctactactcaaaattagtcccatttccattcagttatatcatgagccatcggccttcaaagcttaatgccccgggcatacaaagcaaacactggaaatgacacaaatgtgtatattgcaacagtagaagaaagaaatagtagtatagttctttgctatactaaacaagcgccaatggggactcttagggaagacagtgcataatcattagctaattgaatgggtataaactcaagttatggtggtataaatggagtggtgtaaataaaactaatgaagtcagagggcaggagagcttgtgttgggcctcgcagtatggataagttaggatacttggagaggaataggggaaaggcctttggggctgagaatggtgtctgtagctaacagaaccatacttccttgtcaccatgcagaagaaaatgcaaatttgggaatatacaatctacaaacctcactgggccagtcagcaaagtatttttaggataacatgatggcccaaagtgttctcaaagaaaacactttatctccagaaaacagattataaaatatgttgggtaaatctgactcatgtattaatgacttactcttttcttttatagaacccatgtctcttttcgggaacataatttgtacacagtaaacatcaccttcttggaagtgaaaatggaagattatggccttcctttcatgtgccacgctggagtgtccacagcatacattatattacagctcccaggtaatactccagtgggttacacactgttcagagtgttcaaaacgatggccaggaaacacatctgaaggagcagtgactctaaatgctcagtgtgaggcatgagggtgatattaaagggacaaactcagtatgaaatctagggaaaatctcatgcaacagctcataatgttgttggagtgaggctgtgattttattgcagtatattttgaaagtgccatattttcaatacatccagattttatacatcaaaacagaaagaaaacaaaagcttttctttattaagcgtgattgccaaatgttttgcttttgattttcaacttttagatttagtataaataatttgatataaagccaaaatgcctatgtatatttttaccatggaactttgtaaaattatctgtagaggctgaattctgatatttaagcaggagggcttccaactcaatgtgtgtatacgaattgcactctgagtaccgtacagaactaattgattatgcattggaagtaataaagtcagtgaaaagatagtggagggtgaagccagaatcaggagaacaactttaaattcgtaacctatcaggggaggtgtgtgaaataccttgcaaaatgctgtgtggtttaccaagacagttgttcttgattctattaatatcattagtgtatgtgtgtgtgtgtgtgtgtgtgtttgcacacgcacgtgtgtggctagctacatgcaagagagaggacttgaatttgctgatgtcctttaatgatcagttaaacctatgcttgcatacatcaagctaaagccccaccaaatatttttctagaacctaacagaaaacacagtggttgctgtatggagttagcaatcgtgcctttgcccctgccaagctcctggcctcctaagtgcccgttacctcccttagaattgcagtgaatagggatctgtgcatggcagcttgcagctctgggtgtgcacattctctgcttcacttctgtgtcctgaaggccagtgtcgttctggcctcagctgccttaactgtgagtgagcacagcaccctctactcaccctgagcacatggggaatccttcttgggttgcaacatgtggaaggacccttgggttcatctgtcactactgcccattttttctcttctcactggcttttctttgtcataaagcatccttctccatcactttcccccagtcagtcttgtgtttgccatctctctctctctggtacctctaagaggttcatcatctgtgctgcttttctttctgtgtcctcatccctcaaatctctttcccctttatggcatcaactgtcattcctgagcaggtgcaaacaggttccatatattgagctgtatactgtcttcccccatgacagctctgcgtttccagctgtgtaagggactgcagatacactggctgatgtcagaaagcatgtttaaactctccaacctcctggttctgttttttcttacctttgttagtgggactcctgtatcttccacgttgttcaggctcaaaatctggggtcattttatgccttcccttatcctccctcatgccaacacccaatgagttgccaagctctgtggattcctcccctcctgcccattcccactaacgagctggatggtagggtgactcctgccctacactttaaggtcaggttttcaggctcagatcctatcttgtccacttaggagctgggtgaggacagcactgtcactcaacctctctgtgcccatgtctcctcatctgggaaatgaggaggatagcgacttccttccacgactgttgtaagaatcagctggaattttcttttatacttttttattgtggaatataatgcatatatgtgttataacatatgcacatatatggtaaaggaacacagaatttctacatcacataacaagtcattgtatagcaaacactcatgaaactaccacctggattaagaaaaatgcattgcctgaaaaactcctggatgttcttccctgatcctcccctcctgataatcatccccccaacttttaggaaagtcgtttctttgattttctatctatgctgatagtcctaataatacaatttatttttgcctgtttttgagttttatattaagagaagtatatagtatgctttattttcttaggtgtgggggcttatcagtgtatcactgatatagcatgtagcttagttcattaatttacgttgccgtatcctagtccattgaataactaggtcacaatttatccactgggctataaatatgtggtttgcattgttttgagtttggaactcttaacaaagaatactgctatggaaattcctgcttgtgtgtctgtgtacccatgtagaggcatccctccaggatatatcatgaagagtagagttgccaggtaagagtctgtcattaacatttctatataatgccatactgttctacaatgtgattcaccgatatttactgataggcgatgaaatggaaactcccggcttgacattcagggcctcctgatctacttgttcccactcatttcccagttgtcaccttcatctaccccacagaacagagagccagatcagagacaaaggtgggtcttttgtgagctcatattgtgatgaagtaggtgagtttgagacaagtgcagaaatgtgcggtaggtcagtgaggacaggttgaaaacctgttttcacccaagcagagcctgctggcgtttcctcccttctgactttccattggcttacagcagaaatgcagcctcgcttaggccagagacagagactcagggtccaccccagagaaaagagaagctgttgtaagaagccttggagagtccaggagacctgaagtggttacaacttaaatctgtcccaacctagaagtttgagttctttactgaataatatagactgaagctgaccaatagcgatttccatcccaatactgacttgttgaactttttgaaagcactgtgttccgaaggattctgaggccaagtccaagctcagaggagctaatgctgtgaccagttagttaacacctgtcaagcttgtggagggatggagtcctttatcccctttgttttaagctcatgcttcttaaatcccttagttcctggcaatgctcattttatctcaaatgtagagtattttggttctgttgacttagttttgtttgtcctgagttcctaggaacttcacccttttaaatccaaacctcttgttggtttacttggggacagagctaaggttatagcttctccatttgacttccttatgtttgttaaagacacctccagatttgaatcttatttggtttttctgaagcagggtctctagaaggttgtttaaattgggtgtgctcttccgtgaattcgcgtattacttatgctcactcaccatctcagttgaaggctggtagtagtcaaatgactcagatggtgaataccaccattaacctttaacaggacatctagtacatcaacagtgggctccccatttatttctatttcaaaaccctgagtccctctgaatgtattcattgatgtcctgtttccaatttcattctcttttagctcgtttacagagcagagggcatcagtactctcgaaggcaatgagtgaagagcccgagaattttagagcatcactcctgtctatgtgccagaggctttctgagcctcattagtattgtgggcatggtcttcttatcaggacagttaacaaaaccaagatctccaaaacagacactaaatattcccagacacgagtcgtcccaaagggagaggtggcaatgttacccctagaaagaattataacaaagggcaaagaagagtagaggatgaggaagcaggaaggatctgtcttatgattgaagtgagaggttctcacaagtgcccaggattggattgggcaccggtgtgtggtgcagtgcgtctatactggctgcattgggacttactcaatgaattaatttttttggcaccaaatgtgttcttagttattgtgccatgtatttaaagatgtgcaatagtaaatgagaaatcttgggcctcaagatgtttacaacacggcgtggcctagggcaggtggcaataagctctttaatgagtattttatagccactgtggaaaacattatagtggttcctcaaaaaactaaaaatataacaaccatatgatccagcaatcctactgctggttatatacccaaaagaaaggacattagcatattaaagagatatgtgaactcccatgtatattgcagcactgtttacaatagccaagatgtagaatcaacctaagtgtccatcaatggatgaatggataaagaaattctgtcatagatgtacaatggaatattattcatccataaaagagaatgaaattctgtcatttgcagcaaagtggatggaactggaggccattatgttaagtgaaataagccaggcacagaaagacacatattgcatatttttactcatttgtgagaactaaaaaaattgatctcatgaaggtagagagaagaatggtggttaccagaggctgggaagggtagtggtgaagcggggataaagagaggttggttaatgggtaaaagaaaaaaatacagtttgatagtaggaatgagatctagtgtttggtagcacaacaaaatgactatagataggaataatttattgtataattcagtataactagaggaatgaatttggaatattcccagcacaaagaaatgatgaatgtttgaggtgatggttatcccaattgccctgatttgatcattacacattgtatgcctgtgtcaaaatattacacataccctataaatatgtgcaactattatgtacctataaaatttttttaaaattaaagtgctctagaggctcagaaaaaaaaaccctcttcctcccctcctctgcccaccccaccatccagtgaggactggaggatgaggaaagggctgaagaaggaagtggtgtgtgaggtgggttttaagaatggggaggacttttcttcctgtctctctcttccccttttctaattctttccttcctagagggtcttctttggtggtatgggtttgggctgcggtgaggcagaagccaagctgttccttttcttggatgtgtaggaacatgttttcagggacttgaggttccagaggagctggttctgctccttggccatctcctgcccaccacttaggctcataattactctgcaatgtactcatgaaacaggctagggtgtaaacattctttctgagactgtgcctctcgcacaggcacccagcctggaaatcaatggcacagaaaggatgaggtgagagtttggctcttggcctgtcttgtggagccagccatgctggcttccagaggggacaactgttggctctttaaggatgatgggagtccagctgttcaactttgaatggctgggaaagcagttacaatatgattgtaatcaagaaagggcagcagaaccagctggagaaggtgccccatgaacatactcaggcgccacctctggacagtctcatgttgactcagcagaacctggacgtgtgtgttttgaaagcagttctcgtccagttgggtccatgctgcgtctaccaccggaaactagggctctgcagacttttactcttataagttcccaggagctgacttgtttcctaacaatcatggtgcagatcagattattctgctcccataccacttttttgactttaaagaaatgtttaagcagtgccctcattgacatccaaaacctttccatttggcattcataatgtgatctgtattagtaaagtatataatggactctttgtttcattattataattataattattattatttttttgctgtcatttgtagctccggattttcgagcttacttgataggagggcttatcgccttggtggctgtggctgtgtctgttgtgtacatatacaacatttttaagatcgacattgttctttggtatcgaagtgccttccattctacagagaccatagtaggtaagtgtgtgtaatcactgaaaaatgcctcaaaattggtatcctcttatacatatacaacgatttcaaatatactttgtcatattttactacgttgttggcaaatttagggaaaggaatctccttggaactgcctgtgctttagagaaatgatttgtccctaatcaccagcatcatttggtcagataaggcttgcaggctcgtagtgattgaggaaatatttgctaagctgcaggaggagatcatcttctaagtcctgctgcaaccatgttacaaaagtttccacgtccatcctccgtccactgcgggaaagtttctccgaaaccaaagtgctctccatccatgatgtgtgctcagcacagtgggtactttctcagaatctgggtcatggagagggatgagctgcctgcggttggagctctctctaggccctgtacttggtgcctgaagggatttaagtcttcaactctcagatatggagagagatcaaaccaagtttgaatgtgacttctccacttactccctatgtaaacttagaaagatgtttaactttcttctatttctcagctatagaaaggaatagaggaaggaaggaaggagacagggagggaggaaagaaagagagagagagggaggaaggaaaggagagagggagggaaaacggagggaagaagggagtttcgtagaaaagaaactaaagaaagcaggggagagagatggaggagaagggaggaagggaagaaagaaggaagggaagaaaaaagaaagaaacaaagaaagggacagtgattaaatcctgctttttgacagtgggaataactgagttgaagtacagggaagcattcagcggggcctgggccacagggcggcctctattgcttgtctggaggtcaaaacaaatccccaacaccacagctgtgggttttagtctgtgggcctatgtcctgccagtgctgtttggcatagaaatgcctcagtgtgatcctgactctctgagagcctggcatttcccaccatggtgcttgtgactatgctacttttgttttgttttgttttgttttgtcttagaacagatacaatctattaaggccttgcaaaagtaataaatctgctctaaagtcccctaattagatgaaaaaagaagcctggtgcagctgatctgtgtggagatgcacgactttataccttttaagtccagaggcctgagtgacaagagcaggaaagggagggaaactggttgtctgagaacgttttatggggccagctaaaacataaaagaggtcactggcatcaagtgcttgctttgcacataaaatacacagtacggttgttacccacatgtttgataaaacgtggctattcactaacttggattttttccaaattaaatttctgaattcagaattagcaaccctgagcaatgtagaaagcgataaactcctttttaatgacaaaagtcatctgaaccttaagtgtccagtgcaacctgaagtgctgctagtactgtggatagtccgactgggcatggggagggggtctctggttttggctctggcatctgcagaggccgccccgtctaagcacacccatgactgctctctcctgcttgcgtctttgagaagaagacagttcagtcccccaccactgattgttttctgacacagagttgagtggttcagttgctttctactttttgactaacagaagcctgcgtcactttacgtattcttcctggaagctcaggccccatggtgtgtctctctcactgtctctctctctcactgactctgtcagtgactctctcactgagtcattgcgactcccaggagcgtgactatagctgtgacttatgggtgttgtgcagtgtgtggggaagctgctagtgaggtcgagtttagcaggaagagaaaacaggaatagtgactcacacggagtagtgggggctgggcagatgagagagttaggcagccccgccctctgctgagactgggacgcagcccagattctgcaacagtgggcagaggatttggcgatggaggctaacaggcagccaggggtcctttttttctttatttttattttgcttaattcagaaaagtatgtgtgcattttgtgatgaaattctctacagctctgtctacgagaactgccctgtaatatctctgtgtgttggctttaacagtgagctactgatgagattctgagattagtcccagatcttgtttatgtccttgttccccttgaggatattttctgagttaaatcaggaaataccgattaatggatgaaaatgagaaagagagaaataatgtccttcgtaggataagtcatttaccctgactaggttagctaagctgtatcactcaattaataattaggtgtgcatgactcaccattttagaaggagccattgacagccctagctgaagtcagcaagttctgtatcttctctagcaagccactggagctttacaaattctcctggcaggggtgcatgtgtgtacgaggatggaagggtctgtgcacggatctcctagagagatttgaaaatgcctcgccttactccagataggtctttggagaatgtgcatgtaggatagaatggctaaaacgaagacaagccaaacagttagagtgatcaaagggaaaccaaggggacaatgggaaaacaagtcggggtagagttaatgacacctttaacaattattaaaggtgaatttgcttttcaagctaaagcaaaggcaatgacaagatccactgtgtgccattcacaacaacctttcagattttcatgagagaacatggctttttctgagactaatttccaaaggcagattttttttcccccacagggagtcctcatttcaaaagggcatggtgtagggaagcttgactgcaacaactttcccatggtaaatgtcatagcgtgttttgtgtggcttttcttctagtgttttctatgcatattgggggtaaacccaccaaacctcctgcagttcagtaaaagcatttgcgtggaggccagattgaatctgaattttccactgttctggtttcatcaggcctaaaatttagcaatatcatattgagagaaagtagggaattgaataatctttagacagtatttcatagatatgaatttatgtgaatgagcttttatatattattgccaagatcaagaaggacataacaattttaagggagtggaaatagactctgcttctttgctagggtgtggcaaagttctggaagaacatgtgggactggaaatattgctggggctacttttggaaaattcagactgacacagctgcacaggactaatcagggattagttttgtgaaatttcctgctcccatttctcattttagtcacagcaaaaggagcggtggacctgggtttacatcaaggctatgcactcaccagctgggagactttggagagatcgcacagtcttgctggtctcagcttccttactcataatttggggatagaaccatgtcccacacggttgatcatgagaagcaaagccgggaaatgttgaggtgccgttgcctggcaaggctcttcaaaaccagtggactacaacttgatctcttgctattaatgtattggtcagtaaattatgaattagtcatttgaaagtgatgaaaagtcactacgttttgagaacatcagcaagttctatttctactcaaaagcttagtcagacagaaagaaaaaaaagatgaccaaaaaattgggcacatttgtacattttgaatttttcaaaggtgtgagactttcttcctactcaaatgtcttctgatcctgaagttggagagcaacaagtacctatatcctcagacaccttgtttagaaacagggaacagggaacattcgcaaaagagagaatacacttagcacacaaggtttgtttgtttgttttaaaaatcagaaacagtaggaaaaaagagaaacagattgagagaagagagataactagtggcagggtctgggacaagtggcaataagcctgcatgtctgctgtagtttagaatagaccaggaaacactgtatttaccagagaggttattctctgtggtgaaccgagcatcaactcacccagcccttcatcagaaaccaaaggattaatatgatcacatttttaagtgggaaaattgaattccttctccaaaagttcagaaacataagaaacttatgaaatgtttcttttcccattttctatctacggaaaaaaaatcctctggctttggaaagtcaaatgtgtgctatgaaatttcacacagaaaagtatccacttatttgagcggtggccctgatcagtgacctttatgattccacaaggagtttcagctatgttgggtttttgccaattcaagacacaaattagttatcccttttgtgcctgccctgtgatcccactttaaaaagctgagtctgatctcagattcatccccaacatagatataagctctttgagcctccgtaaaatcaagcttcatttggatattcggtgagcactgatgaaggcctcctctgcgcccggtcctgctccagtggctgagggcagggcagggagccaacgaagtctccactcttacacagcttcctttcatgatggggtggggaggcagacaaggagtgtgcacgtgtgtgtgtgcatgcgtgtatatgactacatgtgcaagcatgggtgtgcatgcatgtgcatgcgtgtgtgtttgtgttaccattctctgtaagagatggccaagaatggtgagcagggacccgaaggtcagcagtggttggtgtgagaattgatggactgagaaatggtgttatgtaaactgtcaagatctgtgcacattttcattactattatttggacgaaagctagaagaatacaaggttttcctttcccttattaatcttaaaatcacctctttctgcaagtctgctcatccaacaaactctcatataaaggaaatagaaaaggacaccacccctctctagtacctactaggctgtctgagtttctaaacagcccaaagctcgaaatcgcgttttccaatgagacgcccacacttacctcttcttccactcaagccctctggccctgctgaagtccttattcattcacaggattcctgagtagggaattattcctccttccatgcccttctgaagctgcacccctgcaagactgtttaccatccactcttagaccctcacttttttcccctcaactctcccaccctttaaaatccaggagctccagcctggccaacataacgaaaccccgtctctgctaaaagtacaaaaattagccgggcctggtggcgggcgcctataatcccagctactcaggagactgaggcaggagaatcgcttgaacctgtgaggtggaggttgcagtgagccaagatggcgccactgcactccagcttgagagacatgagtgagactccatctaaaaataaaataaaaaaataaaataaaataaaatccaggagcggtcccatgttcattgtgagtttttttttttcaagaactccagaccatggggattttttattcttgctgtcttttctgttcgtttgactctcgtcgcctcgtagagtcttgtgtttaacttctgtgcatgtggatggtctgcccagtgaggtcttgttcatctcttcattggccaatgcaggggctgcttttgaggttgctcaataaatactgatgacgacgacatgcgccattgggtttgacttctctcaacggcactgcagattactagagtctgctcaattgctttttctcttgtttcacagatgtgagtctgtgggtttgtagtgatggaattcactggtgggcctgaatcaagagggagtcatccagttttgcctggtgcagttaggacagtgcttcgtcatacaggacacgctgagggtaacatgggtaaatggctagagtttcctgctttttgtttgtttattttagagatcctttttttgtttgttttagagatgtggtcttattctgtcatccaggctggagtgcagtggcgtgatcatagctcactgcatccttgaactctttttttttttttccgagacagagttttgctcttgttgcccaggctggagtgcaatggtgtgatctcggctcactgaaaccttcgcctcccaggttcaagcgattctcctgcctcagcctcctgagtagctgggattgcaggtgcccaccaccatgtctggctaattttttgtatttttagtagtgacagggtttcaccatgttggccaggctggtcttgaactcctgacctcaggtgatccacctgctttggcctcccaaagtgctgggattacaggcatgagccacatgcctggccacatccttgaactcctaagctcccatttcagcctcctgagtagctgggatttcaggcctgagctatcatgcctggctaactttttgaaaattattttctttggagagtcttgttatgttgccgaggctagtcttgaattcctggcctcaagctatcctcctgcttcagcttgtttattacagccatgcaccactgcgctggacgagtcttctgcctttaattctcatttctggccacatcacagggagtggtggacttagactcaaaagacgtggggtaggggtagggttagggattgcagatgtgatgcagcctacccagcctcagcttcactcttgagcattggggataagaccacctccctcaggggtccatttgtgagaggagatgatgtcccttggcagcccctggcaccaagtcagccaactgggcactcagaagtcatggaacccaggccaaaggacaccatggtagccgctcaggcttccggtttattaacatgagagaatttggtagcaacaattccacaagcttgtccaattccttttcagatgggaagctgtatgacgcctatgtcttataccccaagccccacaaggaaagccagaggcatgccgtggatgccctggtgttgaatatcctgcccgaggtgttggagagacaatgtggatataagttgtttatattcggcagagatgaattccctggacaaggtgggttttaagtgaggtgtaaaaataacaaataaaagaaggaaagcgacccctctgttcctccactttactaatggcggtgactctgcctgccttccccatggaaccacagagagtctatgaccagcgccccctgcccgtcagcccccagcccccagccaaggaggttaggcccaagctctttgcctgctctaggctcctccctgccccgcagtgcctgagattcctgcttgcagcagcacgcgtctcactttgagtgaggatatggttaagccattcacagaaacaggtggccagtgatgtagtggtggctaaaggactgaaaggtggcgagtggtcatttgagcctcacatccctgagatgaactgctgggtgttttccatgggtttgaacaatgtaaatcaggtcgtgcttaaagctgattttataaacctcgaccctacttgccccctcccctccctaaatataatggaagttttagtgtacttttcccacttgataggaaggtggctttggacagttcagttaacttctctcaacctcagttgtctcatctgtaaaatggggatggggtgcttccctgactcagatgagagaactgaatgagaaaacctgagaaggggtccccggcatggagctcagcacactttagacactcacacaacagtgctttcctgtccctttgttctccttcttggaaggctatacagcaaaatggctgaaatctgaaataaacattcttttctagtcaccagtaaatgccaattcactcacttattcaacaaatatttactgaaaacctctatgtgatggacagtattctaggcactagaaatatgaaaatcagccaagcagaagggcctgtcctcagggaggttccagtctattcttatttcccatgagaggcaactgtagactgaatagcatctgcagagctgggtatttagagaaacctccctttcccaagcaatcatcagggcatgttatttggtttctaaattactcacataaatcctggtcatttaaataactataaagaacaaaaggaaaacacagattcaagattaatgcaacatttcagctaactacattttcctatccttttaaaatctatttttaaaaacgtgttcatctgctaatatacaccagaccttcagctagtctggggatacagagttaggaaccatcagatacttgttggccagggaaagtgacatacaaagaaaccacatgcaaaacatgattcatgactatagaggaccaaggctccagggaaagccacaaaggcttcacagaagaggtgacaaatattaaaaaaaagaaaaaaacccaaaacttgtattaatccattcctgactaagtcatgtttattttaaagtccatttttggccaggcaaggtggctcacacctgtaaccccagcaccttgagaggccgaggtgggcagatcacttgaggtcaggagttcaacaccagcttgtggtaaaaccccgtttctactaaaaatgcaaaaattagctggacgtggtggtacgtgtctgtaatcccaggtacttaggaggctgaggcaggagaatcgcttgaacctgggaggtggaggttgcagtgagctgagattgcatccctgcactccaacctgggcaacacagtgagacttcatttcaaaaaaaaaaagtcaattttctcctggcctgtttcaaacattctcactagcattaagacccgggctgttttaattgtgagttcttctgagccttctttctttatttccagccgtggccaatgtcatcgatgaaaacgttaagctgtgcaggaggctgattgtcattgtggtccccgaatcgctgggctttggcctgttgaagaacctgtcagaagaacaaatcgcggtctacagtgccctgatccaggacgggatgaaggttattctcattgagctggagaaaatcgaggactacacagtcatgccagagtcaattcagtacatcaaacagaagcatggtgccatccggtggcatggggacttcacggagcagtcacagtgtatgaagaccaagttttggaagacagtgagataccacatgccgcccagaaggtgtcggccgtttcctccggtccagctgctgcagcacacaccttgctaccgcaccgcaggtgagcgggtgggaggacacgaggtttgtcacgcactgatggagggtctatcattgcgtggtggctcacagctggaggaggacacgtttcatcggggccgtctgctctgaagctggcagttgcgtactagtgagaggatctgttgtgtttgttgtcatttgtttgcttcgatcagagctgcttcttcagggaaacacacggcttctgcagaaggccctctttagcctatgggcttattgacacatgcccactcactgaggcctggatggatacagcacttgggccccttgagaacaggacatggagggttttagaaatggcagtggacatgcccggaagtttgcccatgatgtggcacccatagagtctgagatgggagcctgtgctgtcgggggaccacaggagggcagtctagcaccaggagagggttggcaaggatagcagtatttgtccacgcctgtccagtgtcttcagggccccatgctcaggggtcatttgctgtgtctgcgtctctctcactctgtcagtgcagacaaagagctgcaaacacagccttagcactttgcttccagaagcaagttaaaagtcacctagaccagtggggacccacgggagtggccatgactgcctcttggtcacccttccatgtttgagaggctttatctgtcaaactaaagcaagcaggaattccttttctctctcttttagacacatgtcaaccagaattctgagcagcctgtgagagacgcaattagcacacagatgatagaattatagtccaagcaaggcaaagtcagtttccaatgagccaatgtgcccttgtcacaggccaatttataacttaatgattaaaggtttttaatactaaaaattagctgtaaaccctcatcacttttttccaagaccctggcctgagggaattaggcatagctcaaccttctgaagctgtgggttgttgacactgagacttagtaagcagtcagtgggggctggaagggagtcagccctgagagccagccggcaggggtgagagagggagccagagggtgtcaggaggcctgtggccttaggatggcatggggagcagggtgggttaggaggtgctgtgccctcgttcacaggcgatgggtggtacccagtgtgggatggactttcaggtgctaaggaacccactcctgtctttgaagagtttatgttccaaggtgacctcacattacacatttgtttagcatcctatggaggcctcgacttgacattggtccactctttatttaacatttgctttttaaaatttttatttcagtaaactatatgaacataaaattcaccattttaacaatttttaagtggcattaagtacattcacactgttgtgcggccatcaccaccatccattccagaattgtttcatcctctcaagctgaaattctgtgcccattaagctatgcctccctattgccttcccattgccttcccattgcctccccattgctctgaggtaggacataaaatacattttaagaataacagcattaaaaaatggctactataattcattactactattacatttttgatacttttcaataaaaagaaagtagtgacacatgttggaaagagggaagctttttgacttataaaactccagttaaagaatttaccaacagtgctggtctccgggaagtcagaggtttccagaaaataccttttcgtctgacgggtcagctttctattttgctgacagcctcgactgatgtcctgtgagtgtggtcattcatttataaataattaattgctagagaatccattttctaaaattcacaggcacacccttcagagaggacacgtccccgtacctctcccactctccccacactgtggctgcctctggctgcctccatcctgcagagggaaatggctgggaaggaagggggaagggtgctgagatgccctcaaatctgaatggggtgggtgtattccccaaatcctcaccaaaccacgagccagtgaccactcaccctttgcggtccagatcttactgccccggggttagtcaagtggccagaggtggtgcccactgccctcagggggtttcctggcgtggcctggtctcacatgcactccgcagaaggaaggacgaagcgtcctcagccagcccgcagccaccctgcccactccagcactgcaggcagccttcagagaccagcccagagaagagaacggcagcgagtgaggggacagagtgcggaacagatcagtaatgcccattttcctcttgggtgcaataggagaaacagcctgttttaattaaactagcgaatcctccatgaggaataacgactctcatgttggagagagaaatcgagatgcaaagaaactttttaaagttctactaattcctaatgaaataatagggatgcaatgcagcaagaatacaaataattgaagtagcctggcatcaccgctgacatgtaggcaggttggcaggtaacagctccgctcatggtctcaagtccaaatttgtataagaaaggaggtttaagagttcaacggctaagggacaaaaaggtagtttatgggaacgctgaaggccaccctcaattctctcccgtttctccagctgggcttggcgcaaatatgaggtcaatggggtcctatccctagcccttgggggtgggctccagaattctactccaagcaaagtgaagtcagtttccaaggagccagtgtgccttcatcacaggccaatttataatttaatgattcacaaagttttttaatactatgaattagctgtaaaccctcatcactcctttccaagaccctggcttgagggaattagagacccccctgggaatccccagggactgacctggaggtagggctgcgagcggagattggaccagagaggtgaaatacaggtgctgagtcgctgggttacctttacattcaccttcccataatgactgagtcagccacaaaacccactacctttggtatctcccctcaaataccctgagtcggctcatgagagaggccctgggaaagacccagtcacattaaataaagggaccgggaaggtgtggtctttccccggaggaccaagcaagatgaagatatacatgtgaaaagtgcttggcaaaccgtgggatgccatgaggagctggcctgccaaaatatggaatgtgctcagggagcctcagtccccagggccccccacacccatcagcaccccatagtgacgcagaccacttcctgccacgtcatggttggttgacctttcctcggcacttggtcctgttttttatttataaacttccctctaacacatgcttgtttggtattgatctggggctgtgtaaagtggaaaattccttcctggtttccttgaagaacagaggctgttccagatgaggtctggagtgagctacagagggtgatgctggctttaggagtggtggctgctgggtctgaatgttagaggccacacatctccagtagtagtattattctgggagatgggaactctgtgtgtggatgtcccctcccatacacccaggaacttctgagaaatgctgctgttcactaatacaattccaccctcatctcccaggctgtccctggagaggagctctccacttgagaaggacctcagagccctggctcttgtcatccaaattcacctttcctctggggctcttataggaaaggtgagagttgacactgctcacctgtgatcctctggcataaccaccttgcaaagataacccaagagaaatggaagcctcagggatataccaccagatgaactgacggcaaggtggaggttttcgcattcccatggcaggtttccttatcagcccccatctcccaccacatcagaaaaggagtaaatagatctttcctgatttcaggcccagaactaggctcaagaagaaagaagtgtactctcacgactggctaagacttgctggactgacacctatggctggaagatgacttgttttgctccatgtctcctcattcctacacctattttctgctgcaggatgaggctagggttagcattctagacacccagttgagctcaggcttagagaagaggaggatgggataagaactggggccatccccatgtcatggtgggtgagagctggggccatccccgtggtcatggagggtgagagctgggggttatccccatggtcatggagggtgagggctggtcgggggaggcatccccaagtcatggtgggtgagagctcggagcatccccatgtcatggtgggtgagatctgggggtatccctgtgtcatggtgggtgagggcgggtggtcatccacatggtcatagtgggtgagagctgggggtatccctacatcatggtgggtgagagctgggagcatccccatgtcatggtgggcgagatctggggggtatccccacgtcatggtggatgagagctgggggaatcaccatgtcatggtgggtgagatcttgggggatcacctgtcatggtgggtgagagctggggggatcacctgtcatggtgggtgagagttgggattcatccccatgtcatggtgggctgagcccacatggaagcctgtgcttggacagcgtatgcccttttctctgtttttccacaatgaacaattaaactgtaaatgttaaaaatatcagtaatttgtgaaataaattttattctcatttgagcaacataaatcacaattttgtttgtttaccatgcctgtcaaaatcacaaacattttcttatcagtttaaataatgaaaactgatttctgctaaaatcatctgacaattagcttgtcaacattcaaatatttttcaccttaaatccactaccttcgtggtgtggtccactgaaaagttgggcaaaacccaacctgtgattgaggctatagagaaacatgagggtcatgcacaatagctttttttccccacacttagtagatggactgtttctcagtctgacagccaccaaagctttatgtcctgatgaatattttcgtcctctcatcctctctgatggcctcatttctccaaatttcttcttctcctcctttttttttttttttttttttttttttgagacagagtttcgcttttgtcaccgaggctgggattacaagcatgagccaccgagcccggtcaaggctttcatatttttaaaactttgaagtacagtgagaaacataatttagtaagcaactcagtatgcacacacggaatggaaaaagctctgttctatgttatttgttctattttgttcaagtctagctcaatttttcaaaatgctggtcacagctcgccaacttgttttaataaccaacttatgcctttccactgcaatctggagagctcagcctctcaggctgctggtccccctgtcaatcacgatactttggctactttgctttcttcaatcaacaaggctttatcaagaacttatggctcttttaattatctgacttcctggtcaatcagctttgtttgtggttttaaatgaccacaggatagtagaagtgaacataatttcctgcctgtgtaaaaggatgacatcaagaggaaaagaaagcagctcactgggtgaaggaccttgagaaagagatgaacatttcctctcttgagacacaggacaaacaaggtcacgcctgagctcggcaaacaaggacttcggtgcctgcctacggcgccattgcgccctctagtggctgctgaggaaccgctgtccagcccgaagctcacagagccccgttcaggctgccgcaacctacctaggcggccagaatggagacttacaggtgggcgggcatcccggggtgcacacattaccttctcggggctctccaacttaaggccaaggatatctttcttctttttcggctgctgagaaggtggagatagtgccattttcgaatgtgttcctaactcttgggcttctgagactgtcgcagtctgtccaagggtggtgagtggggatcagcaggccctgtttactatgtgctcgcaagaggggactgcggtcatagggatttcagagaggtggccctg

SEQ ID NO: 775 - DNA, 40124 bp, Human
attttcttctttcagtcttcattttgtaaatctcctacattgagtgtaaattgctttggaaatcagaaaaactttaaaaagaaagaaacttaagagttacggaaaagcaaaaatattgatgttaaacataacaattaaaaacccttaaaattcttacatgtgagacatttaatatttatattcttctatgcctattttattaatacttgctagagtatctgttacatttatcagaatatctctttttctggaaatgaattcattatttaatataaccttaatctgttaaattcacacataaaacttaagtacattaaaaattttacatacacacatccacatttgcagaatggtgtgcaaataccagctaatttttgtatactgagatcttaatatgtttcatattgaaactcagagttaacttgtcagtttgctgagccatctcctgataactttgtctcttggtagatattgaatattttttttaaagtggtgctttttataaggttacatcagtcttaatcagagtgacataaaggaaataacattttttattctatccaagataaaagaataggcagagttaataataaaatgtgtgtggaggtagtgggggaggtttcaaaccatagacccagtctaatttgattatgcacagttggtactttccattcatacttgtttctttggcctttacattattgattattatctcttggaaattccaccaaatatttggtgatttttccataaggatgtatgtgaatggtttggcagcttagccattaagctttatcctggattcaggcattgacaactctgtttttaggatggaagatgagtagttgttggtgagaggggcattattctgagctgagaagctgccatgcactcaggaagtctccataagccttagatggtttaatcactcaataattccagaaacaggccttcttatcatctccattttggtaatgaccaaataggctctaagacttgctcaagttttgcacagcttgtcaggactcaaactggagtggcagcccaggtttgtgtgtttctgaaaccagactctgccatcaggctgtgctccctgcactcaggatggtaaacaagggatatggtgttgtttatgcagtatttagactctgaatggtctccactgtgggggatccttcctccactgggctcaaagttgtaatcagaactccgaatgctaggttgcagtaggatcaaagttcaatgcagatcttagttccactgggacacagtcaatgtaaaggaggggtctggagtgtaggagactgtcacttcatctctccatttccctaaagtaaactcatatgggcagccacagacacacgcgaacacatgcatacacacctatgcctcagtgacacatgttagtgagtgctggccatgtgctaggcatcgtgctggattttagtgatacagtgaagagcaaaatagacttagtgcctagaattatgaaagaattatgaaacctacgttctgaaggaggaagatggagttttaaaaattcaaccctaaatgaagatctcattacaattcaggaatgttttgatgtgaaaacacacacacacactctgttacatgggcagaactgccatacatagctcagcatgtcacagattgtttattcatagaatggtaatatttgtagcagtactattgttctgaactttggccttggaagcaggatttagtagaccaggcctgaaattcttcagactctgttgtatcagagaaataaattattagggatttcttccagaagaaaaacttcattgccttgaaattttattaattttatatggctgaaagttctgagaattggttactatattaaggattataaaaatcttctaggttgtttttttaaaaatctgtgtgccagaagatttttaaaccttcataagataggcacacttttgtttgaaagctttggctgaatctgttttattctgttttccagagaagccatttgaagcagaatccaaaccatgaattgtagagaattacccttgaccctttgggtgcttatatctgtaagcactgcaggtaagtgattatacatactctcaaacatatttcatgagtaattgaggaagaatgtcaaagtttttttttttatgtggtggctactgaagatgctgaatttattcagaaaagaaaagattctgcagtctgagttcatgtagtgagagcagagtgaaaaacttgcatcttgaaataaattacatttgtctgaggtgaaaatttatttcatgttatttgaaactgaggaggtggcagccatctttattattgggttttaggaagtttgaaacacactttctccttcctgagagggaggcaaagattcatctcattatttaggtaataatgagaaaagtaaacgacaaatatattagacagcttaaaaaaattagagtgagacagaatatacaaaaaagagactggctagaccaaggagctcaagtaggcttcatagtagatgtcaaatgccaattttaatttattagcagtgattgcctagagttttttttttttatttgagaaggattctgagacttcattctttagcgttccatgattgaatagcaaggcattccttaggctttgggggagaaagtgggagcacaaatattaatttgccttgatctattatctaggagagggaaacacatgggctcatttccctactttgataattactgctgaagagatagctgaattaagcttttggtactttcaaataacacaggtccaatctcagggtatatttacttacgtgaatccatttattattgagatccctgcaatggaaccctacccagatgataaaagaatgaggtagatcttcatttttttatatgtaatgatctgtcaaacaagtgagtggaaaagcaaggtacaggaaaatgtgtcatgagttccatgtcctgtggacatacactaatagccttactcctcattataatgagagcatgtttcaggcacagaaacagccatgcagccagttgtgcaaagttgccaagctcccagctgcctgccctgaagagcacttttcatgaatgtttcactctagggagacatgacaatgttctacatgtaggattcactgaacctagttgagtttaaatgacaaaatgctatgattgtccaaactcaagacagtttcaaacacagactttattccaaagggcattggttgttggcactgctgggttcttatactgtgtttatggaacaataggagtgcctattttggcacttggaactccacaaaccttgaattccacttatttatcccatcaaggaccatttccaacaagcattatggtaatcaacaaagcctctaatggtaaaccatgattagatatccaaagcttctagctgcctgaggaggggggtggtgtggactttcaattatcaacctcccacctctggagagtgtgtaattcacattaagtttcttcaaatggtaatacttccagagagcacatgtccatccaaacacagtcatatgtgtttatagaagctttttaagacaagcgaaaacctgaaaacctagaaataagccaatatccaacagacatttgtttaataaaccaaatccccaacatgcatccttttataaaatggataaattgcgaaatggtaacacgattagatactacattacaatgagaaaagaacacatcactgctacagcatgaatgcatttataacaatcatgtcaaaataacccagacataaaggagcacatattgtatagcctatgcattttattatattaactctaaaacaggaaaataaatgaactgttaatgactcaccagggttttgcatgtcaattgaagctgacacccacatatacacatgtatcacaccttctatgttgaagtattagtataaaatagagattgtattgcaaccagaaaacatgaagttggtgctccttaactcttgtgttttgtggtagattcgacatccatgttttcaaagaatgtgtattagtccattctcatgctgctaataaaggcatacttgagactgggtaatttataaaggaaagagactttattgattcacagttctgtatggctggggaggcctcaggaagcttacaatcatagtggaaggggaagaaaacatatccttcttcacatggtggcatcaaggagaaggctgagcaaaaaggggaaaagccccttataaaaacatcagatcttatgagaactcactcactatcaggagcacagcatgagggtaatcacccccatgattaaattaccttccaccaggtccctcctatgacacatggggcttatgggaactacaattcaagatgatttgggttggggtatagccaaatcatatcattccacccctggcctctcccaaatctcatgctctcacatttcaaaacacaatcatgcccttctaacagtcccccaaagtcttcactcattccagcattaactctaaaatccaagtccaaagtctcatctgagacaaggaaggtcccttcctatgagtcagtaaattcaagagcaatttagttacttcctagatacaatgggagtacaggcattgagtaaatacaccccttccaaatgggagaaattgactaaaacaaaggggctactggccccatgcaagttctaaatttaatagggcagtcattaaaccttaaagttccaaaatagtctccttcaactccatgtctcatatccaggtcacgctgctgcaagaggtaggatcccatggccttgggcagctatgctcctgtggctttgcagggtacatctttcttcctggtttctttcatgggctggtgttgagtttctgggctttttcaagtgcatggtgcaagctgtcagtgaatctatcatcctggggcctggaggatggtggctttcttctcttaactccactagctgtactccagtggggactctgtatgggagccccaacaccacatttcccttccacactaccctagcaaagattctacatgagggttccacccctgcagcaaacttttgcctggacatccagcatttccatacatcctctgaaacctaggcgtaggttcctaaacctcaattcttgacttttgtgcacctgcagcctcaacaccatgtggaaggtgccaaggtttggggcttgcaccctctgaagccacagcctgacctggtatcttggcctgttttagcaatggctggaggggtaggatgcagggcaccaaatccctaggctgcacacagaaagggaccctgggcccatcccaggaaatcattttttcctcttaggcctctgggcctgtgatgggagggtctctcatgaagatctctgacataccctagaggcatttttccccttgtcttggcaattaacatttgagtcctcatttcttatgcaaatttctgcaaccagctttaattccatgccccccattcccacgaacatggatttttctctcctaccacattctcaagctgtgaattttccaaactcttatgctctgtcacctcttgaatgatttgctctttagaaatttcttcttccagataatcgtctctcaagttcaaagttccatagatctctaggacaagggcaaaatgcaactaatctctttgctaaacataacaagattcacttttgctccagctccccaaaagttcctcatctccatctgagaccacctcagcctggactttattgtccataacattatcagcattttggttaaagccatttaacaagtctttaggaagttccaaacttttccatattttcttatcttcttcaaactgttccaactgttccaaactgccctccaaactgttccaacctctgcctgtatgcagttccaaagtcacttccacattttgtgtatctttacagtagcaccccacttctggtaccaatttactttattagtccattctcacactgctaataaaggcatacctgagaccaggtaatatataaaggagaaagatttaatggactcagttctgcagggctggggaggcctcaggaaacttacaaaagggggaaaagccccttacaaaaccatcagatctcatgagaactcactcactatcatgagaacagcatgagggtgactgcccccatgattaaattcaagatgaggtttggatggggacacagccaaaccatatcagaatacttctatcacatcacttcctctttatgttgtggttaacaattttgagttaaaaccagactgctgctttgagaaacaaaccctgactatagagaaggcattctgtccatgtcctaagggaaatgtttcgttcagtttaaatactctcattctcaaaatgtggtaaaagtgcacccgagagtcactggagggtagattatgagaaagacccattaatgctgaacttgaagtaccacaagtgccgaaagaggggaacgagcacctatcctgggtagatgatggtcagatatatttccaaagccagagaatctgggtcaattgagaaagagggaaagtgacagatatgcaaatttggattgatattatattaatgaattcttgattatccacatggtgacctacagtaataataaatgtacacacactgtaagttacataggcacacttttaaccatccccacacttaccagggaatgttagataggcagggtgaatgcaaggtgagtgagatttctgatggtgcagaggaagaacgccaaggttgctagatttcttgttttcttttctactgagactcctcagcagggtatattttgaggtaggtatggcagcaccgtgacttctgtggctttccctatgaagaagttgtaatgtgtaatattttcttctaagaggtgacacaattatcagtcttctagctatggttggttaagttctgataccttcctgttggggagaaactgtcagaagttgtgttttcatctatgttctgaaagtgccttatcctttctagtgttggaaagattgacgcaaaaataaagaacccacaggaaattgacaccgagatttctcaggactttcttgctaaccttgcttcttcacctaatgcattaggagaccaaaaaaagttaccttgtcattttggtttttgtttttatttattttactttactaatcttctgaagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaagtgagtaaccctttcttttcaaaatgtatttcacagccctcttgtcctttgttcagcaactcaaatatgcagtaatctgaaaggtcagataatcaccacatccttttctttcctactcttcctatgacatgaaatacattctatgttatggaacaaaataagtttatctctctctgcttattttcttagtgaccttaatgaaaggagattactttgataggatttccttttaggggatccttaccaatgacaagtgacgattgcatgaaagtcagttttaaaattcagctgctcctgttgtctacatgcccccagtcaaatgaaatcagcagctcggacttcacgataatattaatgtgttgcgaatggggcagtgtcagcttcctgggtggcatccctggtggggagcagggatggggttgatgcagaaacaccctagtccagtctgcaggggctcactgggagccaggtggcagtgctagtggaggaagtgtgtgtctggcagccaatcgcaacccacagctggcggcagtgagagagggcaacacggaagggctttgcattttactcatgaggtggccctagattgtgccagaatactcgaaattgggttgcataacttccatgaaatgagcacagccaactgaaagcatcacccacacttaccgaacatgtttctttttagatgtacctacctacatatgtaggtagttttatagagacttgagactgacctgtaagaaatagctcagggccagctgaaggtgatggtgtgtagatttcatatgtagcagatttcttttagaagcacttctagagtgagtcctgatcattatcaaccatgctgttgagagcagagtgagctaccactgtgaaaccttggtagcacttctgtggttttgcaccaaatcaggtcatttttgtttgtttttatacataggaactcccaggcatcagaaaaaaattaaataactcttttgataaaaatcagtacatctttagatgaccttttaagagtgataattacagaaatgggtcacaactgggatttttcataacaagctaaggaagaatgaatactcacaaatggggtaaaggaaaaagaacaacaaacaccgccccccccaccacaaacttccaactcctgattgaatgaaggcacaatttaaaggaataaagtattctggacaggcctgagagagcacgttgagaggaacagccaggcatctatgatcatcacttggagataacagaagcaaatggcattggccatctttctgatacgggtagtagagaatacagcctggcttaggaagcaacaatggaagcaagagattgaggcaggatgtcagagagaggtgtggagagacagggtagcagataggagatgctaagaaaaatgaggtgtcccagagtggatattggagactgatcactatgagagtaaagtgttgaggagagaagcagctttgacaatggccttgaaaataaatgggattctacatggaagcaggttgttttagacacccaggagcatagaagatacagacatattcaaatatagcataattagtaagcagtatttactgcagatgtgtgtgtatacacatatgtgttctaacttaggtgtgtaaccctttgtagtttgatgtgggatctatcagtgaacagactttacacctgaaaatttcccgttagaacagtaattctttaatttttaggagtacattgctaataatcaaatgccactgaggactgataatttaatcctgcagtgaaaatcactttatcccaccaaattttaagaacgaaatcaactaagaaggaaggggatacaaaagggatagttttcaatgatagagatgaagaaatgaaggtagagggaaatgtacacacagaaatctaataaaccaatcctaggctgacaggcagcaagttcagcttggtgagcagcctcagaagtgggggctggtgtttatcccctggtgtctgtggacaaaaatgagtggttttcataaccaggatgggctgggcctgcagcaggaaagtgtggtcacagctttgggtcagttggcctcagtgttaaccccagccttggagctcctggatggcaggtgcagtgtgttgttgattgtttcagtgttcccagagcagtgtcctgcacatggagtgtcatcagtcctctagcatttgttgagtgttaggaattgaggattacagaggtagagaacaatgtagtctgaaaaaatggggatattcatgtaccctattccttttaagcaacaagtcatagagatccagaaatctctatctctccaattcattgaggtcaaagttggggagacattacgaaaacacacttgagaagaaggtgctgccaatgggatcctgaatccatttcaagagccaggtagctctatcatgtcccatggccatggacccactgcctataactgtgacaacagcctgccacattctccagtcacggccaatcttttataaattcatgcccaaggtgaaggggccagattcattggattgtgaaagtgtagaattgtgcagagcacttctggcctctggggccaaatagatgtgcatttgtatcctggccccatcttgtagcaagtgtgtggcctgagtgagttgtttaacctgtctgagatttagcattctcatctgagcctaaggaaaatagtcatctcccttgcatgtacatagtctaatacctggaactcagtaagtgttagtcttttcttccttctatcctattgtagacctaaaggggaactggaagagcctaaggtgggcacaaatgtgtcaggcatagaggataacttaaaaacacgcatctgctgtatttagcaaataaatctatacatcacaggtgcagtggaagcaaacatgaaatttgaaacattttctctttaaaatcttcatttaaaaaatactgtattgttttccaattccagatcaccttttttttgttgttgttgttgttgtttttttgagatggaatttcgctcttgttacccaggctggagtgcaatggcgcgatctccactcactgcaacctccgcctcctgcctcagcttcccgagtagctgggattaccgtacccagctaatttttgtagttttagtagagacggagtttcaccacattggccaggctggtctcaaactcctgacctcaggtgatccacctgccttggcctcccaaagtgctgggattacaggtgtgagccactgcacctggcctagtgatagtcctgatcactaatttctgatcaggagtaacaacaactataaaatctattcacactcacttttggtcagtaaggcatttaaagagctaattcaattacactgagggcagcaactccagactttggtttattcaacagtaaaagaaggggattggaagaagttgccttgagaaacaaaacctaatatatatatacacacatttagaaaacaacatcaggagtttatagaccttttgaaaccaaagccaccctcccatcctgggccaagactctctgaacttatccatcagtgaagatcactgacattgtaaagatttgcttttctgacatccataatatattgtctgcagtaggatatgtgcgtgtgtgcgtgtgcatgtgtgtgtctctgtgtgtagactgcttaggttttcatttattaccccctgctcccatgacagtttttaaagttcttgctcttctgaatcaagcggaggcagagcagggtttgcacatcaatgaatcaatctctttaataaaaataaaggaaaatattgtaactggttactaaagggaagatgggtgatatttgcaaagtttctgtagcattataaaatacctttacacttttattccatagaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataaggtaatgcttttataatattttaactttaagacttgatggaaaagataaaattcccaaatgaggggctgagagctaccattctggtctcataacaaataagctgcctgatcccacatggctcacttgccctgtttgagccaagtatcctcactggcttgttgtcaagagctgatacatagtattaaaatatgttccacagtagtttccctggatttggtgttcaataaatgatcacagtttcttctcccacactcttccttcattttccttctctttcgataagttagtttttaggaatgctagtttaaggatttccattttctcctgtcacatgtacttaacatgtaaaactcaattgtatatgtttttctgaatatattagttcattttataaaattggaaatggtaatgcttttataatattttaactttaaaactgaaaaatgaagaaagcaaaaatcactcataaatccatcacagacttttttttttctgtgaagcatctgctttttaaaagtggtatattttatttttttatgttttttcctctaagaattacgttgtgactatcccttcacatctttaaatgatcttctaaacatgggctttcagtttttatgtgcctggtttcatctaactaacccccttgtttcgtctaactaatcccattgttattggacatttgtgaattgcctatttttcactattatttaaaggctaaaatgaataccatttccacaaatccttgggtgtttatatgatttgtccttcaaccaaatccctaaatgtagaattactggatcagaggctgtgagcatgtttttatgtctttttcctcacactatcaaacttgtctccagggagctctgccaattttaccccacacttgaaaaaagaatcccaattttttgtcacctccacaacacagggaaataatggtcccagaatgtttaaaatttgatatgaaaaatttctaaaactcctagtggttttttcacttttcttagtaataaattaaacttttgtatatatttattgcatcttactgcaatcaggcaattttgtgggttgcctgtttatttttttctgttttcttcagttggtataccttttacctgttgaattttaaaagctcttatacaccatggaatactatacagccataaaaaagcatgagttcatgtcttttgtagggacatggatgaagctggaaaccatcattctcagaaaactaacacaggaatagaaaaccaaacactgcatgttctcactcataagtgggaggtgaacaatgagaacacatggacacagggaggggaacatcacacaccggggcctgttgtgtggggtgggagggtaggggatgtatagcattaggagaaatacctaatgtagatgacaaattgatgggttcagcaaaccaccatggcacgtgtatacctatgtaacaaacctgcacattctccacatataccccagaacttaaagtataataaaaaaaaaagctcttttagaccacgctataggaattatatatacacatacatagcgtgtgtgagtgtagtgtgtgtatgcataaaaaacatacgcactcccatccacacacatacgcaacacaaattgtgtagttcaggggtccccaatccccatgccactccccctcactaacattaccacctcctgtgagatccgcagctgcattagactctcacaggagtaagaaccctattgtgaactgtgcatgcgaggaatctatgttgcatgctccttatgagaatctaatgcctgatgatctgtcactgtctcccatcacccccagataggaccacctatttgcaggaaaacaagctcagggctccactgattctacattatggtgagttgtataattatctcattatatattacagtgtaataacaatagaaataaagtgcacaataaatgtaatgcgcctgaatcatccccaaaccaaccattccccgctcaacccctgcccaccctggtccatggaaaagttgtcattcatgaaatcagtctctgtgtcaaaacggttggggacagctgatgtactttatatggaataacaaatctgaataatatgactctgtcgtggaaactttaaagacctataagagagtggtctgaacagaacttgggaaatctgaagcgagtgatgataatatccttgaaatttttgtttgtgccttattcttgaacactgtttacttgtgatttccaaagacagctcttatctgaaatgttttctaaacactcgaatcagtcctgagttgactttattctatttcccatcaatgtacaaatgtgttacagtatatgtaaattagtgaggcttggtgtgctgagttttaagaaattccgttcgggtgcagtggctcacacctgtaatcccagcactttgtgaggctgaggtgggcggattattaggtcaggtgatcgagaccatgctggctaatatgatgaaaccccgtctctactaaaaatacaaaaaattagctgggtgtggtggcacatgcctgtagtcccaactgctcgggaggctgaggaaggagaatcacttgaacccgggaggcagaggttgcagcgagccgagactgggccactgcactccagcctaggggagagagcgatactccgtctcaaaaaaaaaaaaatgaaattccaaagtgcagctatttaaattatgagcattggtgcaccaaggatatttagctaaacaattgaccacagggctaagtattctaagcctgttgactgatcatgacttcacccgagagcaaggaggctaattcagtagataattgattggaaaggaaaatgaagagtctctgatcttttctatagcttgaaaaaattagtttggctttataaaattttgacttatacataaataatttactgacgtgaggtacacatgtgggtgcttcacgggcacattctatgcacaatgggtctagccccagtggctgccagctctgagggagaagtctgtgggcagtaggttctccttgcttggtgtttgcagaaacagtgtccaatggtcaaggatggccattcagcccccagacatcccatgtggtccctgcatggctctgggacctacctctgggtgtcagatgtgctggattgaagaaagtggctttattacaattagtattaattcctgtgacatgtatggaaatgtgtgtgtgagagagagagatgtttgagtgtacctatggatttgaatattgctgatgcatttctaatcagctcgctggcttctgatggagggtgtcaaaggtgtgggtggtctgctagctactcattctctgagtaattctccacccatcccactatccaccccttggatgcatagtccagaatacacaaaattggactgaacatgtatgaaatagagttgtgactcaagcaagggtttttgaagtagtgttctctctctctctctgtctctcgctgtttctctctctctgcatgtgtgtaaaagagagagatgaaagaatattgatgaaagcagctacagtgctcatattgccccatgctctacttcccagcatatattaataatgataatcatgccaacagcaatgggatcgcatttaattgtttcagtaaaagtagtaccaagtaactgggacatatgtccaggaattgctactttccattcttttttcctttttctctaaagatctttaactcaaaaatttggatcactgtaatatcaatttggcttttacttaaagtattttaacttgttttattaaaaacagaactgtaaaaagctactactggagaacaataaaaacccaacgataaagaagaacgccgagtttgaagatcaggggtattactcctgcgtgcatttccttcatcataatggaaaactatttaatatcaccaaaaccttcaatataacaatagtggaaggtaagggaaatcttagaattgggaagaaacagacgtattttagtaaaatggaattttttcattcttcaaaactgtgtaggaattgagagtccacttagttggggttgtgaccacaccactagttcaaatatgatggtcaaaatcttcattccggtgctcctctacttggctaaataaacctttctttttggcaggaaatgaaaatctgtatgaataaacctcacatgagtcagctctctcttatatatgaaatttgagtaaattgtggaatcttttgttgttgaatttacattttcactttacaagtatttagtgaagatatctatactcaataaactgtacttagcacaaggaggcagggaagcaaggaagtatgagatgaagtgagcactgtactattctcaagggatttgattctaatcaggagaggcaataagctacataaaggtgtatgaaacagcatcatctgtgaggctgcaagagtgcagggggaggttggaggaaggacagatgcaggaggctccatttgacctgggtcttggagggggagcctcatgaaacagtgacctgctgggggaagggatctccactgggagagtgtaaggaacactgatgtgctggtgggaggggagggatgctggacccaggctgtgtgtgatggaggaacagaatcctgggacattaaaggtatttaattaaacctcacccagtgaagatattcatcataaggcacagccaatgattgatcatccagtcccttcttgggaactatcaaggaaatgaccaaatcacacagcagtgtagtccagattttaatatctgattgttgaagtcttttttttccattgagtccaaatatcccttctcgtagcttccaaccactgattttgatttgccttcaagaatttcacagattaaatctggctccttcttaaaatgacagctcctttcgtgatttgaagacaggttgcttatccagtctggatttttttccccatcatcctgagaaactggaaactgtaacacttgtgtgggtggcttgttcaacaaaatctgtgggctcacatttgctacagcctttgctttagcaacatctttcttcttcactacaaccatatagctatatacacccacatgttgccacagtaacaaattatcccaagtttagtgtcttcggtaaaatcaaggttttgccagaattgctttacttctggaggctgtaggggaaaatgcgtttcttttatttttttatttattttatatttttgagatggagtcttgctctgttgcctaggctgcagtgcagtggcgcagccttggggctcactgcaagctccgcctcctgggttcacaccattctcctgcctcagcctcccgagtagctgggactacaggcacccgccaccactcccggctaatttttatattttttttagtagagacggggtttcaccgtgttagccaggatggtctcgatctcctgacctcgtgatccccctgccttggtctcccaaagtactgggattacaggcataagccactgcaccaggctggaaaatgtgtttctttgcctttgctttctccagcttctagagaccacttgcatttcttggcttgtgccacttcatttcagagccaaacacatttgcttccctcacctcatctcctttttgactctgacctttctgtctccctctgatgaggaccttgagacagcattgtgcccacctagataatccagggtgatccccctatctcaagatccttaatttaatcacacctagaggttccttttgccatgtaacatatcgtattcacaggaactcaggagtaggatgtgggaaacttcagggtctattattctgcctgccacagcccagaacctgggaaacccataactgaattttaaactcaaaaacttaaattctgtgtataatcatctaccctaaactctccaactttactttcctacatctatttttaatctcatataaatctctgttactttgatactttcagaacctacaccctctttcccaccatctttgctttctgcccatcagcagctctttccttccttctttgatgaagctgtaggaatatccattattaaaagggtgcttgttatgggccagggatagtgccaagtactggagttgaatcatgtcatataatcctcacaacagctctatgagactgtggccttgggtgagttaatttccttagttcctctctgcctcagattcctcatcatgaaatgggacagtaatggttcatccctcgtagggttggctgacaatgactgagtgagtgtgtgtacagctctaggatggctctagggacagtaagagttctgctgtaatgaccatctcccactgctaggttcccaaacctcacctgcagcacaagctattcttctcccataattgtccatcttatttttcttgtcttcttggagaatgtcaactgagtctctcaggactccactcaaatgtcgctcctccttcatgcccccatggcctcttgtttgtatttctgattgctgtcagaattgcaatacatgtgtgtctctgtcaataacttgaaaggtttctggaaaggtttgcactgacttctgttcctcatctttgcatcttggatacctacaattggcacttggcacataaaggtgctcattacatgcctgttgtgtgcatcactgagacagaaacaactcctttgatgccacatacaacaagaagtctagacacttcaccatcctggctatttttctttggatttggcaaagtttgccacgagtctacagaaattagagcttggagttggggaagacagccaggaggtgttctgacctgtgttgaggacagagaggttctgagctcgtgccttctccatgttgtgtctttattacagtccccttgccttcacagatggagatctctcagctgctacatagtgactgctgtagtggtggaaaggtgtgatacctctcctccccatcctaagggtcatggcaatgttcccataacaaaagacagattaacaaggggcaagcaagttttatgtgacatgggagccttcagaaatgaagaccctggggccgggtgtggtggctcatgctggtaatcctagcactttgggaggccgaggcggatggatcacctgaggccaggagttcgggacaggcctggccaacatggcaaaaccccatctctactaaaaacagaaaaattagctgggcttggtggtgggcacctgtaatcccagctacttgggagactgaggcagggagaattgcttgaacccaggagatggaggttgcagtgagccgaggttgtgccattgcactccagcccaggtgacagagcaagactcggtctcaaaaaaaaaaaaaaaaaaaaaaggaaagaaatgaataccctaagactcagggaaacccgtttttttctttttaaatgcttaggttctagaagcatggacagccatgtagaaatgtgattggacaaaagggtatgacctaatgctaatggactgagtggggaaacccagcaagacctgtccagattcttcttggcctctctgttatatttccttttcctgggtagagggcagagggtcttaagacttactgtcagaccaaagaaggccaaagaatttatagccaactcctagacagaaaggcaggagaaggttagagtcatgcttctaggttctatggcttactttggggaaaaggattctagtttttatgatctgcctttgggaagagggagtctggtttctgtgacttgctttggggagaatggaggcatgaagcaggagggtcagagagatcttgctttttgaggctgctttgaggccttccaatgtcgttgagtttaaagtactcagcctgccaaaacaccatactttgggactgtttttggagcccaggagttccattgccttcagcttgtgctcgtgaatcacagtcacctgaattcctactgggcatctgccactttcctggtcttatgctctggctgatcgggtggcgtctcctcctactgctgacaacctctatgccattttgactctgatagcctcctaggtaggctggccatgtcaagggcatgcactaagatgttgtcttccttccatgacctacatgggactgcacccttcactttacaccagttgtgcaaactcagggctgatctggatttccaatgatataatttgagtgttagtagacagcatcctttgctgaagatgtacttcacactgccccttctcaagtctcccatgtaagtttctgggggaaaaaatggatccagagaaaggtagtcagtagcagttttccccctcacaccgaaattgcctcctgccctttgtctttgaattcaagccggtgttgcttcttactgtcagacctgagagttagttctttccctggatacatctcagctcctcctgcctgtttgccaacattccaggcttgcccagagactccaaatcccaggataacccagacctgactctgaactccggagtccactgtgctggtttcattctcctgttcttgctcacatatctgcccactgcattctcaactgctcactctggcactgcactttctgagagggctcagggaggtgtgggagctgcaggagcactcctgagtctcactgtactccactcaaccaggcattctgcttgctgagcacctgcaagtcccagaagggatgttctggacattgcttgggaatgcctccaaagcagtggggctactagcagggaacagtcctggtcatgaggaaagttaccaatgaggatatcagggctaacaataacttgactatgcaccagttcaaatctatgaccgcagctgctcttagggtttgcagttgccagctgccttaagcaagagcctgttgggtgatgacttacttcccaagcatcaccagatggggactgagggggcagaatttatgtgcagtacttccagtcggggtcagaagccactcaggagcagaagtagaacttggcctacaggcatgaacttaacagcagggccagggccaaggtgaggttcctggggcacaatattgaagggacactgctctcagcatcctgcaagggaacggtgggcacatagagtgagggatttgcttttctcaacctgtcttggccctgcaacctgtaaatccatcactggccagctgaggaggacagatggagagaatcgagacagggcagaaaggctcttcccagtgattttgcatggtttgactcttgcacgtttgatcatctgagagtcaggctgcagtggatgggcatcttcctctgccttttagttgaattgagcagaagctgcagatctgagtgagagaaaaccagatacaaggtgctttcaacatctgtgacctttagttaatgcaaataggactcaagtgaacgtaaaccagtaactattggaatctttgttacatgaaatgagcatattatcatagatgcttgtcataaagaagctcaaggcaacactaatacatttgtcttttcttttgtcacttctagatcgcagtaatatagttccggttcttcttggaccaaagcttaaccatgttgcagtggaattaggtatatttcaatatacatatattctgcatttataagtaggggacataatagagccttccaagcgtaaatatgattcattattgaatgacactggatacacatttcatatttactgaataacattacaaaactaagaaaagagtgccattttttgaatgttgccacttttaacctgacttaaaagtggcaacattttaaagttcaagagacagtggaactgcctgtggtctgtagactaaggtttttgttgtgctgtgtgtggcttgtctttaactctctctatggtcatttctaaatatgaaaatttaggccgggcatggtggctcacgcctgtaatcccagcactttgggaggccgaggcaggtgaatcacttgaggtcaggagtttgagaccaacctgaccagcacggtgaaaccccatctctactaaaaatacaaaaattagccaggcatggtggcatgcacctgtagtcccagctactcaggagactgaggcaggagaatctcttgaacccaggaggcaaggttgtaatgagctgaaatcacaccactgcactccagcctgggcaacggagcaagactctatctcaaaaataataataataataacaataataaatttaaaaattccgtgagagcactctggagagatgagtcaaactaattttgtggtgtgaatgtttgattaattgattcactttgaatcaattgactgaattgattgtatatttggagtttgtctagataagtcttatgaatcaacatgtccaattgagtaatttctttcaaaagagaaaggaaagaaagaaaggaagaaattcacatatgctacatatgctaagccaggtatcatgctaggtcattgaaatatattgttgaattaaatcctccaagcaacactgaggcatgtattctcattttatgaattaaataattgaagtgcaaaaaggctaagtaacttgtctaaagttaaatcactaaaaagtggcaagtctctgtttggggactttgcttccaaagtccccaccttataaccacagttggggtcacagtggtttatatgaccacatgggcccagtgcagctgggtcctatgccatttgtacatgaggtttacctgctttatatttttatttatttctgtctttgtctttcttatttttttcttctactcagtggggcttaacttgtatcttttgttctagtttgttgacctgaagagttagataattaattttaattatcctctggtagtatatacattcaaactccaagtttccctgtaaacactactttagctgtttctcatattttcattctattcagtttaaaccattacttaaaatttcccttatgatttctttttccaacaaaaaaaattggtatttcttaatttccaaatatttggtgaactttctagttcttgtctcttattcatgtccagtttagattcattatagtccaagattatacacagtgtcatttcaaccttttggaatttgtagtgacttacttaaggcccacagtatggtatatcttgctgaatgttccaagtgcatttgaaacaaaggtatattctataggtttttgttttattattctttaaatgtctatttggttaagttcattaatggtgttgttcaaaaaatttatatcctgactaatcttttatctgcttgttccatgtgttgctgaaagagatgtgaatatctccagctattatggtcaatgtgtctctatctcctttagttctgtcaatttttgtcttacatagtttggagctatcttatatgcatacacggatttatgctcgttgaattaacacttttatcattatgaaatatctctctttatctatcataacacttcctctctcaatgtgtagctctgtcatatgaaataatcacacaagttttcttttgcttggaattggcatatttgtctttttttaaacatccctttactactaacatttttttttgttctatacataagtgtctctcataaactgcatgtatttgggtcttttttgaaatatggtcagtatggtgtttagtccatctgtatatttaaaattactgttacagttgctatatcatatatgcatgatatacaaatattcaatttattctttttaaaataaattacactttgttgaaaatgaccatatttccatccacttgtttatcttttcctctattttctttcaaacagttacagtttttaatctgctaaattcagcatctgtaggtctgcttctattagctgtcttttctattgattatggtgcacattttctgtgtctttgtatgtctcttaactttttattgttgttgatctttatgtatcaaacaattaaagtgaatacagtttgtgttattttttcttacaagtaggtagcctgagagttgagtatctcagttgactcagaattgagttggggtggctgggatgtaggtatgttcactccaatctgtcttcatctctgatagctggtgagggagggggtgctgcagtcatgtgtttgatgcaggcctcttctctaatgagacttgctctcctgattaccatgagactgcaagtgatatcatacagcctttacatccttttacgctgtccgagcgcttagcagtaattctgcaagcctgtgcagctgccgagagcttcactggattttcttgtttctatgagactctttctgttaattacaaaccaaagcaaattctgccatggaatgaaatggccacctatcttagctcaccctagaaaggatccttcttaagtacgcttgtagttcaaaaatttctctttattttctctgtactttgatgtctttaatgtttgcttaatttaatttttttgtgatttatccatttggtttatctagaagtctcagtgagagtattgtcctgatgctacgaaaagaaagtacactgatcactctaagttttaatagttgattaaaaaataaatgtttaaaaagaagccaaatcatgttttgatgatgacttgtaattgctacctatttcttctgctttatatattttgttttatttaaagcaaggcatatttattctctttctgggatggagcaccacgttttgctttaggttaacatacattgattatattgttttgaaacttttaagaaacctgagtttcaaaaatcagaactttagttgccaacttttaccaggaaaaaacgtaaggctcaactgctctgctttgctgaatgaagaggatgtaatttattggatgttcggggaagaaaatggatcggatcctaatatacatgaagagaaagaaatgagaattatgtatgtatgtgtaatatatatgtcatgatatataccatataacaatcatatatattatatataacatcatattaaaaacactgggtggctgatgtgtattttgggctagtttaaattataattataatggacatattttataattatagtggccataccctaggtggacgcattatgcagaaatgtattgccaagatctaagctggaaaagaaggtccatgagaaggccattgagggtatttagcatcaccttataaagtagcacttggtcagtcaggatccgatggggatggggattttacttagcttcttagaaaagggcagttgcctaggccaagcttttttttattttgaaaaatttgttaagttgtttatttttctaatgggccaaaaaggctccaaatggcatgcatattgatagttaaataagcctatattcttccattaaggaatggtcaaacttataaaaagaatcagtctaaacatatagtcacctaagcttttctgaatgactttgggtcatactgtaagtattcattattatactgatacactactcagggtctagtgagtgctgagcctaagttgtctaccacctttgctgcacttgttgagttttttcttctgctttttacacattttttggtaccttctttgttaccatgcttgcagctctacattcttgctgacacttgtctacaagctctttacaccacaaagtctggcttcttgcccgggagcaggcatgtggttcatgcccactacatgttgaattcatttgaaatttgtggatctcctgccatcatatctcatcctcagccactggcctccatttgagttttgtatttctccctttggataatctctttctaatttttagaggggtagaaaaccacagtgaatttcttagaaatgcagcttaagctacaaaagcagagaggtctttctttatagttgggtgcacacacctttgatatcatctgttttgtcctctcaatggcctcctgtgttttacttctggatttcattggttttagatggttgttatttctggatgggtgacttaggaaaagaattacattccaaaatgtacttgaggcagttggaggctacagtggggctctgtgtcccgggtcctagatatccctgttgctaggaatgtgggcacatggggcccatgtctggctgtgttgactggtgtagctatcagagcctgtcattggtgggggaagtggatgtcataagtgtttacctggcatcaaccacaggacaacttgaatcctttaaggaagagaaaaagaacgtgctgccagtggctttctcaagtcattttctgacactcatggaacaacttaactggcacttctcatgtgcctcggggtgcttgagaacagtgttatgttttttaatgctgaacacattaaaccagtttgttggattccatggacaaatgtaatacgaatctgcatctatgctaaacaacttacagccttgtcataattagtgggaaccactctgtggaaagaaccccaagttgttaggaagagagaagtagagaaaaataattgagagagaatattttcttatattttcaacttagcatcatgatcttccagccatttaaacttcaggtaattgacagcaccattcccaaatggcctcaggagggctgtttctgtcagttctgatgctccacggaggaggggacgtttattgtagtccatgctttaagagtactggccagaaagggaagaaataatgcaggcaacatcacagctgccttcaagcattttaaacatgtgaattcccctctcaagggtaacgaacagagcctactgctaaattattttgccctcttacaggactccagaaggcaaatggcatgcttcaaaagtattgagaattgaaaatattggtgaaagcaatctaaatgttttatataattgcactgtggccagcacgggaggcacagacaccaaaagcttcatcttggtgagaaaaggtgagaaagatttatttttggaagttttgaaacttagctcattgctactgagagacatttcaaagatggccactttctcattttccacaccagaacccagctcctgagaggggaaatcagtcacctcatgtcacaggcattcagtggggcccctctgtctcatgatgccaagcagagaatgaaaacagaactcattcacctgctctcacagtcatattccatcccatgtggaaatcggggggcctgaggcttggagatacagatgctgagagtgaggctcatggggaggccatcaggacaacccctgcacccagcactgcacccagagcagccagaggggagtttgcagatctgcgtggggtgaggccagtgcaaacttggtgtgactgctgctccagcctgcctcagcagggtaccaggctcagggtccttgtgtgtgctcattcattcattgcctcctgaacttggcaagcaggccattgatagccctgatctgtgggctcttaaagtttttcagtgctcacctgatggagggccccagggtcgccatccctttcctccaccaaagtagcacagcccagggccttcagcccagtagctgctcagaaatggctgtgactggagccagaaagctgtgatttccagttgtcactactcattcactgttcattcccaggctccaccatcaactccctggatatgtagagaaaggtcaagatctgcaagagagagagaaagggagagagacagagactaacacacccagagacagatggagacggagagagacagacacagagagaggagaaagagagatacatgagatggagggacagagacaaacagacaactctagagagatgaagacagaaagagaaagagaaagagagacagagacacagagagacagagaaatgagagagacagggagagacacagagacagaggaacagagaaagagggagatagagaggcagagacatgaagggatgcaaatacagagagatgagagtgaaacagacagagagacagagtaagggagagatacacacagacacacacaaacatgcagagacagccacacacacagactgggccttggctttgtgagaaacggaaggagtgggacaggaagagcacaaaggctggaaaccccctccagctgggctatcctggtgcccaggggcagctcccccagcacacatgttttagagccgcctctctaccatatgcactcataacaacagctcacatcccatacatgttaattacatgacaggatctgggtgaagttcctgccatgatctcatccagtcttaacgacaagctttatagaggtgaagaaacttgcccagggtcacacggcaggtgaaggtattgaaactcagacccgattaaatctggaatctgtgttcttaccttctgcagggcttgtcgcctgtggtcttccacccctgtgtgattgcctgtgctgtggtccactcacttgtgagggagcggggctcaaatctttgttggaccatcacctggccaggctttcctggggcctgctcaccaccggatcacctctcctttcttagaacagggcaggactgtcctattcctgccctagacgcttctggccagtcaattctcctgctgctgctctcacaaatgtaggtttagaaattggggctcacaacccaccatcaccccgtgccaatgtgtgcgtgcgtgtttttgcaaatgtgtgacacagttatgactatgcagtcctttccaaggtacaggagccccagaccctgagtctgctcagagttcactattaaacaacattagctgcttgcctgaatcctaaagatagtagaaagatatggaaagataatttttaaaaattgcaccaagatggcaaaagttttaagcacgtttatgctcattgacctagagatgcccccaccattacaatctattttaagaaagaattagaaatatggataaatgtatatgcctttttgtatatgtatatacatatatgcatgtatatatacacatatttgcaaatgtatatgcatatacatacaaggttacacatttatataaatattatacatgtatacacttatacatataaaatgtactgcaactttatgtctacttactaaaaattgcaatcaatctaaatattaggatattatgaattataattttaatgacctactgaaatgctcataatataatattcagaaataatgagtgattaccatataatctcagttaactaaaaagtttaagagacaaaaagaaaacccagaaggaaatattctatcatgttaacacagccttcaccacattgtgatttgttgttaaaaattactttattctttttattcctctgtattatctcagattgtccataataaacataaacggaatcaatctagaaaatgtatttttttccaaatgatacttttatacaaagaatttgctaaaattccaagagctgtgtgctgtattaactactttttgtgtaatatttcatttaatcttccccaaaggagcagccttgtaagtgaagcagttagtatcttcattttacagatgaaggtaccaaggtttaagggcattcacgatttttcctacaatacaaaataattgatggagcccagctgcaaacccagacaaatgtcaatccagtgctctctctcttctctcaaaactatgcacctcaacccacttgctaatatttctgtgagtccctatgtgtttcagcctagtatctcttcaccccagaaatctgatttccacgggtacggatagaatacattactgtgtaatgttttcacttcagttctctaaatatccgtgtacacatttttattctttaaaaatctgagtagaaatatcactactccagactaaaggcaggaatgtggagtcactcagtggaatgtgtcagcacgtgggttggcaactactgcattagtgttagcagtaaaaatggacaagcacgtgatgatggacaacactggtaagatttcttgattattttcttttcctttttccctttcttttctagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacaggtaacacatataatgctggaatttcttaccttatgttctcattaagaaatcagataaataggcattaatcttcatcttattgtgatgatattgtagaattaatctgtgggagaggttttctatgggaaatattgttctgcctgtaccatccattatgaatgttgtctatgtcttcttttcttgtgcttacttatgtgttgcccaaaattgttctgattgtctcgtgtatgtatgtcatagcttcctaaatgccctgggagatgctcgggcccaggaactgtatatctgggtgtctttgtgcatgcatcacttaggtatctttatagtacatacactcaataaagttgctttaagttagattgaattgtcctatcgctcattatttcaacctggcaaaggaggcttacataatggacgtgtaagaacccccagctggccgggcgcggtggctcacgcctgtaatcccagcactttgagagtccgagacgggcagatcacgaggtcaggagatcgagaccatcctggctaacagagtgaaaccctgtctctactaaaaatacaaaaaattagccgggcgtggtggtaggcgcctgtagtcccagctactcgggaggctgaggcaggagaatggcgtgtgaactcgggaggcggagcttgcagtgagtcgggatcgcgccgctgcgctccagcctgggcgacaaagcaagactccgtctcaaaaaaaaaaaaaaaagagagagaaaaagaaccccgagctggaagccaaatgatctggaatcatgtctcctagacctgccagtttttatctgctactatgtcgacccgctggctctatgcctcagtttccttatacttaaaggtgaccagaagtcctcaagtttccagataattactaatttaaaggaagtcagtctaattcattgcacttgattttgttttgcatgtgtgtgtttgcaggaaaaaaaccttcacagagttcaaaacccaaaatgtctatgaaattatacttcagtagccccccttccagcctggtcctggatctatgattcccacccctcattgatagcacatctgaccaaatatcaatacagattcttattacacacctccttttaaaaagaacaaatcctggcttaatatgcgcactcttttcaactttgctctcttataccttagacacacttgcatgttactttataaagcagtccatcattttttagggccgcacagtattttatttgtgcagagctaccactgtttatttagtctccttttgatggacatttggcttgtttccaatcttttgttattataaaaatgctgcaatggacagctttatacattcatcgtttcatatgtatgcagtaggtctgaaagaaaaattctccaaaatggagtttctagaatacaagaaggagacacagccattattttgctagatactgtcaattcaccctccctactgccttcaaaagatgacagcaaattttttcccataaccttacccacaaccatttggagttgtgccaatctgataggtgaaaagttgtatttaagtgacattttaatttgcatttcccttactatgcaagagaaccagcaacttttcatttgcataaggctcagctgtatttcctttctcaacacacccattcatatcttttgcctattgttccatggggcaatggctttattttgcgtatttatttctaggagctatttatattttagggaggttagcttattatctataatatgaaatgcaaatattcccaggctgtaatttgtcttttgactttgcttgtagtggtgtgctatataaaagattttttgaaaaacatactcaaatgtatcttttatggtttctggatttgggatcataagcaaaacagccttcttaacctcaagttatacaaaaattatattagttcctctgagatttttataggtttagttttcacatttagaactttaaattgaacaacataaaattagcaaggttagtgaatttagctttgagcctgcatgtgcacgtgtgagtttgctatggggagagatgatgctgtaacaaacggggaaatctgtatttgatattttctgaatggtctctgtttgcataggccagtgtttgtcttcaaataaacattgactagctcctctctttctgactttctggagctaagatttcttttttccttctccagttgtgtttgacatgatttgcggtaattttttcaattcacacttcttaactgtcaatatggcagtgcagagacatttagagacatgctctaaatcacttccattaaattatggtccatgaacaaatgcagtccacgaaaaggacagaaatggagatataagtatgaagataaaaacttttatcacaatttaatactgctgcaatatctaagaaagtgttcagtattggtttctgaaggattggaaatgaaactaatcaataaacaacaacaaaaaaaggcaaatttaaattaaaacatggtcattcaccaagcatagtttgaggaacatttgtttaacttactccttgaagtcccaaatatccacttgaattataatttcctttataattttcctttatgtttgaatatagagaataaaaacattaccattagttttcaaattcctttttttgaatactttactctgtcaattctcaagtcccctaaaccttttaaaacctgaatttaaaatatattgtaataaaattagcatatttatattaaaagaattgcttaaaataaggaatttgaaagcaattaatagttgaaaagctaatttttcataggtaagagcaaagctatattgtatgtaatataaacccatatttgatgaaatcgtcttcccagtttgttgcaatccattacatcataagaaaattatgccctttaaaaaagtgtgctcatttaattgtcttacatgttgatgcctgttttgtcactgacacagtgacaaccctagtggaagcactagctcttacttaactagtagatagttatatttgatagcagtttaagaaaagtttgagggggaacctacttactgattgataactggttttatttttaccaacatttcatacctttgatatttatgtaagcctgaaatttttaccaacatttttcatctttcaatgcatgcaattctgcaaagcaattgctttaaatcaacaataggttctaacccaaattgctggacagaatgctgtaagtagaactgaagaagattttgccagaagcagaaagtgttgtttggtgaccatgagtgctatggaggatgccaggctgggctgttaagcataaatgatgtggcaccataagagacatagatctagaatggttttatcctattagattttaataggggttgcagttatatgtagcctcaaactcagtagcaaattcattaatcccaacaatatgccatgcataaatcttacccatctgccatcatctgccatcaaaacaattgtcatgggataaaggtagaccattccccactactttccttctttctctacagatcccaattagcatccattgcattttttaggacctgactcaaaatttcctcctttcagaaagcatgtccatcgggatcactctttattctctggccaggttattttgtctgtgagttttgttattctttttttgttatgctatttttcttctgctaatgtgttgtctgtaactttttccaagttgttgcatgcatctgctttgcttttaaaaatagattggatgaagctagaagagagagtggtatcatgttttaattacccaattaggagcatggtctttgttatttaggagacattttcaccttcttgggggtctttctgagcatagaaattgtgatggtggtagaattaaatgatatgagtaaaccagggtgagattttctttccactcctggaatgaggacacctttgggctcttggccttctaaggaacttaaagacttaagttcctttagtgcccagatctatggctcatatatctctgtattcttctgtggtgtcaagcagtgggatcttaaagtagatgcttaaaaacacattggctaattggttgcttggttagcatgggaggtttaaatataaacaactttatatataatttgttttttcaatgattctatactcattacttacgacattcacttaagtttgtacttaaataaaattttatttacacatgaattaaaagagccaatcttacctcctagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggaggaggtaagagggaatgccagatagaaaaatattcaagatagtttctttttaaaaaatgaatgagctagcccccagagagctatcccattttccttaaaaacaaatgaataaggtcctttaagcaagaaataaccacgtaagtcaacaatcgatagtgagaaaacaaactaatgagcttccaatagtctcttctcttgggctctgttctttgtgcttcacggttctctgaaactttggggaaagggagagggcatttccttttcagaaccgggcccagagctggcgttatcatgaagcctttatttagaaatgacccacggtgagaatatctgtaccacagcagcagttcctaatttaacatgtgatgtgtggactagttaatcctcactagtaactcttactagaaataaacacgggttaattattactagaaaatgcatgggtttttattgtgttgatattggtgacgaaatttaagtagaaaataggaaaattgaaaagggaaaaataacaggaaagcggtgatccccatcagatcatagctatgaaattcaatgttttttttattaatataggaatacaaatggccatagtgcctatattaaagcaaattactgttaaatttttctttttaatgagtaacatttttagattttctctgaagtctttagaacaaacatttaaaatctggtgtcaaattattctggatactgatgcttaaaaaaaaaaaacaaatgtttgattattaccatcattcatgtattaatctaatatttattggatactattcctgtgccaagttgtgaactgggcatcaaagatataacagtgagaaagaaatagttacattcccccccatattacaaagtagaaaggaaaatattgctaacttacactactgtttagtaataaacaacttgtcaaaaaaatatgccagattatcagatgcatacattgtagtatttttggatagcagttctttgcatctaagaaggcatattgttacttaggaagcatttattctgggccatacatcaattttactatatttccgttattttctaggggcctttcttgaaaacagatttattcttaattcataaataaaaataatgtttgaatattcagctgtaattaggtttggttaaacctctatttgagaacagtgagaggtctagaacaggggttggcagtttaccagccacgggttccatcacacctgcaacccttattgaaacacagccacgcacattggtttacctgtcgcctgcgtctgcatctgagctacaacaacagaactgagtagttgtgacaaagacagtgtgacctgcaaagcctaacatatttactatctggccctttgcagaaaaagtttgccaacccctggtctaaaataatggatggttttgttttgttgtgcctttttgtcttttaatctttaaattctgattttagcatgctcttttctgcttgaggagaagcaggatagtataatagttagaaaaatgtattccacttgggtttagattctgattctgccatttactagctgtgtgactctgggcaggttacttaaccactctgtgctccggcttccttgtttgttaaatggaggtgataacagtatcttctctgtagcgtattatgatgattaaatgagttaatatacaaaaaacatttaaaataaggtatggtaaataataagtgctaagtaggtgttcattattattgttacctagagattttttaataagcatataaaattaagaacaaatggtttgtcttaaagaaaaacttattagtgaggttaggagttaatataaaataagactgtgcaaaatgacttttatctcatgttccccctttcagttatcttaaattaataggggttatcttgcattttcagctgttgttgatgaaatccactcactgatagagaaaagccgaagactaatcattgtcctaagtaaaagttatatgtctaatgaggtcaggtatgaacttgaaagtggactccatgaagcattggtggaaagaaaaattaaaataatcttaattgaatttacacctgttactgacttcacattcttgccccaatcactaaagcttttgaaatctcacagagttctgaagtggaaggccgataaatctctttcttataactcaaggttctggaagaaccttctttacttaatgcctgcaaaaacagtcaagccaggtagagacgaaccggaagtcttgcctgttctttccgagtcttaatcttcagaaacagtgaacgccaaaaagaactcaagatattctggggactgagcatatgaacctgttcataacaaaggctgtgactcgaaataattaactttgtcaaaatcctgctcacaatttgaagatgaaacttgtcattaggttggcgggaatgagactaaagattgcgctgtgggctgtggtcacgtgctcccagaagacctggaattcaaaagaaatggagctattctttttctccctctttcataactggatgcagctgctcatactcaatcccatattcagcaagtgtgaagctggacgtgatgcaaaataaccgatgccctacaaaaagggcgcatctttaagagttttaatgccagtgcttaattcgaatgaggggattttaagtgtctgaagaggcattttctagggaccagtgggtgactgagtaactgaaatgctgctttcactccctaacaccatggatctggttgtgcataggatgtgggaggaggggctggcagggccgccttcagaggctgcagggcctcagcctcaggatgcatttaatgtatcctggccacagttgcagccaacggttcttgaaagctcggtaaggccctgcaacgcagagcctgcttatgtggatctatttatgggaacttcttaaaaggaccccagaatagctctttatctttcacaagagacacaaattctaattgagttaattatctgggcctttcactttggatgctctgaaacatttgttgattttgtgtgaatgtttatatcaaaatgtttgccaggttgtattagccattgaatagcaaaaaactgatagttacttgcttgttttttaaaaattacatattaaaaatgcccttggcataaggcagcatggtgtggcagttaagagatgggctgtgcagcccatcctgagctccagtcctgagtttgctacttacttctgtggcctctggaaccttatccaacctcttggtgcttcagtttcctcatctgtgaaattagaatttataataattgcacctacctcccaggggtaactaaatgaataaatataataaagtacttacagtggttcctgacacagactcagcactccgtcagtgttgccatgactatttttattatcattattaatgattacttagatcaattatttagcagtggactaatggaagctacagagcagggaagggaagcagatctagggaggaaggcagttttgatttgaggaggtttgcacatgtagagaagcatactggagaagcatatccagagggcgaaagatatctctccattgtgcatctgcctcttttgacgttggaagacacatgtcttaccccccaaagggagcccagcactgggagccttcttgatgatctcaaaaataatagctattcaagaaaatcaccaagtgactgtgaaaccgtcagttcggaaggctggttagaacatgtgggagcaacatgaatgttctacaaaagtttaaagcagagattgtttcaaatgggtgtagtagatattactgaaaaccaaaaaagagtgagattgtcagtgtaagaatgtgatttaatgtttgtagtgcttacaattttgtgtaccaactggatgactaaaaagagtaaaataatttaattaatagctcatattttatgtgtgaaaacatgttagtgaacatatataatcaaaatagatttcattgctattgcatagtctctaatacatagaatgattttgcttttctcttttattatacttgctttaaaatacttgaaatatattttgcattaaatgcatttcaagttaaatgtcttaaatgtatacattagatgtgtgttttaaaatgcataaaacacgttgaaatacattaatgaaccattagtctaatgcctttatttttgaaatatcatgacgtctttttcacttactttaagattccaattcctcgttcttaacatagactcctacctgttttaatagaatatgggccattcaaaatgaattcatgcacctctctctttttaaatgtcaaattgccttgcacctaccttcttgtttcacaccttccatccaggagcaaactaattctcttctgtttctcacaagccactcaatactaaacacagggacttatacatggtaagtcttcatatgtcagttaattaatgggcatattttaaaattctggtttaaacattccccaaccaggaccaacaaataacttttcaggtataaaacagctttcttttccatggttcagatgcccttaaactgtgaagtctattttagagaatcagcacaactacctttctagggcacgtgaagaaacacctcttacatgtctgtcatgtcctagaagcatttactcattagagctatatcttctcaaagcagtgagaagccttaggccccacgtattccaaacccaggaacttgaggcatggtaagtccagggacttggtcacagttgcacacgagcggtctgaccaggttggcacaggatggcgtacggcctcctcttggagatgagcatcttggaggctgcaggcacttttctggggccgacaatttaggctaagagggcctagggcaggggcctgcggaggggaagcgggctgtctaggactggctctgaggaggaaaagagagtgagagggatgctcaggattccttataagccattaaaaacaaataggcattcaagttcagtgcagggtgaaagagcacaattgatggagcacatccgcccactgtggcctctgctgagatacagagagttagaacctccggcatctgctaggagcccccggcctgtgttgaggcaaatgactcgccagttgggtttgctggggctctcagcgaggagcagaaaggagacagttgtccaaagagaggacattagcaaaatcagtgccccaaaccaagttgaatcatagctgtaaatactcagaggaattaacctgtcaccttggtctgaagttcagctgtgagggaggggacccagggttagcagaagccatctgagcagaagctgctctgagcagtgtgaccttaagcaatgcaaggatcttcaaagagtgaccaagccacagacctaacaggaaactcatgggcaggacacagggccctccagccccacctgcgtgccatgctgatagtgatcacagtccaggctgggagcttaagaccaacacccagatttctgtgtgagacttttgaaaatttttatctccttctggcatataactcgcgggtgcacagacacaccgggagaacaccatacctcatttacgtgattgctacaatttgatgtgtgtgtttaataattaatagtgaacatgttaactgactttcaaatagtggcttgggagtcttggggttcctcagaggtgactcagggaccatcctggatggtggaatggaaaattggagaacatgggagctgggctcctggatcttccctttcacctcactgctcccaccccctccacataccacaactagagccacactgcttttatccatattgtatgttgaggactcacataacattttatttaacagaacagaatacttccgaggaggtcatggtttagatacaatgaatataattctttctagccagtttaaacagaaatcattacagaattatttggagagatgaagaaacggactctaggctcctcttccagggatgtcttccaaagtcatatgaaaaacctaggctgccaaatagagctgttgatcttgccacaaccagaaagaaatctgtgcaaccaggaagctcttgctgcagctgccagctccagaaacagataggctgaagtctaagttgactgagagccatctaatatggaattgttg

SEQ ID NO: 776 - DNA, 37774 bp, Human
ggcttgttacctggtgtctggctcccaaaagaggaatcggaagctgaagatcttttaaaaactggtctgcaactggcaacagtgtcacttccactgtgttcttttcatcaaaagtgaaccataaagccaggctagattcaaggacagagaaaacacattttatctcttgatgtgagaaacaaaatgcacatggaagtaaatgggaaaaggtgaggagttggtggaagaattgatggcagccatttttagagactagctccacaatgtctacagcaagactttccatctcctgtaagccctgttcaaactctattaaagtgatcaaattcactttaggaggcaactaaatagctgaaatagtttgtatattagttcctgcacaaatctcacgttaaattgtaatttccagtgttggaggtggggcgtggtgggaggtgatctgaccatggggtcaggtttctcatgatggtttggcaccatccctttggtgttgtccacacgatagcgagtgagatctggtagtttaaaagtgtgttgcatccacccgtttctcacacctgctttcaccatgtgatgtgactgctccccttttgccttctgccatgattggaagcttcctaaggcttccccaggaaaagatgccgctctgctttctgtgtggcctgcagaaccatgagccaattaaaccacttttcttagaaattacctggtctcggatatttctttatagcaatgcaagcatggcttatacaataactttagattcagttttgaggtctgcatcaagatctctgaaacttcacaaggacagcttccacaccccaattcacttgaatatagttccattcaatggttattgaacacttaccaaaaacaacaccttattattagcctttttcattcattcaacctcatttctccaaaacttcccgggtctcctgcccttgttcttactactgggcctgttgccacatgacattgtaaacctgaagcatcacatgcctggagtgtctgtttcactgctccttgttaccactgttggaataggcttggaacaaaccctcacatcctcttggaatcctaggtagactcatgaccagtggtggatacatttttggggctccttcctgtctgcagttactaattcttcttgtatcctcctaccctcacctcaggtaaacacttattttgctttcataccaaagtaaatttagttttcatttgtatttcatgttattctctacatatgtgtagaagcagcctggagctttgatgtgctcagctgtgccagctttacctttattagaatactagactcttgacggaggatgttatctagacttcaccaagatggtttctagacaaaactcattacaactattgtggtctcagagtttttgaagtattaaatggtttcagttgctctatcaaaggaacaatggagttttcaattatatgttatattctgagactatctctcaataggaacataaaaactcaagtaactttagactttaaatgtattttcctttatgtattaataaattattgctttataaaattggtgttggagacataatttttctttttcaaaattagaaagttaatcacaaaataggctttagtgtttatctcaaaggtcacacttttagagattagttttacaagaagaaaaccaaaacccacagttgagaaattgagttgaaagttaatattctttacaggaaattcctgtaaaggaaaccagcttactcactctttcaactaaacccaaccacaaactttatctcatcaaggaggttggtcagagaagagtttgagatgcttcttcttcagagcacttcctactgaaagaggtagtttatctgattttcctctgtatgaccatccatttcacaatgtccatggtcatttacaaaataaggttttcctttttcctccagttataatcctttatttttgagctggtgtaacgtggctattgtgtcttctccaggtatctctctggataggaagaaatatagtagaaccctttgaaaatggatattttcacatattttcgttcagatacaaaagctggcagttactgaaataaggacttgaagttccttcctcttttttttatgtcttaagagcaggaaataaaggtaagagagcagtacttcttttttttcactagatttcctaaccagaaaacataagttgggagaatagcttaaataatttaaaaaatgagttgctaatacaattacttttcaagaaatattttagaataacaaaatgggttatttactaacaaaatttacatctccatatatacggagtcttcacttaaaaaaactgatggttataaaataaacccgtttaaagtgctttgagcattttacaggaagggctaagagcagagagattcaagatatttgccaaatttgaatgcccatttaaacttaactgtaacatctttgatggcaggtactacagcttcattttctgttatccctagacaatggggtctaaagccaccacggagcatctgagaatcataatgatattagttaaattaaatactgtcactattacacgagaccaaatctctgtctgcaggtgttctctgtgtaaagtagtttaagtctgcctttgatggtgacatttctctccctgggtctcagatccctgttgacactgctttctccagcactttcctctctctcccccgtttctcaccaaaaagttttgtgggtaaagtttagttcattatttctgccagagacagctgaaggtgtagccttgaccaactgaaagggaaatcttcatcctctgaaaaaacatatgtgattctcaaaaaacgcatctggaaaattgataaagaagcgattctgtagattctcccagcgctgttgggctctcaattccttctgtgaaggacaacatatggtgatggggaaatcagaagctttgagaccctctacacctggatatgaatcccccttctaatacttaccaggtatgtgattatcattgagaatgggcactgccattccaagcaatgtgagccttggttgtccatctgtaatatgagaaagacagcaccccgcttcactttacagaaagtaaatgagtgccacattattttattcccataagcagagtctgaagcttgctttggcttaagttgcccagtgctcaataaatgatgtactctgcattttggtggctccttccgattcggtgaagcattttagtgacggcagcatggaagacatcacttagacattagatggccttcaaaaggtagatattaacaagcaagccacacagtgtgggtgtgttgtcccacataaatgagacttccagaatggtcttgggctcatgttggtcagttgcctacaatgctggcaacagctactgtaactcagcactaacccacctccccaagctctatgcttatccctgagcagggtttcccaaaagtgtctcccagatgagcgtggtggctctgacacttgtttataatgtaggttccattgttcttctccttgagaatctgatttaataagtcctcaggaagcccaaaaatctgcatttgtaataagggtttcgggtgattcttataatcaagatgatttgagaaacactgtcccagagtgatagctgcagcctgcaatcagccccaggcagctggaggtctgaggccagttggtgggtgggtgcatcagtaggcagtatctgtcatctcaaggttggcggacattcctgagtgctggagactgctgggcatcgtggtaactaatttgctataggcttggacatttagacataaattgcgggatggtagagctgggaggatcttagcaaccatctgatcttatgatttacaagtcagggagcttttttaaaaattacaaatatcccgacttaaacatcagaaattctgattccctcattctaaggtggaggaactactgatacagtccagacattttattttgcaggtaagaaagctgaggtccaaaaagagcctaagtgacttaattggagccacacagtatgtgaatcaccataatagattgctatgtgtttgttctgatggctctggaagtgtttatcattttttcagaacacagaatttattactaattgttcatttggcactctcctaggatcaggatatatgatttctgaaatgggatatctgctcttcaggagctcccaatctagtgggaggacaaggtgtaaggaacaactgatctactgcagcatggttaaatcctgaacaagtcattactgagctcctgttatcagctaggcactattcctgcagagaggctgcaggactcagaaagacaaactcagttcctgctgggatggaacttatattctagttggggagaagttttaggagtaagatattttcagacaataatatgtgctaagacaaaagtcatttaaaatgagtagcaagagagatggttgatggcaagaagggagagggcgcttctttatccaggtggtcagggaacgactctctgaggaagaaatcagggaagacatgagagagccaaacgctacagcattttgtccatggtgctctggaatctgtgcttcatcacatgggtggtgggagccggtgacgttttgggcatggaaatgaaatgcccaggcttgctgcttaggaagatgtgtctggtggtggagttggaggactgttctttcggagactttgtggacaagggaaaggcaagtggggagaccacatctttaaaggccattgctgatcctgccttgttccttggttgcagtccttgtaagaagagctgtcagttgtcagcaatggggataatgcagtgaccttaacacctatccgtggcattctgcaaggcgcattgcacagaaccccctttctttcttccatgaacacgccttgctctcagcagacagccaggtcagcatcagcagccaggtggtagcatcctgtactttcctgtactttctggctccacctggacaaagtggtctgggcagactttccttttcacctgcatggttctacctgcctcttgtccaagattaatctccccatggtatcagggaccccacttcttctggcttcctgggagaaagcagtccatgcaccctctcctcactctcacttgtatttgtcctcactgacctgctgacgcattcccctcgcagtggaatcctacccaaggccctctcatctccagaaatgagcaaacacttcctcctgtcttcctgcatcatgcagactctaggaggcgtggttcttccccgcttcccacattccctctactcctctctctccaccctgaagctctccgttatctcaccccagctgcacatgctgagcttttggtggccaaaccaagactctttggtggacacttttcagtccttctcatgcccaactcctctgcagcttctgaaactgatgtctagtctctcctccaagctttctctgtctggattgccaaggtggtctctctgctctgctccttgcattccttttaggtttgtcattctttattttccattagccctggcctacttttaaaggttgaggttcctcagggaagttcatctgccctcccttatggggcaacagaaacaatccaggcttgttacagatgccccaggctccctccagctgctgaaactgagaccctgctctgagccatatgcctccccacccctctgccctgggaatgctccagctggatccccaagatatttcaagtaagtggtttgaaaggtcccatgactgccttatcaagagaggggactcaagtcctttggacacagcccagatctgattctctggaggggacctgctccccctttcatatttgagagttgatagtggtgccatccagtgacaattttccctcttgcatgtggggcagggagaggtaggtggcctctattctctaatagaatagactagtatatgcaaacattctcaaattttataaataggagctatatctctagctttcctaaccgtgaaaaatctgacagttttattcaacttgggtcattttttcaggaaaagttaaacataactcttttcaaattactcatggaaatacacatgctaggtgagcacatcaaagaaaaaagattaatgaggggaaaaatggcattaaaagaacacactgcatagagcctagggatattgggagcttgagatgatttgtaagaaatgacacaagtgaaaaggttgctacacaccattggaaatactcacgtaagttataggcaagtgaaggccggtttgggtaggacctgccctttcaaagcttcctgtgtgagatgcactttgttcactggttctgacttcttcatttcccatttcttgatttacagaaatgaaggggatactcagggcagagttctgaatctcaaaacactctactctggcaaaggaatgaagttattggagtgatgacaggaacacgggagaacaatgctctgtttgggctggatatttctttggcttgttgcaggagagcgaattaaaggatttaatatttcaggtaggggttttcacttttcatgttagcactgtgagtctgtggtcaagtgtaaagtgatggataacctgatatatcagcagtgtgatatattaatacaaacctttccatcctactattaaaaggggactgagaggagaattattagggtgaacagctttcagctgataccaagcattgtcgaggtaccctgttactgtagttgagtgttcagtgagatcagctgacgagggatgagccagagttctaccatcttttccaggaaaccagggctgctgctggtatgctggagtccactgggagggaattagaacaggcacttcctttcccctacaaaatagacagtgaagaagaaagacacacaaggaagctagatctcttgttaaatcaagtactagatgtaaatataagctagaattccattttctaatgtgtttccatgtgctttgtttattatgattttcaggttgttccacaaaaaaactcctttggacatattctacaaggagtgaagaggaatttgtcttattttgtgatttaccagagccacagaaatcacatttctgccacagaaatcgactctcaccaaaacaagtccctgagcacctgcccttcatgggtagtaacgacctatctgatgtccaatggtaccaacaaccttcgaatggagatccattagaggacattaggaaaagctatcctcacatcattcaggacaaatgtacccttcactttttgaccccaggggtgaataattctgggtcatatatttgtagacccaagatgattaagtatgatccaaatacatttctatctgaaaacatttccaaatcctctattatctagacaaaatatctatgttcacaggatcttgttaatttcctaggagcccctatgatgtagcctgttgtgtcaagatgattttagaagttaagccccagacaaatgcatcctgtgagtattccgcatcacataagcaagacctacttcttgggagcactggctctatttcttgccccagtctcagctgccaaagtgatgcacaaagtccagcggtaacctggtacaaggtaagagtgaattctctaaaattaatataagagcattgtttttatggtatcttcttcatgggcttttcatggaaaagcgtgtttgagaatctgaggtatacagcttctcaaaaactggccctgtgcctctgcaggagatctgactttctaaaataatcatgttccctgggaagccacagagcttgatattctaattattagaggcatccttttgatcaacaccagagaaacttctaaaattcaagtatattacacatgaggttagacataaacctactaacatctgctaatgtaggaagataggttcactcattttcactgtcttaggaaagcaacaggcattgcaaaggggaagggaggactcaacacataagtcttgaagggtttgtgaaagttacaggagcctgaaatacattcccaaaagacagctcttggaggacagttaggacgaatccaaggtgggcctgagtgacagatgtcttgcacaggtgagatggtggaaaggagtacagtgcaaatagaaaaagggaacaagagcaagtttcacaatgacttttagctatgaaccacatgtacgtgaactcccataacaaaagcacttcatgtttccatcgtgtttgatagtgtttccaagtgctagcagatgatgaaatgctgcctaaccatctcctccaaaagagccccctgtcagttgattcttgggtggtggaatccaggaatagaatctaaatcacttcctacaattgcaataactatttgaagttcaatactttgtcttcaaagttatgcagaattttgtattcaacctcataatatatgtgtttgttaatataaaaatatcattctaaattgctactgattaaaatcagaaagatgagttatctaatggtttaatgcaccccaaattttaagaatgagagtctcctggggatacagttaccatggtaagaggaaacatttccctacttgattcctgagactccaggctaataggaagacagatgttatcacatcctttacagaaataaatatacagggtggacgaacggcatggggtatggtctcaaatttgtgtttttatatgacactgaaagaatgctggtctcaataaaaccctaatttcagaaacattcatttcataacctttaaaatgaggttagtaagaagagccaatagttttgttcattattttcagttctctctcaagaacaaaacttcctttggttcaaagtatccgtcatccaggatggcagctgtcttgttgtcttggtgggctgttctcaggcctgtaaagcagtcttgtccccgttatttcagatgaaaatgtgtttggcttttcaatgatcatacacctgaagtgaaagctatgaatttttacttttcaggtgagcacaagttgcataatagtagccagctttctgcaaatattgcttttataaactaaaccctaaaactgtatgacattcacaaaaggaagctttgtttcacttccctggggctttgactgcaaacgtcaacatgtgtttaatggtgaacaggcagccaccttaagaataggtgaacaatggctgttatgaaaattgtacctctgatacagatttggacaggtcctggttttgtgaattacacatatgtgtgtgtgcactcacacatacacatgcatataaaggcacatagtaacctggaaatcacagaccttatggcagtagtacatcactaaaagtgatggcattaggcaggaaaaaacacctaatgcctttttccttcatgctaacccccaggttctcaggtggtgggtaagtcatacctacgacccatctctgaataggtgaagctggcactggctgagagaatgaaaacatggctttactgaattcaaataaaactgctgaccagggatacacccaccagatatacagagtatacaactgaaataaatccctgggcttggagtctctggagcattccacaatatttttaattggcgaattaagaacaggcttgcagattgtttaaattttttttcaacttctttattttaaaattatttttaattaacaaatcataattgtatacatttacaatagattaaatatatacaatacatttaatggtcaatagattttaaaaaaagatgccaagaactcacaatggggaaaggattacctctccaataagtggtgttaggaaaactggttatctacagggagaagaatgaaattgtatctcataccacatgcaaaaaaaagtattgatgtgatgttttgatatatgtatacaatgtggagtgattaactcaagctaattaacacatccatcaccttgcttactttttttgtggacagacatttgaaacttactctcttagttattttgaaatgtgcaatacaatattattggctatagttatcttgctgtgaaatatgcctgaaaacttaactcctcccatctatctgaaactttgtactctttgaccagtatctccccattcaccctcttctccccaccaatcaagcctccataatcatcattctattctctacttctatgagttcaactttttaaggttctatatatgagtgagctcttgcagcatttgtctttctgtgcccggcttatttcacttagcatagcttccaagtttattcgtgttctcccacatgattgaatttccttttgtaaaggctgaatagtatttcgttgcatacatgtaccacattttctttgtccattcctctgttgatggacactaaggttgattccatatcttggctattgtgaatagtgctgcagtaagcataggagcgtagttaaccctttgccatactgatttcaatctctttggatatgtacccaaaagtgggattgctgaatcatatggtagctctatttttagtttttctgatgagacttcatagagtttctcttaatggctgtactaatttacatttctaccaacaatgtacaacagattaatttttttgataaaagccactctaacaagtgtgaggtgatatgtcattgtggtttcaatttgtatttctatgatgattagtgatactcagcattttttcatatagttgttggccatttgcatcctttcttttgagaaatatcttttcaggtctcttgcctatttttaaaatgggctatttgttttcttgctaatgcagtgtttgagttccttatatattcttcacattaactccttatcagatatatagcttgtaaatattttccccatttggtgggttgtttcctttgctacacagaagctttttagttttatgctatatcatttgtctatttttgtttttgttgcctgtgctttcagggtcatattcaaaagaatatttgcccataacagtgctgtagagctttccctctatgttttcttttagaagttttacaactttaggtcttctatttcattctttaacccattttgaattgatgggttgtatgtgctatgagatacaatttcattcttctccctgtagatagccggttttcctaacaccatttattggagagataatcctttccccattgtgtgttcttggcatctttttttttttttttaatttattgaccataaatgtgtgggtttctttctgggctttctgtcatattccatttgttcatgtgtctgtttttatgccagtaccatgctgttttgatttaaatggcttaacaatatattttgaaatcacggagtatgaaccatctagctttgttctttttgctcaagattgttttggttatttggggtcttttgtggttccatatgaatttaagggtagttttttgtatttctgtaaaaaacaacgacattttgatagggtttgcattgaatgtgtagatcactttgagtagtaaggacattttctcaatattaattcttccaatccatggacacagaatactttcatatttatttgtgttttcttccattccttttgttagtttttttttttttataattttcagtatataggtcctttaccttcttggttaaatttatacccaactattttactatgttagttcctatggtaagtgggcttgtttacttaatttccttttctgcagacagttcattttcagtacagggaaacactgctaatttttatacgttgattttacatcctgcaattttactgaattcatttatcacttctaacagttttttagtggagtctttagagttttctataaatgagatcatgtcaccaacaaataaaggcaattttacttgtttttctactaaaatgctttttatttgtttctcttgcctaattgctctggctaggacttccagtgctatgatgaaacgaggtagtaagagtgcacattcttgttttgttaatctgttcttagaggaaaagatttcaacttttcacagttgagtatagctatgggtttgtcatatatggcctttattgtattgaggtacagtccctctatacttaattggttgagggtttttatcatgaagggtgttagattttgtcaaatgatatttctgcatcgattgagatcatcatacagtttttatctttcattttattaatgtagtctatcatatttattgattcatgtatattgaaacatccttgcatcccagggataaatcccacttgaccatggtgaatgattcttttaatgtatggttgaatttggtttgctaatattttgttgtggatttttgcatctgtatttttcagatactggcctacaattttcttgtactggccttttctggctttggtatcagagtgatgcttgattcataaaattagcttggaagttttattactgattcagtctccttattcattattggtctgtttagattttctgtttctttatgatccaatcttggtaggttgtatgtgtctaggaatatatctgtttcttttaggttattcattttattggcatataattgttcgtagtagtttcttataatcctttgtatttttgtggtattggttgtaatgtctactctttcatttctgattttatctatttgagtgttctcttttttcttagtctagctaagagtttgttaattttgtttttagttttttcagtaaaccaactcttagttttattcattttttcctattgtttttctaatctctgtttcatttatttctgcttttatctttgttacttcctttcttctgcaaactttgggcttcatttattaccctttttctaacatctttctgtgtatcattagattgcttatttgaaatctttcctgtgtttcaatgcagacattcattgctataaatttccctcaggactgctttcgctgcatcccacatgttttagtacactgtgttttaacttgtttgtctcaatttattttttaacttcctttttatttcttctttatcccattggttgtttaggagcactttgtttcatttctgcatatgtgcatattttccaagatattttctgtttttagatttctacctttatgcctttgtagcccaaaatacacttgatatgatttcaattttcttaaagttgttaagacttatcttgtagctgaacgtatccttcctggaaaatgttctatgtgtacttgagaaggatgtgtattctgctgctgttggatagaatgttctgtatatgtctgttaggtccatttggtcaaaagcgtaattcaaggccaatttttgaagtttattttctgtttaaatgagctgtccatagttgaaattaaggtattgagtttcttactattattgtattgcagtctatctctttcttcatttaataaatgcgttatatatttaagcgctctaatgttgggtgcctatgtatctacaattgttatatcctcttagtgaatggactctttatcattatacaatgatctttcttgtttctttttatagtttttttactgaaagtctattttgtctgatataagtagagctatccctgctctctcttggttttggtttgtatggaatatctttgtccgttttttcccttctagtctatatgtgtccttattagtaaatctcttgaaggcagcatatagctgaatttttaaatgtcttttgattggagacatattgtaaatggtttgattaatccatttacattcaaggtgattattggtagataagcacaggctgttgccattttgtaacttattttctgtgtgttttgtaggttttttgttacttatttctctgttagtatcttcctttgtgtcttgatggctttctttggtgctatgctttgaatcttttatattcatattttgtgccactactacacgtttttgttttgtggttactatgaggcttccataaaacacttcataacaggctagttaagctaataacaacttaactttatatacaacaagtacactttcatttcctccccgctaccttttatgggtttgatgtcaaattttacatttgttgtagtttctgtttcttaatgattaattacagctaggattgtttttattagttttgtctattaaccttcatagtaatgataaattgctttatataccacccttacattattaatgaattatgaatatgactatgtattaactattaccattgaattttttactttcatattttttgttattaattagcaggcattcatttcagtttaaataattccttttagcaattcttaaaagtagaccaagtggtgatgaactcccttagcttttgtttgtctgggaaagtttaatttccctctcatttctgaaggacagctttgcttggttggcagtttgtttgggtttttttccttcaacactgaatatatcatcccactctctcctggcctatatcgtttctgctgagaaatccactgatagcaatattgggactttcttgaacatgatatgtttctcatctcttgctactttcaatattctttctttgtctttgaatttttgacaatttgattatgatgtatcttggtaaaccccttttgggttgaatttgattggcaacttctgagtttcctatgcatgaatgtcatctttccctagatttaggaaatattcagctgatattcccttaaatatgctttctgacttcttttttcttccatcttccaaaattcctaatatgtgaatcttgaaggtgtcccataatttccataagccttttcattcttttttctttttgctcctctgactagataatttcaaatgtcatctctgatatcacggatgctttcttctgcttaatcaaatctgctgttgatattatagttcaggtattatattctttatctgtaggatttctttatttttcaaatacccacaattcagggagaaggatttctatttaaaacttttttttctatttctctattattaaacttttcattttgttttgaaaattgtttttaaaatttattttatttttatacatattttcttgtagtttcctaaactactttaagaggattattctgaagttttgtcagttatttcttagatctttacttcttcctatttcattatgatagctttcttagtttcttttgatggtgacatatttccttgatttttcataatcattgttccttgcattggtgcctatgcagttgaggaaacagccacctcttttggtctttgtaggtgatctttggtggtagcagaccttcactatgtagtctagcctgggattccaggtaggctagttggtagcaatcccagataagcagactttggtgttgagttctctaggtgggcttggctgttttctgtgcactgaggtcaagtggaattgcttgctgtgctttgcgttccagtgagaccactttctgaactctatggtcaggttgagtcgctggctgagctctgtgattgcctctgatcaggcaaaattgcagactgtcttcccaaatagcctgcaactttgcctgatcagaggcagtcacagagcaatacccttgtgtcttccattcacccacaacatgaaggaattgcttaattaactaaaagggcacccaaatgccctacatctggccgagaaatactgttgttagaatgtgtagttgggcaggacaacaggctaggccctgaggcaaagttagttatctgggattgctgctcagcaatttgggatgggcagggggagaaactaggctacaaagatgtgtgtgggcttgatcttacccctgggccagggatagccttaggcagggcattgaggcttgattgggttgccacgcaccttctggacctgggtggggccagctgctccttctgcagataactgctgacctgcctttgcctcctggcctggggaaggctgcaggaaggtgctggagcctggctgggtcaccatgcttggagattattaattaaaatatttaatgactgaaaaagtcagaattaaagtgagttatttattatttatgctactaactttttctatatatttttctaatttctaaaaatgtaatgaaaaaatagccttggcataaacaaacttcatcttaaataaataatagttacatgtaatgtaacggcattttatgatcttcagctaagcaaatccttgacacaagtcaaaattataatcaagggtagtaggaaagtctctcctgtactggcctagggcaccgagatatgagttttgacgacattgctgtgacctcctgttagtaggacttgcaccttgaataacatttccattggtggtttaagacaatctcactcatgccacattctcttgccacacttctgacatggctgctgggttgattttaagccctatgttgcatggaaggtttttgtttgtttgttttagagataggatcttattctgccacctaggttggagtacagtggtgtaatcacagctccctgcagtcttgaacttctgggcccaagtgatcctccagccttagcatctcaagtagttgggactacaggcacataccactgcacccagctaattttaaaaattttttgtagagaaggggtttcactatgttgctcaggctggtttcaaattcgtggtttcaaccaatcctcctgccttggccttccaaagtgctgggattacaggtgtgagccatcatgccaaccacaaagaagtttgtttgttttttgagatggaatctctctctttgtcgcctaggctagagcgcatctagctcagtgcactgagctagagacttggctcactgcaacctccacctcccaggttcaagctattctcatgcctcagcctcccaagtagctgggattacaggtgtgcgccaccacacccagctaatttttgtatttttagcagagatggggtttcaccatgttggccaggctggtctccaactcctgacctcaggtgatccacctgcctcggcctctcaaagtgctgggattacaggtgtgagccatcatgccgaccccaaagaagttttgtacctatacctgatacttctcatttcctagttcttgtaactggcacctgttggcatcctgtgggcctagtgctgtggataactggtaagcatggtgagactggctagattcaaagattaatgtgtttctaaatagagaataagttaatttaatgtgtttccaaataggaagaagataatttagattatatttctcaaaactgtttctagggttgaaacattggcccatttgattattctcactatgaacatttcagaactctgaagatctggacagctttctaacacctgttcaaaacaatcatctgtatgctgtctaaccagcactgaaacagaggaagaatttccttacttgttcagaacagaatattgccacagccccactattgttttagctttgggacagcctcattatatggttgatttattctgagttggcaggcaagtctttccacaaaaactgaaatcaagcaagttctctctatttttgtttgtagagtagaatttgtaacttatgttcatgattttatatttatttctgttaaataatttgttgtttttagttcattctacatgtcaagaggttggaattctgattttgaatgccgacatattagccatcacacgcaggtttgtgaggcatgtagatgagatcaacatggtatgttctccctcaagcccctgctaaaactacgggcgaggctaacaccagggacagagtgctctgctgttaactccagtttgatccttctagttacatatgatccattcatccacaacgcaagggtgttgcttaattaactaaaagggcactcgaatgccctatatctgatcattcagctcacaatgtacctttggtttaacagagagatcatgagaatatttttcaagtgactcacaatagtgaagatactctgtgtctgccatactcctgtgaacctccagtctattcagttgtgggcaacaatgagattgccttgatatgattgttgttagcaaatgcaagctggctgatattaaccatcacttccttttctaagggttcataaaccatctgttaaataattaattcaagactttcactagaaattgacatctagcccattatcaataatttccataatatactccattcccattaaaagataaatattagtaaaaaaaaaatctatcaatagaatgttgttagttgataactggggcaagagactgcaactacacttaacgggaaagagcaacatagacaacagaaacagaaaagcaaagggtatgttcagtgtatggtcacactgagtggctcactgtggtgggagctgagagttcttaagtggtttaattaggactagaatggaaataaaggttgtgtggttctcatgatggttatggggaccttgctgatgtgtttgaactttatgagtgtgagtcctgatccaggacaggacagaaagaagtggaaacagaaagaaggtggcagatgctagtgatattttcatgtaataaaatgaaagattaaaagctttgactgggagtgtgtgtaaaatagatgagtagcatatttggtgtttttctggctcaacatatatgagatagtagtagtaaattcaattaggagcaggaaagctgtgatgaatacagacctggacacaatgagtctatgataaggaacattaaaatggatatgaaaacctgaaatgcaccagggagaataggccagggaggagagtgaaagaaatgcaggtctttggagtcctcccagactgggtagtggaagtccagctaggagctccagtgtgttgtccaaatccaggaagtaccattcccatagaataacacagtgtgcgtgatgctcagtagctgtactgactggtagtataagaaatcgataatactgcagtataatattataatacctgcccctagtagtaagaataactgttcttctccctgcttcacatatacctttaaaagtcctttgcagtgtcttcattttttttttttttttgcatgcctccactcttttgaagacttacggacattattcattcagattcacagtggcggatgttcctgtttccatattctgctcatgactgcttcacatatgagcaaaaccaagagttccctgtgcagctgcattagcctctctttgtcctatgaggattaactgtaattgtattattagaatgggtttcccatcatccttggcataaattgcttctccctaatttcttttctttgatatttcctctaagttccatttcataaagtcttaatgatacatactaagcctcacttacctatttatgggtaaaaaagatacattattccccatcctcccccttggcttaggtgaggtcttagttacggctctgtgtcctcccaccattacgttctcatgcgatttatgacacgcctctcccctgaattctgatctttatatgttatcactgcgtcctctgaagttttatctttgaatttccccctatgttttaaaacttccttttgaaaagttcctgattcttgagatcatctggtatatatttagccttgtataccactacctctttgccttgttttgcttcctgcccacagctgcacttctctggccactctgcccccacccttagtctcctttccagcctgctggaaattccttcttggaccacaggaaacacacgagggatgtggcgtgggggaatcccagcttctactagtaggcaggcaaagtggaagggaaattcctcaatcagaaaataaaactcagaaccagaaaaaaatgaggttgattctcagtgctctcacttaccagctttgtcagagagagaaaaaaaagccactcacgttccagaacctctgtttatataagtttttatttataagtatgtatctgtttatatacgtaaatatatacaatatatgttatatatatgtgtgtgtatgtatatatatgtgtgtgtgtgtgtatatatatatatgtatgtatacacacacacattaaaaaattcatttcagtttcagcccttagaacactacaggtcttccagaatactctcagggctccaagtcatgcatgctctgggaagtcctttgttaaatagctgtttaggggctgatcaggtttggaggtttgactctctcatctctacacataatgcaattgtattggaaaatgcctcttgtttcaaatctacaagtacagtttttgaacacaatgtcttcatagcttgtgagatacccttatctcagattgaccttcttcctccctgttcaaatttgtaagatttttctttaggtatgtatttcataaagtttttctgtggcaaatttatctgcttaaaatatcttttggattagaatggaaaactcctctctgtggaaaggagcaaccgaatcgtagtggatgaagtttatgactatcaccagggcacatatgtatgtgattacactcagtcggatactgtgagttcgtggacagtcagagctgttgttcaagtgagaaccattggtaagtgagatttttatctcaagatttgagatctgagcagcaaattaaaattatcttcttttggcttagtaagtttttcctcttagggaaagaaaaggatagtcatatacttgtaatcatgtaaaacctttcatgtgggcaaacatcaaagttgccatcccccagggaaggctaagttctgaaacagtttcaaattctcacaagttgggttgtccatgaatatgtccctgatttgcttttgtaataaatttaaaaaatgtatgaaacatttcacacacagaaatattgtgacatccaggtacctatcaccagttttaactatgttaccattttcccacatgcttcaaatcataattttttttctttaaagtaacaaaatattgcaaagacaacttgaggtctatgaccccattctcttccaggcctttgctcccacagtatagtaacatcttgtcatttatatcatttccatttatgtttttatgctttttctacatatgtatgcatctattaacaaaatagaatattgttttgagttatgaaatatgtttgtgtcataaacacttggtattttattaaattattggtttgccaatttacagccccattagcagtaaatgccctttattcccaaataatacttggtgttatcagactttatgactggtgttaagtggagctttgtttttatttgtttcttttctgctccatagtatacttccctgactaatatgaggttgaacattttgctatatgttttttggttcattggctttcttccgcaacttgtctgtttttgtcctaacctttcccttgggtcgttcttaccagatctgcaagcatcagcttgaatcaactatgtgatagaattaatttaaatgtggtctaagaagtgaaaacataagacagccagtcactcatgctttatatcaaagagcaacagagtggttgacgtagctgttagttaagatattaatcttttcttattacaagatacaaaccacacagagcaccccaagaccaagtgaaactctcctgccccttgcaccctctagcacttcagaattattttatattaatttagattacatgttatatagataagatttcattttatattattagattgcttcttgaaagagaagttagaatgtaaataccccactcgcaccacttttcccctccaagtgatgtgtaattgttctttaactcagccatcactcagcccctcaaattctcaatggcataatctgcttttctgtcacccaagggacaccttgcaacatctgttgcatctatttcagtcaagccctctctgttgtcatccctgtcttcctcatttaatcattcattctcatatttattcatttccacacaaatatttactgaacatgtaatatgtgtcaggcttggagctaaggctacaagaatgagtgcccggatgctttatctggcctccaagaactttccattttgagaagaagacaaaggtgaagcaggctgtcataatacagtgcagcaagagaaaggagcactatgggcacatggaggcccaccagacccaacctggggaagcccgctccaagtgagagctgatggatgaggacacaccagctcagtaagggtggggagcttccattccagactgaggaagcagcagagctgatgtccaggagatgaagaagagcatctgggagtaggactgacatcacactcttctaatacgtgttaaaattatctaattacctaattatctaatacgtgttaaaatttatgaaggaacaatggggaggcattgaggattttaagtgggagaatgtcgtgactgaatttgtattcaagatagatcaccttgtttgctgggtcggaagtgggtttgtaagagcaggaatggaggcagggagaagagttaggaagttctgtggtcaagcaggcagttgctgatagggatctgaactagggagtggtagagggaatggagagaagtggatgactttggaaatgtttaagaggtacatttaaaggatttggtgttcgggagcaaggaagagggaaagcaggagccatggatacaagccagcctttgagctggtcaaggagggaatgtgctgacagagcacaacagtacagaggatgagagcaggcacagtcgtggagcagcaagcttgactcatggttaaaccatgcctctgcttgtgctgtaaatagacctagcagaggtgatgagaagtagctggacttgtaggtcaacagagcatgataatggtttttacataaaaggtaggagaaagagaagaatcaaggatgttttttgttttctgccctggataagttagtgaatggtggtaccatttaaggagactgaaaaagctgaagggaaagagcatttgaagaggagattaagtattaggcttaaaaggacttttagtcatccaagtcatgacgacaagtaggtatttggacaagccagtctggagaagttagggctggagatgtgaatgtgaagatgatcgatttttacataatatctgaagccaaagagctgaatgagatcacctaggaagtgggcatagagacagaaggggctagagccaaacccggaaatgcttgaagaggtggagaagaggaagacaatcctcaaagaggatgggaacatacatcagcaagtgaatatcagtggaagggtggtgagaagagaaacaaacgaagtgaaattgatgatgtaggaaagacataacctcaggcaccaagacctttcatagggaagaggcctagagagtaaacttactacccaggggtatcaggaggagtgaaagaacactaggagaggactaatagttaaaagagacacagaggaagggacaggcacagagaagtgaatatagcggttgaaagtaagcagtagagtacgggaacatggaaccaaaagaagagagggtttcaaagagagcatggccaacagtgtccaatgctgctaagaggtaaagtagacgaaaaatgtgattatgcccaatggatttaggtgcataggtggcactggtgaatttggttaagcagttttagtggacagatggcggcggaaatcaggttccataggaggtgaaaggatggagggaattagcacatagaactgcctttcaagaatttggctgggaaggaaggagaataagtgaggctgggatataaggcagggtgtgttttctcttttttaggatgatgagactgagcatgaataaatgttgatgagaagaagcccagagaaagagagagagagagagggagagagagacaagttaaaaatacaggactgagatggtgcaaaggggagaaggaggtctctgagaagtaaaagtaggtgatgtcaacagcaaagaccctggatttttctttatccagaaaaagacacaccttcaggaggaagtttgacattggaggcatatttgacagtggaggcatatttgtggcaagaagttgatggataaaattgttaattaaggactggactcttctttattttgaaataaaccatgagtttaaggatggaggggtggactcggatatgcttgacttgcacagtttcttgggtggattctcctttcagttcaattactcagccagatggcaccacaaagaaatcttgtgggaaaagacagggataggagctcaggtctgcaaggggcaggattagtgtgaaagagaatgcacacaagcagatatggatcaattaacaactaatgttttaccagcacccacaacctgatgtggcagtcattttagggggcaagctttttacatggaaaccggaattcctaacttacaggtaattagtaaaatgtgaagacagagctccaagacatttagatcaaagtgtggctgtgcacctaaatcttcatcaagcaggccttcagactttccaatgcaaatagtaatctttgttttcatctttcagtgggagacactaaactcaaaccagatattctggatcctgtcgaggacacactggaagtagaacttggtaagctgggcctcatcgcctttgaatgacatcgtgctgctgggagcaggtctaagtgtgatagaaggaaaacagcattgggatttccagtcaaacagaattgggtgtgaatcttaactcagccattgactagttttgtgactttgcacagttacttcatcctttaagcctcagtacttaaatccgcaaatagctatcataaaactgaccctaaaagattatattgcaggccgggcatggtggcttatgcctgtaatcccagcactttgggaggctgaggtgggtagatcacttgaggtcaggagtttgagaccagcctggccaacatggtgaaaccccatctctactaaaactacaaaaattagccgggtgtgggtgtgggtgcctgtaatcccagctactcaggatgacaaggcaggagaatcacctgaacctgggaggcggaggttacagtgagccgagatcgagccattgcactccatcctgggtgacagagcaagattccatctcaaagaaaaaaaaaaattatactgagaaataatgggacaatgtatgttaagtggctggagcatgaaacctgatcaatagattttattcttccttaacttccccaggaacaggtggtttcgtacatgttggttaggtctatcagttatgactacaaattcgccaacctgagtaacattaactcttatgaatatgacatttaatctggcatttaagagaactgtagtagaattctacaacccctgcccaaacaatttgtattccaaagtagtgtcttctttggggttgaggagaaattgacttccctgtgggtctccttttattttgtcaacttcaataatatctatgtctttctacacagacaaataagaattgctgtattaaaaataaaatgctgtttttcttttaataatataaatttttttattattattatactttctaaaatgctactaaaacatttattattttagaaagaaacataaaaatacatgttatgatataagatcactagatggcaggagtggtgtgttctgactctagaaatagcactaactatgtgctcaacgtcacaggaatggaaggaaggaggaaagaaggaggaaaaaattagattaattcatatagtcaagttacatatgtattagtgaattataaggtattaccagtggaaaaacgttaaggtgcaaagatgagtattcaaatggagctcctagtcatttcatggttaaatattagatttgaggcagagcatatgtgaatattcctcatggaaaaaaatgggtagaaaaaagttagtctcataatatgcatgcccatccatagtgaattgttcagaaaaattgcttaatatcgaaataatttttttatttaaaccacgtgctacaataactttatgatttttacttaataaacaaatattggatagtaaaattttctttatggacacaccttgtacttcaacagtagtgcagaagaccgggctgatctcagaaactcctcattttcttagttttcttagtgtctccctcaatccacataaggacccttagtgatataatcatgctcatcttcattttaagaacatatagtcatatggttgagatagaaggattgcccattagaaaaaatgtacctggttttatgcatttctgaatgagagctgtgtagacgtttcattatttctggcacacatattctacctgcaaacctgattgcatcaggagacagcttctggcgacgtcttcctcccagatgtaggacaaagtgttctcaccagcttccttcttgttttctctggcctcttcattttcaggaaagcctttaactattagctgcaaagcacgatttggctttgaaagggtctttaaccctgtcataaaatggtacatcaaagattctgacctagagtgggaagtctcagtacctgaggcgaaaaggtaagaaaaaaactcacggattctgttctctgcaattcagaagagatacttctacctttagaaatgcctaaagtatacagttgatggtgtagccaccagcaccgactagtggtgaaaataaaagcacaaaaatgcaaagtgcaaacggccgttgaatgaaatatttaagttgttttaaacctcaatttgtaggaacagtttgacgtggctgctctcaaagtcaagctattgagcagacagttgtactgacccagactgcttggagataagtaatatgtccaagaaatgggaggaaatgctgcttaccctcactctgcttttcaccggtgccacccgttcagagagtgtgggggtacagggatccagatgtgtggggtaatgaacagtctagaaaacctccaggggaaatggcatcataataataagtctgacaaaaaatatgtgaagtgaggaatacctgaagcaacttaaccccgaaaaagaggctcagaggagggctctctgtcttgaaatccttgggagctattacattgtttgagaaatttgacttggtttgttgctctctggagcacagaacccggatcagtggtttgaatttactggtgagatattttggccagtagaaaaccctagatatttggagctatccaatcacaaaaaaagttgatctccagtccccagaaggatcaaagggcctggatccagtgatgtccaatcagatgtgtctccaaaggatgcattccctgatttttcgaagatgtgacccagagtaagagtctatgcattaagtaccttcttctgatacttaacagatatcaataagaaaatgcaatatcattttgaaaagtatacatcattacaaaaaagtacagaacagattttggtcacaacaataaaatttagcaagaatttctaagatcaggaaggtcattggggcccatcttaagctgatattgcattagagttcacagtaggagagtgtagtcaagagggtatgttttgacatcacccacccttgggtttaaacccattttctatctgatgtcaacatgacccttagccccggtgagcctccatcacccattgataatctatggataatagcctgcactttgcaagctcactgggaggcgtggttacagcagaggtgttatgcctatcacaatgtgtgacaggtaggaagcactcagtgaataggagctggcatcgtggtctcagagcaacacagcctaaaacatcattcacatacacaagatttcttaacacaaagatggattgtagattggtaacttcagagaactcaaattgtgaataaatgccaagactcccaacttcctgggtggagcagcgtggcacaagcccaggaatcaagctgcccattccctgcagtgtggtctggggctactcacccaccttctttgccttgtccttgtcactggccaaggccattatgatcctattatactctagggttcctgggaggtgaggaatggaggacattagagtccatattttgtgcacagaagagggactgatacatagtaaaccttcagtaggagttggtcattttaaatatttttcttaaggtattgttattatctattctcaaggggaattcttaagagtaaggaaggtcagatgagtctcacaaataaataatgtcttagcgtgaatgcttagaagagtcaataattgaatcaagaatgagccctttttgaccatcttacattctcgtggtatcttatactattgatctcacagttctctaaaagccaaactgttggctgcttatacgtgttccaaatgctgcaaatgggtgtcaatgtatgttactgaatggagtggtattttttctcctttctcagtattaaatccactttaaaggatgaaatcattgagcgtaatatcatcttggaaaaagtcactcagcgtgatcttcgcaggaagtttgtttgctttgtccagaactccattggaaacacaacccagtccgtccaactgaaagaaaagagaggaggtaagcccagaaggttgcccaggaggcatgaaactgctttcacttgagaggggaggagttttcctaaagaatagtaataatgatgacagcgattacattttctaggtgacagacattgttttaagcactttcctggtgtcaacccatttaataccttgaccaaagccacacaactagtaaactgcatattactggtttagagctagttctcttaagtaatagtctgcgtttgggaggccatgttggaaaagcaactcattcatgcactcattcattcacgcattcattctacaatagctatggggtatgcccagaatggcaggcattgtgctaagacctagcctcctttccaatttttctttcctggctttcaaatccaaaggacatgatggattcatgttctgatgagtggagaatggaagagagaaggagtaatcttgttcattgttcaaaatggtgtgtgtatatcacggatatattaaaaaaaaaaaagctggagtagaaattctaggtaaggaaaagcgtttaaatttctttgaaaagatgcccagagatgaaattgatatcattcattcctttaattaatagataactatagttataagcaggtttgaatgtttctgaggcttcaacaagacaaagtgtgttctggcctgtagtaaacgctctgtgaagggggttttcccccatgggagtatgcaggagatccctcgtgtcaggtaagccagatgggactcctggtctcaggaaatttaggctgcagtaggaatgataatacaggaaaataatttacaatatgcaatgagagagatgtaaatggattgtgtggacgtttacgaggggaaaaaataaaaggaatatgataagtttcccaggccaccctgatcaggaactgcccattcccctggggtctctagtgtttattgtaagacaggtctcaaaatgtgattttttaaaattttattttaataggttttgggggtacaggtggtttttggttacatggataagttcttcaatctgaaaatctttagatttttgagattttggcatacccgtcacccgagcagtgtacactacacccgttgtgtcgtcttttatccctcactcccctcccacccttctccctcagtctctaaagtccgttgtattattcttatgcctttgcgtcctcatagcttagctcccatttataagtgaaaacacacaatgttttgtttttcattcctgagttacttcacttagaataatggtatccaccatcctggctaacaaggtgaagccccgtctccactaaaaatacaaaaaaaattagccgggcgtggtggcgggcgcctgtagtcccagttacttgggaggctgaggcaggagaatggcgtgaacccgggaggcggagcttgcagtgagctgcgcgccactgcactccagcctgggcgacatacagactccgtctccaaaaaaaaaaaaaaaaagtataatgaataatggtctccaactccatccaggttgctgcacatgccattattttgttcctttttatggctaagtagtattccatggtgtgatttgagaggtttccagattcacaaaaactgctgctagtggcaatgattttgataaaataatagagctggaaaaggtgctgggtgggccatagcgccggcctgaacatggtcttggtccaatcccgctgcctctatgtctcttcatactggccctgtctccacagtggtgctcctgtacatcctgcttggcaccatcgggaccctggtggccgtgctggcggcgagtgccctcctctacaggcactggattgaaatagtgctgctgtaccggacctaccagagcaaggatcagacgcttgggggtaagtttacctccacatgcagccctctgacttttcctctgggaattgacttggagcaggacaacagaaaataccatcactaccccttggctttgtttcctcagagttaccttagaaaagaacttcaaatgtcccctgccagccagggcagagcataaaggaggagctgaagaaagaaatgtccccactggataaagtcatgcccctgaggttttgaggccttcctccaggtctagtgaccttacactgaggaaggctggagaaacaattatttttttcattccagttgccaggaatcttgtaggcaatgctattgtgaaacatgttggacttaaaaataatccctctataaccaacctaaagcaatagggcaaatgagtgaatatctctgtgcctttgtttcctcatctataaaacaggattgtcatagcaccaattgcaaaggatgctgtgagggctcactgatgtattcttaagacacatttagtattcattcatttatgtatgtatgtatgtatgtatttatttatttatttattttgagatggagtcttgctctgtctcccaggctggagtgcggtggcaccatctcagcttacttcaatctccgcctcccaggttcaagcaattctcctacctcagcctcctgagtagctgggattacaggcatgcgctaccatgtccagctattgtttgtgtttttagtagagactgctgggtttcaccatgttggccaggctggtctcgaactcctgacctcaagtgatccgtccgcctcggcctcccaaagtgctgggattacagccgtgagccaccgtgcccagccacattaagtatttagaatggtgcccagtacacggtaaatagctcagcatgtgccagactatggctgtttcttgaggactagagtgtatgcctgccatgtgtgttagctactttaatggtcacagcaatcctaccagccaggtagagagacaggaagtcatgtgcctacaattgaactactggaaggcattagagcttgggatttgggcacaggttgtctggcttaagaggtttcattagctgttacctcagttagcctcatctgtaaaatgaggcttttaagacggtgggaatgcccccaaaagtgagaagtcctgtaaaatgcaagtgctattactattaatgaagtgcctgtcaatatttgaggcaagataatcatgttcattgatgtttgcttctgtggaatagaagtcttgcttctgtttttttctagtcctggaaatctccaaggttagaaggtttgcagttttagtaaatgactctgttgcttggaaaaagcagaatccccttttgcaggatttcacggataattatttaccttactgagaggcccctccaaattccagtgcgttcccaaactaggaattcagtgaggagttgtcagatccctgggggaagaaagggtgaataaagaccggcatgggaggctgggtgtggtggctcacacctgtaatcccagcactttgggaggccaaagtgggaggaatgcttgagctcaggagttcaagaccagcctgggcaacatggtgaaacctgcctctacaagaaattttttaatgttagctgggcgtggtggtacccacctgtagttccagctacttaggaggctgaggtgggagaatcacctgagccccggaggtcaaggctgcagtgagccatgattacatcactgcactccagcctggatggcagagcgataccctatctcaaaaaaaaaaaaaaaaaaaaaaaagtgaccgggagcagtggctcacatgtgtaatcccagcactttgggaggtccaggtgggcggatcacttgaagtctggatttgagatcagcctggccaacacggtgcaaccccatccttactaaaaatacaaaatgtagccaggcttggtggcaggcacctgtaatcccagctactcaggaggctgaggcaggagaatcacttgaacctgggaggtggaggttgcagtgagccgagatcatgccactgcactccagcctgggtgacagagcaagactccttttcaaaaaaaaggaagaaagaaatgcatcagtcacatctttctttaaacttactatagagaatacatactagaaatccttaagagaaatgtttttaagatttattttaataacttttttgaatgaagcaaattatgtaatcaaggtcataaaatgctatttaccttaagattctggagctggcttagaagagtcagtcaatggggaaacatttacttgtgtcctttctttttctattttgcaaagacaatgtttttagtgatcagatctggaggcagaatccagttttcaagcacggggatgcagtgccctctgttggccaacctaacattttttagcaaaatgactgctttgaagttaatgctaagtaaccaaaattttagagatgtagaatgttagaattctggaggacctcagagatcatctaatactccactctctaattttatgactaaataaatgtagtttccaggttatagaaaaattttagtttgctgggatttcacatgatatggaaggaatagaggcaactgtggtgtgttacacatttaaacagcacagcacctacctgccagccatgccccacaagtctcatccttcctacatgagcaatgaggtgcttcataggttagtttcccaacctcagctcttttatatcctcctctgttgactctgggagcttcccttttggtacctggtacttccatccaccgaggcatcattttaggttcaccttgaacatggtgtactactaaatagcatcagcaatcagggctactgtttaccgttttgtaacaatactttgacagggattgtggaaattgctggaatacaaatctgatgtatcccattccgaagcctgtgagttaagtgttgggattttctacttcttccagtgagttccttagtctcagtaatcatatgcatttatgaagtatgcatatgaaaatatcctataacaagttatatacatatagttttccatctagaatagaggggaatggacatttatcttgcacctcctatgagccaggcaccaagaagttcatatacattatctcatgaaacccttaaaacagcctgcccaggagttatgattgtctttattttacatatggggattcacatatcagcatatgggccatcaactctccgagcaagtactttttctccttggatacgatgtgctgggtgttagcagtactttgcttactggatatcatcatgttggatggggcagactcctgcttgatgtgtgactaatgagacagaaacactgcaggtgcaaagaaggctcagagaaactcctgagttcatgtgacttaatcaaagaatgcctcagccatttgacctaaaatcagtaaaaatgcaagactgcttcataaattagaattcgatttggggtgaaaaatcaataccgctcagtggtatgattttgaaatgaatttttaaaatcaatttagtcaggatcccaaatattatttcttattcatttaccatatgattcaagcatatgtatgtgtaccataacagtaaaaaaaagagtaaatgacttatgtttttataaattttcctattcttcagataaaaaggattttgatgctttcgtatcctatgcaaaatggagctcttttccaagtgaggccacttcatctctgagtgaagaacacttggccctgagcctatttcctgatgttttagaaaacaaatatggatatagcctgtgtttgcttgaaagagatgtggctccaggaggaggtaagtccaacatgtcaagaaaaactgcagtgcaaaaagggcagttcaatgcaatccccaagtcttttttgtcattctttgttttggaatatagatctgggagattacatgaggttagaacatcttgggcaacaacacagaaactatatgttccagagatgtgttccattatcaaacaaatccatctgcagaagaagacaatcacatggggccctaggcagtccttctaggacaaagatacctctcctggcttcgcagctgaaggctgcgaagtgaactactcgctcaccccaatttagtggcccctctgatttctgggactctgccttccacaaagctcactcagcactgggtcaagcaggcttctcaggcctgggccacgccctggacaccctgagaagtccagatctcagcctgtcctgctggcctcctcctcctcagatacccccaccaaggagcctgggatgttccatggctcccattatcccagcttacctagttccagtcagctttattcctagaggaattgccaatttggggagactggacacaaagcagggaatgtaaaggtgagggtcactagacactggagcgtatctccaactggcaatagagctgatacagtgtaagtggtagagtaaacatgtctcccttcctccttatgtaagagaatccattgcaaggacctctctgactcaaggtttaacaatatccattgcaaataatcaaatgttttatttccagtgtatgcagaagacattgtgagcattattaagagaagcagaagaggaatatttatcttgagccccaactatgtcaatggacccagtatctttgaactacaagcagcagtgaatcttgccttggatgatcaaacactgaaactcattttaattaagttctgttacttccaagagccagagtctctacctcatctcgtgaaaaaagctctcagggttttgcccacagttacttggagaggcttaaaatcagttcctcccaattctaggttctgggccaaaatgcgctaccacatgcctgtgaaaaactctcagggattcacgtggaaccagctcagaattacctctaggatttttcagtggaaaggactcagtagaacagaaaccactgggaggagctcccagcctaaggaatggtgaaatgagccctggagccccctccagtccagtccctgggatagagatgttgctggacagaactcacagctctgtgtgtgtgtgttcaggctgataggaaattcaaagagtctcctgccagcaccaagcaagcttgatggacaatggaatgggattgagactgtggtttagagcctttgatttcctggactggacagacggcgagtgaattctctagaccttgggtactttcagtacacaacacccctaagatttcccagtggtccgagcagaatcagaaaatacagctacttctgccttatggctagggaactgtcatgtctaccatgtattgtacatatgactttatgtatacttgcaatcaaataaatattattttattagaaatgagtgatttttttcttttttttctttttttgagacagagtctcattctgccgcccaggctggaatgcatgttcttggctcactgcaacctccgccccctgggttcaagcaattctccggcctcagcctcccttctaactgggattacagcatgcactaccatgcccagctaatttttgtatttttagtagagacggggtttcaccatgttgaccaggctggtctcgaactcctgacctcaggagatcggcccacctcggcctcccaaagtgctggaattataggcgtgagccaccatggctggccttagaaacaagtgattgaaactctgcccgaagaatttctgtaaagaagacaattcttactccatggtcagccaacaactctggagcacagaaagtgagcataaaaggtaaagactaacgggacccagaatagacagggctagggttggtttctactgtgtcctcatgcgaagtgcccacactgggtggatgaactagaagaagaatccctttttttgggggcggggggagatgcagtctgtgccaggatatgggcttggaaagaagagtagagttaatttcagctcctccttgtgatgtcggccagagatctttgtgttaggtataaaagtgtaaatccttaccctgggcccctggaagtacagaccaactggaccaaaatgatcaggccaatgaagagacaaggaatgcacttgcagtgacatacaaagcagagagacactggccagagtcagcagtgcagctaagagtctggggaataaggatatacactggttaaacagcagcaagaatggaatgtgaacagagctgtagcctgaaccttctgctgaggctggcgatcctatgggcttccgatctgggcgtctccctttaagttctcctaagtaataaggtgatgggctgcagggccatgaaactgtttctgatagacgaggccaatttcctcctcataagtgtgtttcctttaccagagtttaacctgcagttaaaatagtgttccactcacgtataaacatcaagctcttatactctgtcttttctgaaggaataaaatgatttatcatctgagcaataaataaaagcaatgtctggactcattcacatgcagtgtgtcacacccaccagtctggatgtgatccaagttcagagtggctaaaagtcattgtcgtcttggggcctgcgtgaaacactcttctgctctttattcacagaggcacccacatcataaaaaccactgtggctttggcaccaagcaacatccttgttggaaatttcagtgataaagttaacaatgagttaaagggtataaattattcttggaggaagtttcttgtgggaaggatcattgcagggtctcagtgaagaggagcccatattgtcactgtgccattgtgctttggtgatggccaggatccctggccttcctgcccgccactctctgagatttaagactcagacttcttttggccactttgttcagtttatcctaagatagataatgctagaaccaagctattcagatgtccagcgttttgaccttagcttcgtggaaaatcaaatagagcttcaggttagcacatacacaaaaggagaaatagccagctgtaatatttacagaatacactctttccaggctgctaggtacactgaacataacaaggtagcattcgggacagggggctatttatatttcttatatgtcaattaaccacaacaaagcagacaaccaaaacaaattttctatgtataggagactgattgcaatagaacaattggactcagtggaatataattagaaaagagtattatttccctgtcacatcttctgaggtgtccatatgttctagttcctggttgcacctattgtccaagtataattattatagtactctctttcactctgaaaaagtgtcctaccttggatgatggtcactctacctctaacactcatcatagagaactccttactgaccct

SEQ ID NO: 777 - DNA, 25590 bp, Human
  misc_feature (1)...(25590): n = A,T,C or G
caacacgcccggcccatcttggttattttgttcacagtgttgggtgaaagggttaagtcatgactaattgctatcatatgaatttctgcccagtgttgtaatacagaaatttggtgtttctctttagaccatttgatgtggacagagaatgaaatgtaaaatatgcctctcttcagaaagaagacttacgttgaaagaaataagcagaatagtgtgcctataccttttatacctctcccaggtgcatgaaggaggcttcccaactggtgggattctttggagagcgatcagtcaaggaaaagcctcctttgatggagaatcccccaatgtcagtctctgaagatcttttcggtgaagctctgctgttcctccagcgaggaatcctatgttctttggcctggaaagtggtaggaagagtgtagagccggttgcctggctgcaagagaagaagcctgggaaagcctcaccctttttgaacagggtctctctcctcccctccagcacttctgctgtcatgtcacctggagcatctctgggcaatcttaatagaaagtaaatcttccatattctgaaagggtacgagaagcagcattcacctggctgcacagggtttagatgaggatctgactgttagcccatttgcctctaccttcacttccaagctagcagtgcctccaatccagaatcccctagggtgctacactgtgacttctctcgcttctcatggtgctcctctctactgctgctttgccaattcccctacttctcttctctcctctcctctcctctcttctcctctcatttcgtttctttctagacagggactcactctgtcacccaggctggagtgcattggcacgatctcggctcactgcaacctccatctcccgggttcaagcaattctcctgcctcagcctcccgagtggctgggagtacaggcgcccaccaccacgcctggctaatttttgtatttttagtagagacagggtttcgccatgttgaccaggctggtctcgagctcctgacctcgagtgatctgcccacctcgacctcccaaagtgctgggattacaggcgtgagccaccgcaccaggccccccacatgcctttttatcatctaccaacttgctgacattgcacactagctgttctttccctttctctttgactttgtcagttcgcatcttttaaactttttcttcactcattttctagtgggctttgtgagaaggaaaaaattaaattcatgtgttcaatcaaaccaaaagtccccaactccttcttaactcttaccttcaaaactatacttagcccattgttttccagtaaaagaggaaagtatgtcagtataaacagactgtagtttaaagcaaggaaattacatttttccctctgagaacgattttgcctcctgaggaataattccgtagaagcaacaacagttattggggtcaccacaagaattaaatgctagggataccaaaattagcaaggtgtgacctttgctttcaaaaatcttactctaggcagtggctcacgcctgtaatcccagcactttgggaggccaaggcgggaggatcactcaagcccaggagtttgagaccagcctcacaacatagggagaaaaagacacaagctccataagcagagaccagcgtgcagattttgactacgccacttccttgatgtgtaacattaaataactgattaaaatgctcctgtgcctttccacagcataacacaaacagcacattaggatagcgaaaagaaccagagtccttcctctgtttttgtgatgaaacagattcaattctagttaacactcagtgtcattctgtgtggtgagaggctgggaaagtctgggagaatttcctcggcgactctaagattagggatggcctgcggctgcatccgacttcctggagctactgaagtctgaactctggtctcatgaaaaattcaaggttgatacatttataaaattctttttgttcttgcagttttttcaagggggaacatggcaaaggtgttcagtttcatccttgttaccaccgctctgataatgggcagggaaatttcggtaagcttcttgggaaaactattgtcatatttataatgcctgcttttatctgaattttctttcattttgcattaaacctatagtgacttgtcattgaaaaaacttaactatgtgggaaaagcaaagaggctggtagaaatactggacacatagtaaagcagcactttaaagcgctttacatttttgcaggggaggccgagatgggtggatcacaaggtcaggagttcgcaaccagcctggccaatatggtgaaaccccatctttactaaaaaaaatacaaaaaattagccgggcgtgatggcacgcatctgtagtcctagctactcgtgaggctgaggcaggagaatcccttgaacccaggaggcggagattgcagtgaactgagatcatgccacttcactccagcctgggcgacagagtgagactccatctcaaaaaaaaaaaaagtgctttacatttttttaaataaaaagtattcataataaataagtaatttttaaaaattcactggagttatttggttggaatattagaaatttgaaactgtccatagtaattaaaattaaccttgagcttttcaatattgaaaagtgtaaaactaaccagattatttgaaagtaattacatcgaacttgtgttgtccttcatttgtgaataaaaaagacaaaacattcattcaaagttcttggagaaagaaaactcctaggttttaaataagcttactaaatatgcgtatgcaatctcataaagattgggcatacttgacctgtgatgtcttcaattattttaaaattgcatagtgcactatgtttaacaatatcacaaccgatcccccactgttgtaaaacaactcaggacccagacaccataaaatgttcttgctgttcattttttagcctatgtgactcaaggtgctaagcaaataactctctcagaagggataaatctgagtgttagggatagagtaacaagaacaaataagaagtaatcctagagaggcctggtgcagtggctcacgcctgtaatcccagcactttgaggggccgaggtgggtggatcgcttgaagccagaagtttgagaccagactgggcaacatggcaaaaccccatctctactaaaaatacaaaaattagctgggtgttatggcacacaacctgtatagtcccagctacttgccaggatgaagcacaagaatcgcttgaaccagagaggcagaggttgcagggagccgagatcgcaccactgcactccagcctgggcaacagagcaagactctgttgaaagaaagagagagagagagagaaggaatcatcctagaaaaatggctgggagaggttctgtgacttggacctagggatgggaagaaaggaaagaaagaaaagaaaagaaggaagggagggagggagggaaggagaaagaaaggaaaagaacaaaagaaaagaaaaagaagaggagaaagaaatcattttagaaaaatggctgggagaggttctgtgacttggacctagggatgggaagaaaggaaagaaaagaaaggaaggaaggaagggagggaaggagggaaggagaaagagaggaaaagaacaaaagaaaagaaaaagaaaagaggagaaagaaatcatcctagaaaagatatctgggagaggttctgagaaaggaaacgtaagggaagaggaagggaaaggggaaggggaaggaaaagggagaaaccatcctagaaaaatggctgggagaggttccatgacttggacctagagatgggagggaggggagatgtactacatatatatatatataaaaaatatatatatattatagactatataaatataaatgtattatatatgcatatgtatttgatataatatatactatataaatccattatgtaattttatatatacgtatattatgtataaatataatatattatataaagtagactataatataataaatacaattatattacattatattatatataaatatatttaatatattatatattatttatatttatatattatataatatctattcatttatattcatatatattcatattatatattttgtaatatatattatatattattattatattgtatattattttatatattatatattattattatattatatattatttaatatattatatattattatatgttatttaatatattatatatgatatatattatatattatttaatatattatatatgatatatattatatattatttaatatattatatatgatatatattatatattatttaatatattatatatgatatatattatatattatttaatatattatatattatttaatatattacatatgatatatattatatatttaatatattacatatgatatatattatatatttaatatattacatatgatatatattatatatttaatatattacatatgatatatattatatatttaatatattacatatgatatatattatatattatttaatatattatatatgagatatattatatattatttaatatattatatatgagatatattatatattatttaatatattatatatgagatatattatatattatttaatatattatatatgatatatattatatattatttaatatattatatatgatatatattatatattggtttaatatattatatactatatattatatattggttaatatattatatactatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagcacgttgggaggcctaggtgggcggattacaaggtcaggagatctagaccagcctggccaatatggtgaaaccccatctctactaaaaatacaaaaattagctgggcgtggtggcaggtgcctgtagtcccagctacctgggaggctgaggcaggagaatcacttgaacccaggagtcgcaggttgcagtgagccaagatcgtgccactgcactccagcctgggcaacacaataagactctgtctcaaaaaaaaaaaaaaatccgtgtacacatggcagattacaattgggaatttttgcatttgagctttgtgtttgtgtatctttccttgttgcatgtatgcagttttcccttctgaaatcctaatgtgcattagggtggcaaataaggtaaaaaataaaggagcagaaaaaggaaaaagaaccagaattactaaggaaaataaaagagtagttttttatatgtatattttctgatttcataatgttcctttcaatgaggtatttctccccagaaactaaatgattttaaactggcaacacattacacacattgctgcacaaatcattattctctatggaaaactgttcacttgaattcctccagaagtaaaaggtatcttttagagtaaacgacgattgtcagaaacaaaaagaatgctagctagagcactttgtccatatgtctattctagcactaccatgctacattgtaatttctgtttatgagtctattgaggtcaattaactgggcactctgtaaggtctagaatgatatttaatatacttttatctccctgttggctattagagtgcctgaaacataggagatcctcatattcaggaatgaaaggaaggtagttcatagggagaggaatagcaagataagcaaatataaattcggatacctatttgactagaattgaaagaatgtagaggtcaaagagttgccaatcttatgggaatagaaacatgtttattttctgcttctaatcatacaagtgtaggatataggagttgtgagagtctatgcttccataaaatgcttcagggcacctggctggctcacactgcagcgcatgagactcttaaaatgctccctttttttctaccaagatccttatctccctctgctcagactcctcgccctgggctcctgcttctcttatggccagcatcttgatccaactgccctccctctgacccttggagatcagaaagaggccagagccagtggtctgcagtagtggggatggctatagcctgaagatggccagtgcctctggagccaagaggaaccagggacagtttgggtaaaagtgggcttgggaagcaaacggactatcgtttaagggatgagcatacagataagtgatcccaaaagaacatacaaagctgatctcaagggcaaggaactggtagatgccagtggatcaccattactccaaatttcaaaccaagcccacgacttggggtttctattcgaacacattctgagcaggttattggcacagactcaagggtcaatcacggcagggggcagctaatcagatgtttgttcccaggcctctacaaccagtcatgggaagactgaggcttaagtgctgtattagtccgttctcataccgctataacgaaatgaatgaggctgggtcgtttataaagaaaagaggtttaattggctcatggttctgcaggctgtaaaggaagcatagcagcatctgcttctggggaggcctcagggaacttacaatcatggcagatggcaaagcagaagcaggcacatctcacatggtgggaacaggagaaagagagggaggaggtgcgacactgtttcaaaaaccagatctcatgagaactcaccactcactgtacagtaccaagagagatggtgctaaaacattcatgacaactccacccccatgagccaatcgcctcccactaggccttccctccaacactgggaactacaactcaacatgagatttggtggggacacacatccaaatcatatcaagagctgaagatccagtccttgtgttgacactgctggggagcagactttgggaagtaaggggtcaccaaggaataaggcaagaaatcagttacttggaaattacgatgccaaggtcagagcaggattaactgtacaagcaggagttagaagagtcatacagagatgcttcagaaaaaacattataattattataaatataatactgttataataataagacagatgataggaattctagatgactgttttttgatataaaagccaaaaaaatcagaattcagtagattaaaacaatatttttcatatattaattacaagcatgaagaagaaaaaggggaaataaaatataaaatataaacacagttcaattgttctttatattttagcatatagggagatagtactggagaggctactaagaacagataataaataaaatatataacataaaaattccaataaagtatagtgttttatatatatataatatggtataaaatatataagaacttgttcacctcaaagtttatgtttttggtgtccttaaattgaaaacaattaaatattcatacatataatctgtagaaatataaatcttttcttcttatttacaagttactttattattactaaattagttattttctgaattctaatttatctgatggtagaaaacacccaattacatacaacctagcaatttgtgcaaacaatgcacaaggcacatgattttctacagcatactattaagctgtatctttttttaaagcatttgggtgctagcggattatgaattaaaaggttactgtgtcaaattcacattaactggtggcaagaacaaaaatctggcatcaccaccgccgttcacttgacaacaccactggctccagcatctccccttcttcaggagcccccagtctgcatgtgagtgtcttgaggcaggttacaaagtggcctaaggtgttgactctggagtttgatttcaaagtccagctgcccatcttgctagctgtggcctttgggaacattacataacctctgtgtgtcccatattccccatctgaagaatgagaataagaatgctgtgtatttgttgtaaggattaaaatatattcaaatgagtgaaaatattttggccaggtgccatgaatcatgcctgtaatccctgcactttgggaggccgaggtgggaggaacacttgaggccaggatttcaagaacagcctgggcaacatagtgagactctaacactataaaaaaaaaattgccaggcttggtggtgcatgcatgcaggcccagctactcaggaggctgaggcaggaggattgcagaagtttggggctgcagtgagctgactgtgccactgcactacaacctgcctgggtaacagagtgagacccgtctcaaataaataaataaacaaaataaaatgagttaatatatttaacatcgtagagcaaaagaagtactcagtgaatgccggctatctacggacattattatagccttgttttcaaggaagaaagcctactcactctaccctacaagagtatcgcattctctcaatattaatttaattgcatatttaaaaataacaaagagagcaaaattgaattgtttgtaacacaaaggataaatgcttgaagggatggacacctcattttccatgatatgattattatgcattgcatgcctttatcaaaatatcacatgtaccccaacaaatacatacacctactatgtacccaccttcctttatcctttttttttttccttatgttgcctgggggtgaagatggcggtagcagggccagttctcgcatatcccaacatgctctggggagtggcagctgacctctgttgcttacctctttttgtgtttagaatgttgggtactttgtgcctttggttctcagctttgtgcctcagccaccatcctgagacaagaggaaaaagcccatttgacaggctgtcatgtcactttatgagcttaaacattcagccttccaacatggcttactttctgcatgatcagagaaaggacacacataacccagtttaatacagtgtttgtcaaaacagaaggcaggatgccttggcctctgtctagtattatgtaaatattcaaaattctttttcttttttaaaaaaaaaactcccatgaacacaaagctctttaaccttgcctttcttctacctattctccagggagttgagtgggtcagaacattttgaaaatcatcgttttaaatatcaagttcatattttaaattctacatttttcatactttctgctgttacgatttaagtctcatttcccaaagcaggcttcttaacttgttagctataagcaaattgaactactggtgcttttttgcttttttaatgtttatttatttgttgggggttttgttgttgtgttactgtttatttcagttaaaagcttttcttaagttgtgtttggcattttcttctggggagaaggaaaatttcaaaaacaagaccaaagaaataacaaactcgcagttagcataaaataataacaagtagaaaattttggctgaaacctctatattcactaagttttccagaggcaaatgttatagctaatcacttccatatttgcctggaaaatagtttgatccttgtgagtctttagtattcagctctttggtaggaaattaaatgtaagcaaaaagcttctttccaaatagggctaaaatctgcttactttaataaaagtgttgtactatatacttgactacaagatgtaaactttataacaacattgaactaattttagataatcattttctcattgttttgcttcttgtttaattgccaaaacaggatcctttttataatttagcatgtatttgaacacatgtgcttctgaatcttgaaaataaatatatgaataaagcctaaatcattacaaaggtaaacatctcaccaaagcaggagtatatggttggtcccaaccatgtgaaggctttataaaatgactaaggttctttcttttcttttctcttctgatgtctatggcctattcacctacttaatgtgcaatatattttatctgtaacaaaacaagagagttgtaaatttggcaatctagtatcaaaacaatgaacatttgtttttaaatctttaaacatctttaaaatatgctacaagaatggaattatccaataagaaaaaaattttttgttaaggaaattaacaaagcgataagggtaaaagtgaaagttgatgatgttatagtatttttattcaaatgtttgtagacggctcttcttgagattgtttatagtgaccactacttcaatcatcctaaaacctagctttctatgcatctgaacaatagagaggtccccatttgccacgttctctaagtctgtacagatcaacctaggtgagacccaatgggtattaatttacatcaccctcaagtggcttaaggaacagacatcaccatttggcagggtgtggtggctcacacctgtcatcctttcactttggaggccgaggcgggcggatggcctgacctcaggagtttgagaccagtctggccaacatggcaaaatccagtctgtactaaaaatacaaaaaaattagccaggtgtgtaggtgcatggctgtgatcccagctactcaggaggctgaggcaggagaatcgcttgaacccgggaggcggaggttgtagtgagccgaaatagcaccattgcactccagcctgggcgaaagagcaagactctgtctcaaaggaaaagaaagaaagaaagaaagaaagaaagaaagaaagaaagaaagaaagaaagaaagaaagaaagaaagaaagaaagaaaggaaagaaagaaagaaagaaagaagaaagaaagaaagaaagaaagaaagaaagagatatcactttttggtgacaaaggggtagctacgtttgcttcagtgttcaaagaaataccacagcaaaaaagaattaagggatgaaaagaatagcagaagcttgcagtttttagcaaaaacatctaagaatgtatggacttttagaaacttcagtgggttagtaaaaaatctaataaggctaagagattataagattttgacaagattatgggtgcagcacaccaacatggcacacatatacatatgtaacaaacctgcatgttgtgcacatgtaccctagaacttaaagtataataataaagatttttacaagattactattttgggttcattttcagatgtccagaatgatttatcatgctctaagtcaggataacctgtagtaactttggtgttaacatttctgctttcattttagcttcatgggtgagataaattttactattccgtctgataaaactgtaagttccacctaaatatactgttattaacagactactcataacttgttttttttaagattgttttctacaaaactcagaaattagaaactaagccaggcgtggtagctcacacctgtaatcccagccctttgggagtctgtggtgggaggataggattgtttgaagccaggagttcgagaccagcctgggcaatatagtgacacgcccccatttcttaaaaaaaatgtaaaagaaaaaagaagaaagaaacaaaaaactagattcttatttcactccccttttttcctccatgattatatcaaggattcaggtggcaaattttagcaaaggaaataaaactttcctaatatccactggaagatgtacaagatgcaattttaaaacgctgatttctataccatgtgttatctgtctccagtgatactgagtagtctcattcagaggctccctaagtgggggggagaaaaagacacataatgaatgttacattaccttgttttaaaaacagattgttcagagattttcaatgatgggtataagctcagtggattttacaaaatcaaacctctccagagcctagcagaattttctgtttattgtgacatgtccgatggaggaggatggactgtaattcagagacgatctgatggcagtgaaaactttaacaggtgtgctaattatgatgtaagactttatatgtagcagcaaatgtgagatttataagtcaaatattttgatcatatcctgaagcctattaattagacagaatttcaatctctctaaagaagaatactgaaaatgaattaactaatcaagaaaatattggaggtggtggtagcagggggtgggtggtggtcgctttggtaccacaaatggagtttgctctaatcggcttccactttaccttttttagaggatggaaagactatgaaaatggctttggaaattttgtccaaaaacatggtgaatattggctgggcaataaaaatcttcacttcttgaccactcaaggtaaggtttgaatgatgtcagatttatttgaaatataataaaaacaacactaaaatttttttttaaccaaattataggcaatggaactaattcaataattgctatgatttgcagatggtagtgataacttttgggcaataatcccaaatgtaaaatgtggctgcctaaaattagaaacagaaaaaaaagctagaattgggttgcggggaattgttttcacatatatatttatgagaaatatctaaatatatttatagatatatatacattctatacatagtatatatgtagctatatatagatatatagaatatgtcgctatatgtatctatagatatatatagaatatatatatattctacttctgaaaaggatatataatgtcataattattcctttttgatgccttgagttcctggagattatatatgctgtatcagttacctaatgtcacaataataacgtgtaacaatcctcttccaaagcttagtggcttaaaatcaacaaccatttattacttctcacaaatctgcaggttggctgggtgattttgctgatcagggctgggctctgctgatcatggctgggcttgcttatgagtctgccatcaacttcctcactgaagttgctgctctgggatggaaggattcaacctggctccatagggtctctcatcttccagctagctagcctggacttgtttttgtagcacaggcagggttccacaaaaaagagtggatgtatataagtctcttgagatctaggcccagaattggcatggagtcatttttcttctattggtgaaagcaaatcacaggagcagctcagacttttttttaaaaggaagtaaacaataggaggagctatgaagacatattatgagagagaggtgaacaattggggaattggtgctatttttccaataaaacactataatatatgaaatgtccatgtttccacatacatctcatctttaatgctgaaattttttcaaagctgcaaccaatttgaaagaagtttcaacctaccacctgtatcctacattaacattttactttgcttgtttttgttacgtatctatccgtttgcccattactcaatccgtccatcaatccatcttttctgtatatatatttcaaagtaaatagcagacatctggatgtctccctatatacttttaaattcttatctttagagtttaatatttgtctaaaatatcattgttttgataacgacttttcccagcttctatctcccatgttcttttgctccaatccattgtcttccctacctctgttgtagtctgagattatcatcagtcccactcaagtctgatcctgaatccttcataaaaggcaactgtaatgcccaaaaaagcatgctaagttacactgcaattgcattaaaaataaacagctgggcatggtggctcatgcctgtaatcccagcactttgggatgctgaggcgggtggaccccttggggccaggatttcgagaccagcctggccaacgtggtgaaaccccatctctactaaaaatacaaaaattagccaggcatggtggcacagcactgtaatcccagccacttgggaggctgaggcaggagaattgcttgaacccaagaggcggaggttgcagtgagccaagattgcgccaatccactccagcctgggtgacagagcaagactctgtctcaaataataataataataaataataataataataataaagtaattaagataaaacaaaagttcctttgttccatccaagttctggaaagctattggtgtttctatatttatagtagtaggcttatggttataaagttctttgagacactagaatgataaacattagacaggatgagtaatcctagaaaccttatactttctttgtatgtccttcttatgatcagtgctctctaaatttacataacgcttcctttccttcaacatatctattattctagttttaagtgttttatgccagatatataaaatttgccataccaacttctgtttcatttgcacattgatatttatctggtttcttattgaaactacgaaaaccccagagcagtaacccttggctctttctaaatatatgaaattcaaacgtattattttttaagttattatgatgtacatattttcccagaggaactttgccaacaaacctgttccttttcatatatcaacttggtactcaggctggctaatctcgttggagaaaaaacgtgtttttcagttcctgggcccccacccacgtatcccatcaatccagacaatagccagtgtttttgtctctgcattctttaattatgagagcattatggctaatgaattaatgaattacctctgagaatagctttatccccactacataaatctcaactagaagtagtggcaataaaattgatttagaaatggtaaatataatttgtttacttattgaacaaagagacatttcaatgttagccaaaaaattgagtctttatgtctctgttataatagaagttttttttttttgttttttttttttgagacagatttttgcctgttgcccaagctggagtgcagtggcacagccttggctcactaaaaccgctgactcttggctcaagcaattctcatgcctcagcctcctgagtagctgggattataggcgcacaccaccacacccagctaatttttgtatttttagtagagacggtggtctcaccatgctgaccaggatggtctcaaactcctggcttcaagtcatctgcgtgccttagcctcccaaagtgcttgaattacaggtatgaaccaccgcatctcgtctgtaatagaatatttttaaagacagttgacgtagcctgccttgctgctcttatacactctacagtcttttctcctgtgacctttactaccttgagagagctccctggggcaaggaaattgtggtgctaaatcaacaagcccaagagaggcccgcatcacctcttaaagggactccagtcttgaggaatccagcattccctgccccaacagccttgagtttgtttataggactccttcaggatgttctcgtctgtcctcttctgctgctggtgtgtgcacccttaagcttgaggggaggctaaaaaatggctttttttttttgagacagagtctcactctgtagccaggctggagtgcagtggcgcgatctcggctcactgcaacctctgcctcccggattcaagcaattctcctgcctcagcctcctgagtagctgggattacaggcacgtgctaccatgcccagctaatttttgtatttttaatagagacagggtttcaccatgttggccaggatggtctcgatctcctgaccttgtaatccacccaacttgggtgtgaatagaacttggatatgcagcctgggatgtccacaagtggatccaaagccccttgctataagtgatggagatggggatggaaagagagaagaggccaaccagagatggggcctaggtgataggactattcagggactctctttcccagtgcctccatggtctggcttgaaactccaaggaaagtgaggctctaaattctaacccgaccttacaggtcattgttatatcttatttatcaaagtaggaggatagaacacatgtgatctaataatttgatttataacatttggtgcccctgacaagagttctgtttctgaaaaaggaatagtctttgttatttccaaacaatgggaaaaaaaagattacttgaaggtagcaattattttaatcattttaaaaacataatgctcttatatcgcctagaatttttacagtcattaaagtatatctttaatgtttagagattttttgtcatcatatatcattctttagcatatataaaagataatatgtacccaatacattgtattcttttttttgtttttttgttgttttttgcgacggagtctcgctctgtcgcccaggctggagtgcagtggagcaatctcggctcactgcaagctctgccttctgggttcacgccattctcctgcctcagcctcccaagtagctgggactacaggtgcccgccaccatgcccggctaattttttgtattttttagtagagacggggtttcacagtgttagccaggatggtctctatctcctgacctcgtgatccgcccgcctcggcctcccaaagtgctgggattacaggcgtgagccaccgccccggccccattgcattcttaaaatgctttcacatgtagatatcagctcttcagaaatacctttttactcagagtcattgatgttagtatattttccagtaattatcatcatctctgccattgagaatgttggtggtacagcatttctccagaatgtttccttattgcctctgaaattctcttccaatgacatccactctacatactttgatgctaagagtctcttgatcttatgagccagtatcaaacgaaggttttcggataacaattaggattcatatttcttcctcaaattattcttaaagggtttcctggctgatcttttatgctatcaggaaaataaccaagttcaggcatatgcaggcaatggcaactacattttacaaacctagtggctcagctactagagattacacaatgtcattaatagccaccatttatattcaagatcaacattcttactgaaatcaagaaaaagaggtcaaactattaaaggtaaaacgtcgatcctttcattgttagattgctttaagtaatcacttattttttctgttgttcattattcagtgaattgcactaggttttacctctaagagatctagtagacattttttaaatttaatattgtatccatcattttttttcaaataaattacacgataaaatgttcatgttatatatacaaaggagtcactgtttaatctttgaaaactgattcttggccaagggaaatggtaaaattaaaatagagctgtgaattatttttaaaccgcagtagtccgtgtcatgtcacacatttttaaaaattataattgcttgtttcttttttagaagactacactttaaaaatcgaccttgcagattttgaaaaaaatagccgttatgcacaatataagaatttcaaagttggagatgaaaaggtactacaattttctaagaagtaaaaccgtgaataaatgcttaaaatgtgcaatataaccctggagtcagtggaaataaaaatatacaatagaacctgttcttttgtttatgaaataaacttaattttaaaatggtcatagaggaactccactgacagcagaaatgccctttttctttagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtttgatgtcttatgagcatagttgtaatggagttgatgatatctcactgatagacattaattatcaatataatatgtatggtaatgttagtctttatttataatattagtattattaagtaatcattctcattagaattcttcagcaatgaagtcgttttgaggatttgttcattgtgtacattagtaaagtttaaatgtcatagaaataaattattacttttacaaagatcatttgcaaactgaattatggatgagttataaatagaaggccacaaattcacacaaagaaagagagagcatgtatatatatggagactatttggcatcctaataaccaactagttcttcacctgaccatatcacacaaaagagccaccgttattgctgtaatgcttctgtatggtactacttttcaatcactatggctttcattaattcattgagtctaagcctctcccaatacagaaatttcctttacaataatccagaaacctaattctaccctctgactgaatacattcatgttactttatcagcaaattcattccgtttttgattgtatatagttgcttctttttttactgatacaaaatattttatatatttctggggtacatgggctaatttttgtatttttggtagagatggggttttgccatgttgcccaggcaggtctcgaactcctggcctcatgtgatccacctaccccagcctcccaaagtgttgggcgtgagccaccgcaccctgccgaattcataagttttaaattgcatgtcattctgagcagagattcgcaccattggattctttctgcccaggaggtgggtcacccctctgtctagcgtatccacgctgaaagccctccctgccccaagacacttagtagaagtctgagttatcagatccagtgttggagtttcatagtgctcgtgttcgaatcatgcttatttgatttaataatggtcccaaagcacaagagctgtaatgctgacatattgttatataatcataatcttttattattagttgttgttaatctcttactgtgtctaatttataaattaactttgtcataggtatgtatattataggaaaaaacagagaactactatagatggtttttttccttcctacacccaaaagatttttccccctagcgttctgaaattttacagtgacatacactgtcgtggtcttcttttggtttactgcagtgggtactcagtggttcttttgaatctatatcatgtctttcagtttggtaaattttattttctttatctgctcgttactcacttcgtagctgtttcggttatcagactgaaaaagcatagtatcaatatatagaatttggtattatctgtagtttcaggcatccactaggggtcttagaacgtatcccctgcagataagggagtactactgctgttgtaaaaatagtcatcttttctatattttgcttttttaaaaaaacatttgagtccatttaagatttgatcatttataaaggaactggagtatttccagcagtgtgaaggagagaaacaaatttcactctcctgctttgcaaattgaaggtgatgatggtgttttccttagtggttttcctgttattttaaaaaccgtcttcttcacctgttcctactcctttctttcccccttgttcttctaagtcagcatgacataaaacttaacgtgtaattcatgaagtcatctgcaagcatcaccaatgtttgattttgaaaagaattccatatacagaaataattactaatagtatcctgagatcaaaaccatgtactttatccagctgactggcttctaaggcatctgaatgaaaactaccatgtatattaatgtgggcaaaggaacgatttacctgactttaaagaaatgggttcagggagcacaaagaaaggccattcattaggtggagcctgccacagagcccacattatccttggaatcaaaggggttgataaggctgtgcaattggaaaatcagtaggcattaagggagagaaagtagattgttttagaaacttggtgctacttctaccatgcctactatcagtgagttcgactatcatcttttcttccttcttactgttgctttttttctgtcccatagttcttctaatttacatgaaatgttggcacttcataaatattacccacctataagatgttctttttccacacagcaaaccaatcactgcgagttgatgtcttttctttgttagtgtagcatttcacgtgagtgttcacagccacttcttcaccaaggaagacccaatcatcccctaacctagtttcaaatccaggctgttctaaaaactaaacgatgctagaaaactggtctcagaatagtgaaggtttcttatgttcatcacagagtcagtttcctaatgggattcaaatgatagaccaaatataaaaatatagttagcagatgtctctagatagacaaatatatgccaaaatatatattctggagactcaatttacagtattttctttttttaacattactttccatgctgttttaaaaacacagtaggctttgacatttgcagacttgacatacatattttcaattaattacgtccatttaagttaggaggacttcgagaacgctcagtaggagtgaatcattaagctgataagtgattcaagccagccactcagcctttacgggtagattatatgcttttttgattcaataatttgggtttttccatagatgttcagaactacctcttgtgaatgttctccttctatcctaattctgacatcttttcattaattttatcaataaagaagtatatggcaattaatttcataacaacacacataaacttattgcatactgttacatgtaaattatacatatcaaggacaaaatttacagactccaaaggaggaaagaaacatttttatattgtcgataacctaaccagcttatctagattggtgcaatatatgtaaaaaattaactcagcaactaggaaaaaatgattattggttgatgggtggcaaaactttaaatggtgatttaggtttgtttgcttacccttgagattgaaataactgataggctagcaatttaaagaaggggacatacggagtttgaattatgaaagctaagtcttagcagcagaggaatgaacgtgtgagtgcaaattatccaggaaagccagtagtagagcaccttgcccacgacttgctttgctgacactcaccttagctcttgttaagtatgaaattaacactgttctgagtcaggaggttgtaaggctggaggttacaaggatgcgtttttgtttgcttgttttaattttttgtttaaagaaaatcaaaaattgaaatgcttatttttcaatgcactgtgagtggcctgggttgtattttcagatttgtaatggcagtaaaactcaccagtttaaaatacccatctctgaggccaggcgcagtggctcacacctgttatcccagcagtttggaaggctgaggcaggaggattgcttgagctcaggagttggagaccagccagggcaacacagtgagacactgtctctattattaaaaaaaaattaaaaaataaaaaataaaatacaatagccatctgttgtagaaatttctcagcttttggaaactagtaaatatttacttgtctgaaaaatggcagaattcatagttcaaaaattttgagcatttgtagcaaaataaaagggattctgaacaatatttttccagtctgattgttgttttctttttttttctcccttccactaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaatatttattgaatccctgtgtgcaaagggctctgataagagcttatgtcagacaaaacataaaaagcatggattatataccatgacttaggagatacaagcataaatgcataataaattatgaatgcaattggcaaaacacatgacaaaatccagcaaataatggattgccgaatcaaccacagagacaataaatattatgagttgggatttgaactcaggttttggattacagagtggaaacttttaagcacaacccaggatcttaatcactacaaaacgctactcgtatttttaggaagtttatgtaggttatacacttctctcacagggctcattttaattcttatgccaatcctgtgaggttattattatgtccatttaacagagctgagaatcagtgggtctgagtttttgtgactgctccaagttacaaagtaggggaacaaggcctcaaatccaagtcttctgatgctaaatcaaatatcttgccaccatcctatagcttcttctgggtagaacttggattggtgcagaatagggagagaacgtttcaaatgagagtaaaagatactccaaaaggctgggcacggtggctcacgcctgtaatcccagcactctgggaggctgaggcaggtggaccacttgaggccaggagtctgagaccagcctggccaacatgatgaaaacccatctctactaaaaatacaaaaattagctgggcgtggtggtgtgagcctgtaatcccagctactcgggaggctgaggcaggagaattgcttaaacccaggaagcagaggttgtagtgagctgagatcgtgccaacctgcactccgacctggccaacaaagcgagaagccatctcaaggaaaaaaaaaaaaaaaagatactctaaaaaatatttgtgtgtcaactgtgtgtcaggcacagaggatacagttaaagcccacacggagcttagttttttggtaaacacatacactaatcatagaatcacaaaatatacataattataaaagctgatatgtatgaagtaaagatatgtgcctggggaatgtttaccaggaggatctgacctggctttggggtaggagatcagaaaagcttcccagaacaactgactttttgagctgagaccttttaagaaggtgtacgtggggagatgttgcaggcagagggaatcatgtgtgttaagtacacagagcaggaaagtgcttgggaacaaaagcttagaaagccaatatagttgagtgatccttaaatccttaagccaaggattctgccacttaatggctatgtgacgttgggtaggcaacttaacttctctgagccctagctatctcatctacaaggtaacgattacaatagtacctgcctcataggggtgctttgagaattataaaactatagcacttggcatagtgcctcgcacaaagtaagcattcaataagaactaggtgtgttgacttgtgaagtaggcattaagggacagtaattatatagaggcccttgaaatcataggccacataaggatattaaggttagttgtactttattctctaaatcagtgtttcccaagcggcacttctcagtctttagtgtcatacaaaccaactgaagatcctgttaaaatgtaactctgcttccaggatggggcctaatatttgggttttctaagaagtttccagacaatgcagatactgctggtctagaaattacactttgaaaagcaaaaagctagagagctatagttctgtgagacattggtagttcagtacagaaagaagaaaagggctgcctgatcaaataaatttaggagatgacaaattcagcagaattccacaggtttcttctcttgggaatttctcagttctctaatttttctaatgtgcgttctgaagctccaagaaggacatatagtatgtagcatttttatatctaattaagagtatgttctggtgcgaggtataaatcgcctgactacggaagtccaaacaaat

SEQ ID NO: 778 - DNA, 55068 bp, Human; identical to SEQ ID NO: 691
  misc_feature (1)...(55068): n = A,T,C or G

SEQ ID NO: 779 - DNA, 22357 bp, Human
atggcaaaacccagtgtctactaaaaatacaaaaattagccaggtgtggtggcacgcacctgtagtcccagctactcgggaggctgaggcatgagaatcacttgaacccaggacgtggaggttgcagtcagccaagatggtgccaccgcactgcagcctgggcaacagagcaagaccctctctccaaaaaaaaagaaagaaatgtaaatttattgaagagggaactgttatattatgactgcaaatggtcatcctgatgtgtttcatagataaatagatagatgatagatagatagatagatacatacatacatacatacatacatacatacgtacatacatacatacctatcaaaataaaaagaatctttttcgggtcctgcccagctaacttttttttttttttcatggcaccactgctatgcttcatgccccacctccccctctaagattctcctctcagcaagaacaaactaaacctgctcagtggacccagcaccctcagtgctcaggggccccatctgggaagtaggccccaaagtacatacaaggttaaaatgcagtgtggctgtttttcaaatgccaaaggaaagaagagctgaagcaaagaatgtagccttgattagttagaattgtggggtttccttttttcatttctctgtttttcaaattgtctgtaacagagttctcagaactggagaaagtcactgtatgtttacaaacatcaccacctggccctttcttcctcagaaggatggcttaaaatgcacagttcttacactgaagtgagccccagcatcacaaggagggcttgctaaaacacagtatgccagacttcttcccagagttgctgaatcagtggggctggggtgaggtcatcagtggggctggggtgaggtctaggaatttgcttttctattcaagctcccagagggtgctcttgctgcgagtccaagctttgaaaaccatgggaccaaatcaatgagatggtaatgtggaagtacttgcaggatgaccttggtggtcttcagtggtgggcaggcccccacatccagtgggttgtgtggatggtggcccccgcatctcacacaaagtacaacctgtgtagcccatggccctgtgggcacctgggggagcttcccagttccctacctccctccttcctttctccctgtccttctgccttcttttctccctatacttccttccttccttctttcctttcttcatttccaagacactttacacagttccattagaaagcatttggacacgttgctgagctcttgagagaaaaattttactgtggaaagaatggagtttagattctacatttgagcttaaagtggggcagagttaataaacccacacttcatctttcttccttctttcctacagggatccttcctacttggcctcccactggcgcagcaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcggaagagccgtatacaccttcaccccccgtgcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgcctgtggaaagtggactaccctcaggggatgaagagagaattgagtggcccatcactcctacggttggtgaactgcccactggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagactactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggacttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtattagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccacggtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacgttagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaacctcgagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcaggtattgtgattttttccccctttaaatgtgcttaggtagttcagactgtagcctactgcagcacagaaggaggcagcatagctttaaggttccaagaacaactccaccaaaggttagctgtgcagcctcaggcaatagtcttcccctctctgagcctcatctgtaacgtaagagtaggataatactctaccagggaagattaggcagaacataaacatagatagataaagcaagcacttagcatcacgctctgcatgcagtgcacacttgtaaagatgagtgatgttatcgttacagcggagttacagtccgtgagtttttacacgtgaattcaactatctgtacttggcacagggagagaaggatgactgtctagatagtgctagaaattctgctcatgcaccctgccccggagtgagtgtaagatgagagagtaaatctgctgatggtgtttatgtctgaatatttattttgtgcagggttaaaacctgcacaacttaaggaactatgaagtgtcatttggctatctggttttagattctgcatccccaaccccatccgtgtacaaaggggctcctgtactatcatgattgtctcaccgtgacataactccaagtgccgggcagcgggcactggtagcggtagctgattttcctttttttttttttttttttttgctctggggtcccttgtaccttcctttgtgctgagagagctttcacagctagagagctccccccgatgctgtgggccaggtgcccaggagggacagaggcctcagaaaagtgctgacccaaagccagcctcgtggacttcaggaacctcatgccccaactttgaggtcttggaggccatggtagccaggtgactgtgttcttgatgctcaacctctcccctgggggttgcagcccccgccaggtcctgtgcagaggagccctgtggagctgggacctgcaaggagacagagggacacgtcatatgcctgtgcccccctggctacactggcgagcactgtaacataggtaaggccctcattggccgtggagagtgagggcggaggcgctggacagacttcttcatcccccaaagggtccccaggtgggaggaggcaaccaaggtccactgaggctcaggctgggaaggagctgcatgatgacatgtcaggggcagaagccacaggacagacatggcttatctttctcgaatgtctaggtttaggagaaaagagtcaagtaattaagttgctaagtatttttatatcaggctgatgactattgtaggagtagaatgaaaaatgtgcttgaattttggagatgagacttcaaagaaatatcgagcatggggtgagtattaaatacagcgggtcacacctctccgctcctggtgaggagtgtctgagtggggccatcttgtatcgtgcagagtgaaccccaccaagttgcctccatgcttgggtctgcgtggggtttgggtccccttcttgccctgaaggaaatgacacaaacaacggtaatcacccagcacagggattcgtggatgtagggcagctgtaacccagcagcacgtctgcccaggcacccaccatgagcctgtttgtccttagctatgggtgaagcagcctgtgggatgggtggagaggctggggaccctctgatctgaggtggaccccggaaggagatggttagaatctacctgttgttccacggacacacgggaggcccgtggtcatgaggacatctcatctcatcttatcaacatcaccaccttgaggaaagaaatgcccagttaccaccaagctcatgttctttcattagttctcccactaaccccagtgcccttatccccagcctccctcctaggtcaagaatcagagacctagggtctttcataaaaggggtcactcctaggacatgtgcaaaaatgaaaaaacgaatcctggagaaaaaacaatcacttccacgtaaacctcatgtcgggcaattatccttcgatagcctttacatcaaacacagagaagaattctgtgtctatatatattaatatacatgcaaattaatacatcattatatattattatatatcatataaacatgctgtatacatggtacatatgcagtaactatatatgtatatataaacagacgttagggtagatattcattcactctttccccaacgtgtgggctgcaaggacagagagggtgggctatcctgggaaggtcccgggcttactgcagaaggggacagcatttccactgggccatagtgaccccagggaccatagctgcaccccaccatcactcacccctgatgggtgactccactcttgggaaatccttcttaacctgatacttgaggcaaaaatctgacactagcatcagaagtcaaagcaaggctcatgttcttggcagccctgaaattaataggagtaagtgtcagtgggccgtaactattctgctgtaaggacagcctctctgtgatcatgtatatttccacagggcttttgttcccacgatttctccccagatggctctgtaagcagcttggtaactacccccatttgagactggaactcagaggagttaagtaatttgcctaactatactgagtaagtggattgaatcaagaatcaagaccttaattcacgtgtttaacacactcggctaaataagaaactccctcttgaacataacaaccagttgctggtctcaaaaaactgaagctggacttcaggggagccagaatggggaggagctgaggaatctgaggtggtcggattcaagacttgcagcccagccttcattttcctcatttgtaaacagggatcgatggtaatggttctcagctttgaaaaattatgatgcctgagatctacccccacagattgtgattgaagtggttctgtggccttggcattgaggtttttaaaactcccaggcgactccaatgtgcagccaggactgagaaccgctgctgtgagggtgaagatcacccatgtacaacatctggtcagaagaggcatttaataaaaattgcttccctttccccatctctcactctactggctaagagaagctttagcatctccaaagagtgagtggtggggatcagcccagcacaaaacctgggtctcttttcccatgactgtaccttggggtcccaggtcactcttgttcaacttagctcaaggttcaagtgcttccagaaggactgcagatagtggccagtcttcacgggtgacccacgattgtcttgcaccacaatcaggaactacaggttgttaaaaagaccacggatcggccaggtgcagtggctcatgcctgtaatcccagcactttgggaggccaaggcggatggattgcctgaggtcaggagttcgaaaccagcctaatcaatatggtgaaaccccatctctactaaaaatacaaaaattagcttggtgtggtggcgcacccctgtaatcctagctactcgggaggctgaggcaggagaactgtttgaacccaggaggcggaggttgcagtgagccgagattgttgcactgcactccagcctgggtgacagagtgacactcggtctcaaaaaaaaaaaaaaaaaaaagaaacaagaccatggatcagtatcctcggggggccatagggagcaaaatgcagcatgattcctgcagtaatatttgaatcctcagggaaaacttccacctggtcaagggggtcagaagctgtatttagtccttaaaaaaaattgacaattactgtcatcttttttagtcaatcttccataaataagttcttgataagttattataagttatttagcaattaaaagcaagactattctattctgacccacttcaaaaacagcagcgtctttccccacttccattactgacatcacccaagggaattaggcttcagactctaaggtttctatcctggctgcagcttagaatcacctggagtgcttttaaaaagcatcatgcctgggccccactctgagatagtctgattcaattggtctaaagaggaacttcagcattggtatttttaaaaaatctttaaataggaatatttttaaaaactactccagtaattctaatgtgccagccaaggatgaaaaatactgttctaaccagatctcacatccaatttccagtcatcactggtgctatgtagccttctcttatctcctctgttaggagggcacgaccttaaactgaatcagtttccttcctatcttactgctatttttcagtttctaggtttgaagctctgatctatgactttccactctctcttcctctaggagagatgtttgaatttcagagaaacctctatccttgagaaagaaatgttttcaaagcaaatgaaaatatagggttgcaagtgaaaatacaaagtatgccttcttgacttaaccaaaaagttcctgggcagattttaacaggcaactgattgatttaagaagcaggatattgttgggcacagtggtgcacacctgtaatcccagaactttgggaggccgaggcaggaggatcacttgagcccaggagttcaagaccagcctgggcaacacagtgggatcccactgctacaaaaaatatatgtttttaattagcttggtatggtggcacatgcctttagtcccagctacttgggaagctaaggtaggagtttcacttgagcccaggatgttgagactgtagtgagccatggttgtgccactgcattccagcctgggtgacagagtgagaccctgtctcaaaaataaagcaagatattaaagttatattcaagatcaacctttaaaatacaaaagatttgaaatagtacaaataatgatagcatatgttataacctttttttttttttaagacagagtctcgcactgtcatgcaggctggagtgcagtggcacaatctcccctcactgcaagctacacctcctgggttcaagcgattctcctgcctcagcctcccaagtagctgggattacaggcacacatcaccacgcctgcctaattttttgtatatttagtagatgggatttcactatgttggccaggctgatcttgaactcctgaccttctgatccacccgccttggcctcccaaagtgctgggattacaagtgtgagccaccgcgctgggcctatatttttaatttaattaatttatcttaaaagcaaattaggactggtgaatatgcttttataatccttctttcatttgtgtaagagacaaccagaaagttagtgtatctactcaggtctgttcatcttcattgatcccaggtctttgcaacatgcagagcatccattgaattgagaaattttatctgtatttcttaagaggtttcccccatccttgcccaggaaagttatgtccagaatcaccacatacagctgcacaagtatgcactgaacagcttgaggagttccattcatattgtagtctttatgagtggcaacccttttagttcagtatcatttgagttttagcacctgcattgctcttcgttcagcattttttatgagcaaataaactctcactcacttggaggtcctgggctgtgacctaggcaaaagctggacaagatcttttcaaggtggaggcctgacgtctccaattcagacaaccacgtgatgctttgcaactatctctactcccctggcctttatcaggggctctcagttattttctctcccaagttagagatattgctggagggccttgttcaggaacaaaccagcccttttggttatagtagtgggaagaggaccctgagaatcctgatgctccccagagtccctgctcagtgatgatgagtgagccctgggtagctgtagcagcaatgctaaggaggtgctgacagtccaggactccagtgtctctctccctccacgtggggcagaagccaacttccagtctcatttcctgactcctccatctcttccactctgtctccccaacacccaggttgggcaagtcacctcacttgttttctttctgttctttctttctttcttttctgttttgtttttacatctcaaacatgttaaagaattcacatgttttctcacctgtaaatggcatagtgacgtcttgccacctggccattggaaggataatgaaggagaacatgtgtgagtcagcacttggctcacaggaggttcttgagagttactggtttcctccctttcctctctttccctatgaagcctgcccattgcccaaagcccttccctccctccacttgcaagctccttatccaggatccatcactctgcattcacagcagggcccagcccaactcctctatcagttccagaaggcatgagatgtcctaattgcccttctcagaaagaggtgggccatgcagggccagaacggcccttccagccagaacaagaggagatgagacagcacaggccaaaacagctaataagaaagccccacaccggacacctggccttctgcctgctgctgaagatgctgactcagcctctccaaactaccctgactgcaaacacaggttttctgactttcaggattgtggcccttctttccctcctcatctgtaaatccagggccgtgaaaaaaaaaattctgagccccggaatttgttccttcagtccccgcagccttctcagattttgtgccctggtcaaacacagaaagaaagcaacgctccccctcaccccaacttgggcagcctgggagcaggttttatgcgaccagcctctgagacaactggataccccccagcctgacctccgctggggtgtctttcctttcctgccctttctcccatgggcagccagaggccccagggttgatgttttactcttctccccagaggccactcctgttccctgctctgtacaactgctttagcacctacatttgcttaattccccttgcccagtgcttcccatctcccataatgacgctaatggataaaagagaacaggcaggagagccgcccccagcttccgccctgccgactggcctgacctattgctgctactgctgctgctgggaatcctggggcatgctgggaatccaagtgcatgctgggatttcagtctgttcctccatgcattttgggtttgcttggaacagttccaacttggaactgttggttctagtctatggtgtgcccccccgagatgaagttaaagacttcatgggaagaaagagatgcccaacaactggagattagggccttcgtggatgagcaagatgcctgagagctggggattttcaggccacctgttgcacaaatccgcctctggcctagaagatgtctactatgcaccagcgtaaggactcagaggaaaccgcctttaccatctcatcagaaggttgactttaaggtctggtctgctcttatgggaggcaagaactaagtcttggcacatgtttaggactctgagatcctattcccaccacagggcttcgctgtcctgcagagcccacctacagacatgtcactggatctggaaggctgtgtgaacacagctgcacatactgaggctcagtatcttcaaaccaatgtcatggtgccccatagccagtggaacccactcactgcagaattttactgatctcctggcaagaggagcttcataatagcatttatcatgttcccaggggaggaaaccaagttgggggataaaacagcaggaacctttgaagtacaaatatgaagaaagcagaagagatcccccaggtcttctggtttctcagcaagatgcagaaagaccagatgaggagatttagttctcaccttggctaattcatgaaaatttgaggcaatggccaatgacttaccaattcaagtaccacaaagaagtttgatcagaaaggatatctcaggaccagaagaacagaagagaagagcctatctgaaaagaggcagaggatggggatgtgcctgtatcccagactggtgccagtgctgttgtgcgaccacttgctaaccacctctgtagctccgaacgcttgtctcccactggccaggatggagtccctctagaacttgtgtctccctggagatagccaccttctggggccttaagctgaaaggagattatatggggaaatgttggacagggtttccatccctctcccgagagaaagattcaggcttcatttttataagagattctaaaataatatctactgaagacaaagatgtctgcagcccaagaactctgatgggtctcacgcaaacatcccatgctgccattttcatatggatctacactcttcagaccatttcgaggtcattcattctagccccacacagccttgccctctttctctgggtcataactacaaaggaagccaggaaaagaaagacctctaaccaagcttcaggaacttgacttcagtttccttgctcaccaccacgttcataaccacttcagaatccatggtctctcaaaatattcacaagagaaggcatcttggaggaactctatgttccccgtcagaaaagacatttggctttagacctatcagatctcttcaaaccactgggaaatctggctccagtgctccaagtttaccaatcaagaatcacacacgcccaagaaaacccttgtctggatctttgcttcagcactccaagatggcagcagcagcagcagcagcagcaacagttctcaggaaaaccagccagttccctcccaggggtctggagagcagcaggactggccactcaaaaggaggccacagtgcttgtgaggctggagttgccggcaggagtcctaatggtggcccttggtttcttgcagacattgatgagtgcctctcaagcccttgtctgaatggagccacctgcgtggatgccatcgactctttcacatgcttatgccttcccagctacgaaggggacctgtgtgagattggtacggccgtcttggcttcagctaatgttactaactgctgcaccccctcctcctccctcacctttccctcctaacaacaggctccaggccctggctggggcccccgaggttcatctggagagccatttcaggggccacaactgaaaattctgccccactgattcccactctttttcttgctctcctccttgaaaacccttttctggagcactggctgatctgactttctccagggcttccagatctactgatgccaccaccgaggttggtgtatggttcagactaagaggacagggctgattctgagcacttgtcttgaaggaagctatggggtgggagtaattggttctcattccagatgacagccacggatcttctcagtgtggtcatgggcatgggacctttgtggttccttcatggccctgggagccactgtgccacattggccaagctgcctttctcttctcctggggcaagagctgtggttggtctgcctgagatctcccgtgtcatcagcatgctcaagtcatgcatgagcaaggactgctgcatgtcaccttcttctcatcactattgtgacagctgccatggcaatgccatgccagcctatgcttcctttctccctcccttgtgcaaggcaaagggtggccagagagaacagaactgtgttacaagggggaggactgagttacctctcttgggccttgccaacctctccatttctgcaccacttctaccaaaaggagctgtgcaccaggaaccctcccagggacagactgaaccctcagctctctcacctttggtgcttcctagtctccccaccagccgcctggatctcggggatttcccagctcagaaaaggggagatgagacctttggatacttgtctcagtggcccagacagaactggaagtgtgtaggggcttaaaatccttttcaatgaactctcaagttggatacccagaaacttccagaaggcaggtgaaactcctgggaagtctccctttggtcctaagcagtgtgaggaggtagttttgggtttcatattcctttgaggcactgccaaggttacagactggtagaggaacttaagacttttgggaaaaaaaaggcctggacactcctactcccttgcagcctcccaccctccatcctcaccccaagaccccaagaaattggtatatggggtcttggctggggtggaagcagagactacaaggattttctccccatgataccacaacatttgccacagggtagaagagtctgggacttccatgccgacaacagctatttggttccagactggaaaagtgggctctgctggaatggaggcaggaccctcacagggctctgtaccctgatggggcagagagatggtgacagagccacccagctcggccctgggcctgggggcccagctaagcagggctgcatctcctctcccattccaatcctgagtcctcaccactccacggtgcctcctgccttggctctgtccctgttacctctttcagtctggaattgtttctgtttcctaagaatcttcagcctgcacagccctgccctcccatacccacctcccagagaagttgcaccctccagctctgcctgcccagctcagcccttagccactgaaggggccaaaaactgaccccctaagtcagccctaagatgatatctctggcctcttcagagtgctgagctagtctgaggcctctccacctctttccagactgcagcctcaccccttggggaaggcattcatagctgaggcaccagaggcctccacggcccctcctacagctctgttctttcttctcaagctgctgaccccctgttctgctctccctccactgtccccaactgtctctcccccactttgccaagcatccaccccttcagcctaagactccttcccctcgggtactggtccttccattccaggacagccagagtatggtggcacccaatcagggagaccaccatgcagcctgaggggtttgtgaccctccacctgggagatcccaggggaagaaggaagaaggggggccttggaattcactctgtcccacactgtgctggcagatgtttaacaaccagctctcatagaggagaaaggagccctgattgtagcatctgccaattcctgaggtgtaaatgcttccaccggggccagtttaaagctatcaacatgatgtcactgaaggcgaggttgagaggagacactaacaatgagctctctcaaagctgagtgagccagctcagcatggctccgcctgtcccctaggctgtccaagaactccaagccagccccttctccagactgagaacccattacgaatttaggtttgtgaggagagaagctcctcccctcttcccattcacccccaaaataaaaagccagggcccctggatcccagacccccaatgggctatctgacccctgcaagaggcaggcacagtgtgcttaactaaagccaactctgatcaacagccttagagctctgagtcttctccagaccccaagcagacttatttctgctcctctgttcccacctgaggttctgcaggaaggaaactgccagctccgctccatgccccagcgctaccagcttccactgcctccacacacttccccacagctccactccctctctccctggagccccccagagccacagaaccatgttttgccttaaatctcaagacctctcaccttcccacctctttttaactggactgctgacctctgccggcccagcagagcaggcatcaagaggaggaaagcttgggagagggtgaggggggagggcgtggcatcagggaaggaaagggcccctggcattttcccgagtggaagcatgtgcagaggctcccagggaccagaccagtttccaacctgaactcctccagctgtgcctctcccttcccttgagggcacagcatggaaggtggggtgaacgcaggaacctatgccataagactggcagcatctgccatcccctggtggcctctgcccctcccttcaagcccctgacctgtgttgcagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacagtgagtgcggcggggcctctggagcctgagaggagagtggcggtgtaggcaaagggcctcacctttcagaaggcagcagatttgggcctcgtgagactgcaggacagggacctgggggagggggaacagtgttcccacagtctgagctcccagagagaagacaacggtctttggggccagaagctgtggctgcagccagggcagacccattgccagccagagtcagcccaagactaagctatggctgtcacccgtccatgccagcttggagaggtggcccgaagtgcactccaggcatgcacgtgctgagcctcttgtgaggacctgagaagcacgtgccttgctcctaggagcccacccacctcctttcctcctccatcccctctgcctccgtgagctcaagtttctcagacaccctcagggtgtccagtgtgatgcctgacaccctcaccctttccccagacaatgcccaagactaccagtggatcggcctgaacgacaggaccatcgaaggggacttccgctggtcagatggacaccccatggtgagttctgctgtaggcacagctggtggcccaggggacagggagtgggatagagacccctggagagagatgcattcaaaccccatgcagacagccgcttaccagctgctggaccgggaacccttgagggcagggattatctccttcatctctgcctctggaacccagcccggggctggacagattgagctaatgatggcaagaggcaaggagccaggaaggaaatgaaggaataacagccaccaccatgaggagtatacggaagctttagagaggtttcttgcccacactgaactcgagtctactcaaggagacagacagaaagcaacatagatgccaagtgaatggtacgggcacccagtgattctctttgtcctgaagcaaggctggaaggataagtcttgggaggacttcttggtgggcagaagctggacttaagagctgtgttcctaccatccatccctacccaatgtggtcagccctggttggcccttctggataagaggtgtggaatcagctcatgtacagagcctgtgagtcttgggggttctgagctcctgagaaggacctgagccaagctgtgtgactgattccctagagggccaccgggttccatggcccctagaacagccctgatcagattcccagcagtttttgtgctgctatcagatgagcctgaagttggtgctaaaagagaaaggagatgatgaagaggctccacggggaagacagtcggagcaggccaacccgcactgtcctgccctctccttactccttccccactcccacccacagcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacaggtaagctggcgcctgggaggggtcaggggaggataggatcaagacctccagctacaggtgaggctcttgctgtgtggcctggggtgagtcccttgtcttctggctgctggtgtctcctcacttgtccaaaaggcagactggagctgacctaggggtccctcctagcaccggcatcccagggccaatggcaagggcaagctcgctgccagggaccgtttgcagggacagcaagcacatgaaggtcacaggctagaagacaggacccccactccacactccacacagtcccttggatagcagcagcagagttacccacaagggcccccagatggggagcctccctgtctttgggattcccaaggccatcaatcacagagtcatagttgtcaggcctcgatcctttggctttcagtctgtggacattgaggtgctggtaggatgcgccccactgcccctgctcaccaccttgcgtcccccaggcctcctttcagtctcattttcccctgaactagatgttttcatcaagaagcctgagtctgcctggctctcgccctccacacctttctacctccctttcatcttctcttcatccctttaaagaccaccccgtttgtattcccttcctgctgttctaaattgttgaggaacccagatgttacagccagcggcttccagattcttagcgctgcatgaaaacgtccagggctcactgtcagatgttgaggctgtgtcccccacagtgcctcgggtcacaaccagcataggtcatcccaggagaccctatgagaccctttataaagggtgtttgcccctcagtggcctgcggagagccccctgtggtggagcatgccaggaccttcgggcagaagaaggaccggtatgagatcaattccctggtgcggtaccagtgcacagaggggtttgtccagcgccacatgcccaccatccggtgccagcccagcgggcactgggaggagcctcagatcacctgcacagaccgtgagcatcaccccggccatctcgctgagcacagggttagattctgccagcacagccttccccccgtcccctctcctggggaccctacaccgtccacagggttgagcaagggaagggaggtcggggggctgctcagtcacaaatagctgaccactgcccttagaagggccacgtacttgtcccaggagagggctcacttggaggatgaaggagaaaaagccagaaagtccaagaaaaatccaaatcaggaaagccgataaagcctcaggcgcctgagtcctggtttccacaagggagagagggtagtctggggagagcctgggctcgccccactttctttccaggtccactgatatctttccatctccctttcgtcctagccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcctgactttatccaagagcagtgcaatcgttggttatttcacctccagggagagctagggaggagggaggagggctccaaaggagctggaaggagcagaggcctgagagcaggaagaactcggaaccgcagctgaatgtattggatgagaaggagccaggagggctacaccatctgtatgagggaaaagccttgggggagaggggtgggttcctgcctcctgccgagggtaagccggcaggagagagccatcagagggacctccgctgcctgggagttgggttccctccaagggtccctctttcagtgtcctctctctcacctgggtctgccaccctaacaggtggcaactcggcagggctgctgggggcacttcctgcccagtggggggtgccgcccaaccttctcccctccccacccccgcccccgggaccgtgcaggcaccagggttccgtgcacctatttatatttttgaaaactgaagattataatattataataataataaagacattggaagagatctatctcttttcttttccctcttttaatttaagaagaaggcaatcatgacccggagtcccccaaaggggtcttaggaatggtggcagtggagacaggttttgatcaaatgatctcaaattggtgtgactctgtgactctggtctgttcagagcgcctaggacagtcacatctgtcgtgctttatttttcctagggtcccaatgtgtttggtagatgatctgcatgtaagcacatgtgatatgtctctacatgtgtgtacctggctgtgcctgtcacgtgtgacatgcgtcagtcggtgccatatggatttacaagtgggcactgtcaaagagcaactcaagccagacatctggtcaccttgcatgctttggttctttgtgatcacactgctctggtgggttggtagactgaatccaagaacagaggcaaaaatcaggatttataagaagggaaggaaaaaacaaactgcagacagtctgagaacagtgaatcttgcttacacattttcaaggtaaactgcttgccagctactagcaaaaaggtctgggcatcctgcccttaagtacactatagagaccgggcacagtggctcacgcctggaatcccagcactttgggaggctgaggccagtggatcacaaggtcaagaattcaagaccagcctggccaacatggtgaaaccctgtctctactaaaaaaatacaaaaattggccatgcatggcagcatgcacctgtaatcccagctactcgggaggctgaggcaggagaattgcttgaacccggcaggtggaggttgcagtgagccgtgagccaagatcgcaccactgcattccagcctgggcaacagagcaagactctgtcaaaaaaataaaaaataaataaaaaataaaaaaagtacactgtagaatagcaatgaaaacaattctaattgtttacggattcccctgacaaaccttgagagttgagcccacacacgcatgccaggcagtatccttccaccagtgccacctcctcagacgcctccctcgtcacagtcgctggacacgccattgagtctgtgtgaatatgtgtgtgtgttggttcttgcaggccagtgtgagttcctgggtcctggtatcttttcaggcgtgggcgtgtgtacagctgtttgttcgtatatatatacatacttgcatctctacctctagaaagaacagtgggccaaagtagagtgtacagcactggtcacatagtaggcgctcaatcattacttca

SEQ ID NO: 780 - DNA, 22357 bp, Human; identical to SEQ ID NO: 779

SEQ ID NO: 781 - DNA, 51905 bp, Human; identical to SEQ ID NO: 667

SEQ ID NO: 782 - DNA, 14882 bp, Human
tatgataaagaggttgtttcatccattccacaatgtgtacctatatgaaaacatcatgatggacaccacaaatacccttttcctcattaattaaatttgttttggttttttttttgagatgcagtttcactgttgttgcccaagctgaggtgcaatggcgtgatctccgctcactgcaacctctgcctcccaggttcaagcggttctcctgactcagcctcccaagcagctgggactacagttgcgtaccaccccgtccggctatatttgtgtttctagtagagacagggtttcgccatgttggccaggctggtctcgaactccagacctcaggtgatccacccgcttcgccctcccaaagtgctagatttcaggctgagacaccacacccagcctgtacattgactttctgcccttaaactgtgctgaagtttgtttctcagatgtaggagcctttgggcagagactatggggtttctaggtatagaaattatctcatcttcaaacagaggtaatttgactacctctctctgctactctcttcttacttggatgccttataattctttctctttcctgatggctctgtctaggacttcaagtactatgttgaataggatggtgagagtgggcattcttgtcttgtttcacttatgaagggaacttcttccagcttttactcattcagtatgatgttggttgtgggtttgtcacaggcggctcttattatattgagttatgtttcttcaatgcttagcttgttgagggcttttaacatgaagaaatgcttagtaaaaagtatgttctacatgtgtgttgagaagatcatgtggtttttgtttttagttttgtttaggtgatgaatcacatgtattgattgtgtatgttcaaccaaccttgcaccctaagaataaagttgacttgatcatggtggattcactttttgatatgctgcgggattcagttcttagtattttttgtggatttttgcctctatgttcatcaggaatattggcatgtagttttcttttgtttaatgttcttttctgtctttagtatcagggtgatgccagccttatagaatgagtaaaggccaccctgggcaaacagtgagacccatccctttttaaaaattatgagttttacaaatttaaaatgcatagtgaaaaagttcttacaaactccagaaaggtaggtgtaaataagagacatttgtaagaatgacagcacattaaatgtgtagatttcaaccttcagttattgcaatattccagtatcaagttggaggatgttatcagtctgatattttttcctcaaatgagagagagaaagaaagacacacaaacaacacagggagaaaaaaagcacacgttacagagagacaaaaagggagacagggaactgtgaatttggactcttgtgtcataagacaaattctagataacacgaccagaccttcaattgacatattgtgtttttgctaataaggtggaattctatgatgcgaaataactatatagtcttttctactgggatttaaatcattttatctgtttctggcttaacaggaaaaatacaaccatggaaaattatgatgatttatttaatacgattgctctatagtgttaataaaacctattaggtattttgcatattacatatcaaggagagtttgaatctcaggtagaaacaaaaaaaaatacatcaaaagttcctcatgtgagtgcagaattcaatcgtcccgtgcaggggtaagtgagtctgagatgtgttttgagcctggccgttgcgcatgatgtgaagtgacaagtctagtctgcagttttcagaaaccctcattcctcccttgactgattcaccacttgaacctcatatgacgtagaagaagcctacctatgtccccttcacatgttgtggtcaatgtgtcaactgcacgatccgggcccctcaccacatcctctgcaccggtcagtcgagccgagtcactgcgtcctggcagcagaagctgcaccatgtccatgtcacccacggtcatcatcctggcatgtcttggtgagtcctggaagggaaggagcaccagggttacactatgggcctgcagattgggtgtctccccagcagagagccatgttctgaagcaagtgagtggtgaggatgagttaattttcagtccagcgtggcgcccagtggctcaggaggaaagggtaggttgctgccgagatgaatagttcatcatgatctttctttgcagggttcttcttggaccagagtgtgtgggcacacgtgggtgagtccttccccaaatgatgggttgccatcttcaccccaatacaagtgaattttccagaaatgggagggaggcagcacagagggtgggctgatgggctgaccatgggaaggcctggggggagtctctcatgaactagtaagaggagatcctgggagtctctcatgaactagtaagaggagatcctgggagtctctcatgaactagtaagaggagatcctggtatgctcagccctctgttttgtcttagccctccccagcctttcttccccatggctgagttgagctctgtgtggcccaggcgggatactgaggtgctcaaagctggggtgtgtggggggatgtggtgtcaccgacagaggagggaagggtagcagtgttaggaacagcaggtcctctgaggacaagagggtaactcacaccctccagcgtttccatgacggtaggggctgcagtgtggctgctgtcattctgccagaagaggtgggggaaccacagccacgaccctgccattccaaatcctctgatggagctcagttgtttattgtggttcaggcattagctaatattccattcacaaaggtcataccctccaccccatgtctactttgtgttgtttggtgtaactaatcttgcagtattaaaatctagtaagagtcccttactcagcacctgctcagttctcaactgacacttttgttgtagggagacgccacgtctatgcgggatgggtccttcctgtagccccaggcacccaggtgtggtaggagccttagaaagaagaaatggggagaatcttctgagcacagggagggaggggcagctcaacatactcctctctgaggcggcatctccttctccccaaggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtcagagggctcctgtctgggcttctccttgtcccacctcctgagtcccagagcttctggtgggggtgtccaccagagtccgatcatccaggccccaactatatttggggtaaagggggattgaatacaggggaatgggtgctgtgttggaaagaataactgtccccatcgatggccacattgtaatccttggagcctgtgactatgttatagggcaggggactgaaggggaagatggagctcaggttgttgatgagttgaccttgagatggggagatggcctggactctcccactgggctcagtgtaatcacaagggtccatatgagtggagaaggaagaggagaatggggattagagcagcatcgtgggatactccaccagccactgtgggctttgaaggtggaggaagaccacgagccacgaaggggctggagaaatcaatggaactgattctcccgagtctccagagggaatgcagccctgcagatgccttgattgtagcccaggaagaacagggtctgatttctgtctccagaagtggaaggggtcagtgtgttctctcctgccgccatgtttgtgataattttctccagcaacaacaggaaaccaacacaggaacccaggtgaaggacaagttaaaaaaccaaacaagaaggttggctaccctgagatcagcaagggtgcactgctgatgccaccaccaggctggaaccacatagggagggatcgacaggaagagttgggggtggagggtgagagagagagagagagagagagcactaggccatagagcagggcagtgagttctcagctcaggtgggaggggagctgtgacaaggaagaacctccctgaggaaactgcctcttctccttccaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacaggtgaggaaagccaatgtctgtcccatgtcctatggtcctagagccttagctgaggagcttcctgctgatgatggagagaagcatggacagatgtggagagaagatgcagcatggtgtgagggtgggatcagggcacaggatggcagacagggcacctccaaaccctcctgcatggcctgcatggaagcttgcagtaagggctccgggtacccaggcagatggagaaagtggtcaggacagacccagaggagggagactgggctcagtttggggagatcagaggttccctcagcccctcaaccttacccatttcccagaagcccaccctggcctctcacctacacagagatgtcatcaccagcaacccctacactttttcttttcctttgaaaaaatgctgattgaggttaaatatacctatataatttatcaactttaccatttttaagtgtaaaatctagggatcataaatacctttatatgctgtgtgcggtggctcacgcctgtaatctcagcattttgagacgccaaggcaggtggatcatttaaaatcaggggctggagaccagcctggccaacatgggggaaccaatctttactaaaaagacaaaaaaaataaaattagccaggcatggtgccaggcgcctataatcccagcaacttgggaggctgaggcgggagagtggcttaaacccaggaggaggaggttgcagtgagctgagatcatgccactgcactgcagcctggtgacacagagagactctgtctctaaataaataaataaatacttttatattcttcttttgttaccctccaccccttccttcctaacctctggtatccaccattctactctctaccttcatgaggtccaccttttacatcctgcatgtgagtaagaaatggcaatccttgtaatgacctccagtccatccatgtggctgcaaatgacaggacgttactctttgtatggatgagttgtctccattgtgtgtatgtactacattctctctatccattcatccactgatgggcaggtaggttgactccacatcttggctactgtgaacagtgctggaacagtcatgggagtgcagatgtcacttcaatacactgaagtccttttctttgcatttacacccactagtggaattgctagatcctctggatgttctctttttaggttttgttttatgctttttgtttttttgacatagcgtttcactcttgttgcccaagctggagtgcaatggcaccacctgggctcactgcaacctctacctccaggattcaagtgattctccagcctcagcctcccgagtagttgggattactggtgcccgccaccacgcctggctgatttttgtatttttagtagagacggggtttcaccatgttagccaggctggtctcgaactcttgacctccagtgatctgcccacttcagcctcccaaggtgctgggattacaagcgtgagccacagtgcctaatctctttttagtttttaaggaacttccatattcttctcctctgtaatggctgtattaatttacattcctatcaacagtgtatcagggttctcctttctccaccaccttgccaacatttgttttgtctgtctctgagataaaacccattgtaatggggtgagatgatagctcattgtgacttcatttgcatttctctgatgattagtgatactgagcactttttcatatatgcaatgtatatatgttcatttgtatgttttgttcattgagaaatgtctgttcaggtcttttactaattttataattaaattattagttttattgaggtgtttgagcttcttttatattctagttattaatcccatctcagatgcatagtttgcaaatatttgctcccattctgtgggttgtctcttcttcacttcattggttgcttcctttgcggtgcagaagctgcttgatttgatataatcccaatggtctatttttttgttgttgttgtgattacttgtgtttttgaggttttaaacaaaatgtcttccctcagacaaatgtcctggagcatttctccagtgtttccttttagacatttaatggattcaggtcttaagtcattaatccattttcatctgatttttgtgtatggtgagaggtagaggtgcagtttcatccctctgcatgtagatatccagttttccctgcaccatttattgaaatgactgtcctttccagattgtagattcttcgaacctttgtcaaagtccattggatgtaaatgggtggattacatccgtgttcttcattctgctccattgttttatgtgcttttctttatgccaatgtcatgttgttttgcttactacagctctgtaacatatttttaagtcaggtagtgtgatgctcctgttttctccttataccttgaagtctcaagatagttggtgtcacctacaatgattatggagaatgggatgccaggactcccagggcccaacattagataatagaatgttggccatgaaccaacctcaaagatttccattgagtagaagacaggcatcctcattgccacacctctctcctgtcccatgttctaggaaacccttctagtagttggccttcacccactgaaccaagcttcaaaactggtaagtgaaggacccctcttatctctgcttttggaaacctggggaggtagaagccttggattcaagcgttggctcagcacctgccagctctgtgattgtgggcctgtcttccattgtctctgaaccccagacactccaacagcgaaagggatctgggcccagcacagggctcagtgaaatctcttaatctctaattttctgctgctgagacctcagggtagaaggatgagtgcaaatcagacattcttctcaggaaaaatgctgtgtttgttctgcctgcattcctaactgggaggacaaatgcctgggggcttgagaaggggaaggacggggaacatttttgagggtggtgtatttgtagagaagttctacttgccaaggaatgagctcctgtctgtcatgatccaaccctggttgacttagtggaacaagagctttgcggtaagagagaacgtagttcatccgtgcacatgacacttccacttactcgttcagccactgccccatgctcagactgtgcagtgtggaaccttttcctatgttgccataacaaatttccacaagcttcgtggatggaaaccacatttttaaaaaatatctcatggtgctgtagctcagaagtatgaaatgcatcatctcactgggctaaaatcaaggtgacagcaaggctgccttccctctgaatgttccaggcaagaatctgcttcctcacttttcccagctcctagaggctcccacattccttggctcctggtccccgtcttcctccctcaaagtccacaaaggctggtcacgcctctcacacggcatcactcagacccttcttccttgtccacacctctttctctgaatgctgctctgccttcttcctcatcttttaaggactttggcattctattggaaacaccaagataatccatcataatttccctaaaatcatctaggataccctccttttaaggttagctgattagcaaccgtaattccatctgcaatctgcattccttttttccatgtaaaataacatattcacaagatatggcgactaggacaggaacattttggggtggggcggcattcttatcctttccacaaatggtaaacaaggtgcatttggcctctgctcttggacactgatattgcaaaggattaaatgggagggcagaaaatgaatgcaccagtggaccaataaatgaatgatccattgggaagcatctgtgcatgagaatgattgattgattggttgtttttatgagacggtgtctccctctgtgccccaggctggagtgcagtggcgggatctcggctcaccgcaacctccacctcccaggttaaagcgattctctacactcagcttcccgagaggctgggattacacccatgtcccaccacgcctggctaatttttttttggtatttttttttagtacagacaaggttttaccatgttgcccaggctatctcaaactcccaaccttaagggatccgcccgtctcagcctcccaaagtgctgagattagaggcgtgagccaaggcgccgagccgtattttaaaagaaataatagataatgctgagtgtataatttcgggtgacagagaagttctcactgatcaaataatacttgtgaccttaatgaaaaaaatagatcaacccctggaagattggcggaaggattttccacacagctgtcagccgtgaaggcacaaaggtgaaaacaatgttatgtggaaggaagaggctctgcctgaaatgctgggaatgacatggggagaatgacaagacgactgtggagagacagagagcacactgggtacacaggaaactaaggaggaacaaggagcgtgtgtttgatactcacagccattggacttacctcggggctaactgggaatccctacatgatgaatagtgactgacatgaaaataagggaggcccaggtgcataactggaatctaggagactgtggaaaaggcaattcccgcccccctggtgaaatgtggtgctgatttagacactaaatgaatgaaagatggacacaagatgtgtttgtgaggtagagtaatttgcagggagggcttgcctggtttgatttttcctaattgtttaatcttcacttcattgatttctttctgagatttatttttcctacatgtaaatcaatacttggcagaggagtgagagatacatgaggggtggtgcaaaggaagagacctattataatataacacacaaggttctgaacggtggctcacacctgtaacccaacattttgggaggctgaggaggctggatcaagtgagatcaggagttcgagatcagcctggacaacatggtgaaaccccatctctactaaatatacaaaaactagctgggggtggtggcgcgtgcctgtaataccagctattcgggaagttgaagaaggagaatggcttcaaccagggagggagaggttacagtgagccaagatcgcgtcattgcactgcaccctaggtgacagagtgagactccatggcaaaaaataaaaataaagaatacataaatataatataacatacacgaatgacaaaggcacaccaattccaatcatcatttttctatttctctataatgacttctttgatcctttatcctatccgtaagaaaatcaggcgaaaacatcttccttatttggctttctgtgagcatgagatcatatggaaaatgtgaaacccaccagcacaggtcctggaatagagaacgtgatctgttcatggcacaaaacttgccccttcacccaaatcccccacctcacccctacttccaatcacattaatgatacagatagatcatggggaggtaaaaactaatattctttggagttcagatcgtagactcagagaccagtgccagcactatctcctggtcaccttttggagtaattcacagaaagacaggctgtattgaagcaacagatgatggagggggtggtctttcccccagactctcgggtggaacagcagcctaatatctgactcccaagatgacaaaagtagcatgttgcccacgagcttcatcattatttcctggctgtttgatataagacagctcaacctcacttatgttgatttcaatgtcactgttttttccttttcttggagaatgtaatttgtttgagtcaagagggttgtggatgtagaaactgtaaagcacattcactgtgtatcaatcccagtccagtcttcccagagaagactctaaacacctcccatactgcacctggggctgtgccaatttctatcactcaccatcactccagggagacagaacacacagggaatacattacataggcaggttcattacttatagataagcagcgagtgacaacagaaaccttcctttcagggtgagccagtccctcaaggctcagaaaaactgctcaggacacatggagtcacttcatgtgcactgtagctgggggaagccagaaagcagcccagcctgggttttgtaccctggagccacagggaacactcagctaaagcactgcatgatgttctcctccaggaagaacaggaagacagcccaggctgttctgagacgttcctcctgatctcaggatgttgctgtcttagcctatttttgttgctataaaagaacacttgagcctgggtatcttctaaagaaaagagatgtgtttggctcactgatctgcacgctgtactagaagcaggacactaccatctatttctggctgcggcctcaggctgctcccacactgacagaagagaagggggtcctgcgtgtgcagagaccacagagatcacatggcaagagagggagaaagggggtgtgatggagcttccaagctctttttaagaatcaactctccagggtactaatagagggagaacttgctaaccccgtcctctggggacagcattaatctattcatgatggatccacccccatgaccaaaacacccctcccaataggcacaacctcccacactggggattaaatttcaaagtggggtttggaggggtcaaacattgaaacaatagcagttgtatcatcagcacattctattgttattatgaaaactataacggagaaagcaggagaaagctgggtctcccgcctcgtgggtgcttgtcttaaagaggtgttttatgtggttgcctggcaaccaagaaatgagagacaatccacaaagaggaactgctatggttagcttcttattggattcccatcttcctccaggtatcgccagacacctgcatgctgtgattaggtactcagtggccatcatcctctttaccatccttcccttctttctccttcatcgctggtgctccaaaaaaaaagtaagcctcacgaagcagaggccagagaactcagggccctgtgcggaagcaggatgggagcacgcaggtgtgtgttcctcactggcaggaaagtctctggcccaaggcaggagccagaggcagagctttctagagagagcaccagacaccctgcccctgccttcagctcacagaccgttgcctgattgtgaactgtatcctcacgtcccctgcagccactcacatccaggagaagattccatgacaggcagaaagtgggagatagaatcaatgggatgggaactgacagctattcatggaatggggtcttgcactcagagagatggaatgtctgagtctggctgttggcagctgagggacctcaggcacctatggcctccccctgtgtgttggtatctgttcatgaaatgaggacccagaagtgccctcccagctgttttgattgcttccgtctcctacagatgctgctgtaatgaaccaagagcctgcgggacacagaacagtgaacagggaggtaggtcctcctagcccagcctcatggatacagtcttattccgaaatagtcctgaaaaatgtgaacaccctccctcactcaggatttccctctctccaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgccttcattctttaggtgactctttttttggctgaaagtttccagtgttatcattaccatgtccaaataactccaactgttctccactgggttctcacccctggactcggagcttctggaagcagggtggagcctgatttgtctctgagactccaatttccatccaaagatgcagcacataagaggttccaaggatcgtgaatcacatgaacaagtgatattcttactctctgcagacctggaaagctggcagagtcattccatgatgaaacatttgtagagtcataggccttgttagtctcatctccacggggacacatatcaacacatcatctttcatactataaatatacagtcggtcctctgtatctgtgggatttacaggtgtttattgaaccaaatataaatcaaaaatattcagagaaaaaatccacaaagtttcaaaaagcaaaactatgttgaatggacacaaatgaagctgtgtgtaggctgtatcaggaattataaataatcaagggatgatttcatgtacacaggaggatgtgcatgggttatttgcaaatgctgtgccatttcatgtaagaggcttgagcgtctgcagattgtgctatctgagtggagatcctgaaaccaatcacccacgaatagtgagggatgactgtatataatttttatttctcaattttaaatataaaacataaaaaaattacaataacaagataaaataaacaagtgttttatagtgtgagaatacttttagatatatttttctccatgtgtaacccttgggcccatgttatttattgagaagacattctattccaccttaaaccacatggcagcctttgtcaactataaagggactgtgtgtacacggatgtattttagacactgttttctgctcagtggctctctctctgtccactctcttgagaatgctgcattttatgcagccttatacaacccctaaaatttggtagctggagtcctctagttatttattataggctatttgctatgctttttttatttttcttgaggcagagtctcgctctgttgcccaggctggagtgcagtggcacgatctcggctcactgcaacttccgcctcccaggttcaagggattccgtgcctcagcctcttgaatagctggcattacaagtgcctgctaccaggcatggctaatttttgtatttttagcagagacatggtttcactatattggccaggctggtctcaaactcctgacctcggttgatcactcacctcggcttccaaagtgctggggaaattgattttctatagcattatgttactggatatttctgtaaaatttaaaatgagggaggcagagagacagagagagagcaaaccatgagttggaactctggaatcttgggacatgagacaaattctagataaatctacaaaaatccagaatttacatgttgtgatttttgctgataaagtacaattctaagattgtaaataattgcataatccttccctgggagtttaaatcatttgaactggttctgctgtaatactagaaatacaatcatgaaaaattctaatggtttattgtcacaattgctctgaaaaccttaataatacctattagatattttgcatattacacaggaagaagagtttgaatctcagataaaaacaataaaaatacatgaaaagtctttcatgttagcacagattttaggcatctcgtgttcgggaggttggatctgagacgtgttttgagttggtcatagtgaaggacgcgaggtgtcaattctagtgagagcaatttccaggaagccatgttccgctcttgagcgagcacccactgggcctcatgcaaggtagaaagagcctgcgtacgtcaccctcccatgatgtggtcaacatgtaaactgcatgggcagggcgccaaataacatcctgtgcgctgctgagctgagctggggcgcagccgcctgtctgcaccggcagcaccatgtcgctcatggt

SEQ ID NO: 783 - DNA, 267505 bp, Human
  misc_feature (1)...(267505): n = A,T,C or G
tgttcctatgtccttgtactatcacacgtgggcaggataaaatgtaactctagaatttgtactaaaggtgggtggaaattccactcttagatccaggcaccctcaggcgtcagccctgagccctgtgctttgcaaacttctcaagctattattatgtaaaaatagatatcttgggatattattcaaatgcactctgtgattccttagagctggggttggggcctgagaagttgcatttccataagttcccaaatgatgctgatgttgctgcaggtccatggaccacgctttaagaacaactgacttagtaattcccattctgtctcttttagacaggcccttcccccacaggctgcagttcatgtgacttagggaacctgccaactcagaacctgtgtccttttttcctaagccgcactttggttatccaagaccccagaattacctgtccagacagcctcccaaaactgtgcatacctgtccccagtctgtccttgcaatagaagactccaccagtgtgtacacacctgtatctaagtgtggccagaaaatcagctatttgaaaaaggttaaattgtgtgggtaggggttggggggtggggggacacacagatgggcctcatgcaaaacctcccctattacagggtggagattggggtagaaacagaaatgtactatgattagaggaccttcatcgtcttcttgctccagcaggctagtgttgtggtggtcttacccttatacctacttatatataaaggacagggagaaatcccatcctattatggctcatccctgattttaaggatctgggaccacagatgattcttggatggttctatttcatgaggaaggattgcatgtacagtgctcttcttagggtgaatgaaaaatgttttcccccttccatataaccctctacacattttcccagatgaccataaatgtaggggatagtgtatgcactttggatttcagctgaaatacgactaacttcctctgtgaatttgagcaagtcagttgacctctttgccctcagtttctttatctttaaaatgggagtaagaatgtctccctgttctcttccatctccttcttatttctacccaatttaattcaatacttttttcagttttttgttcagatgctaccatctttgattagatcaagtgcctgtatctcatctggaagtaacttctcactgcacttgcaaccctttgttctttttttttgtggttttgtgttgattaatgtctttctagctcattggactctgagagagcagggatcatgtctccttagttctctgttatattcattctgtcttgcacaaaacctggcacctgatagatgctaaatccccatttgctaatgcataaataaatgtgtgattattgtcataattagagaaaacatactaaatgactggcacatagtaggtgcttagtaaatgacaccaattgtttttcagtgcaatttgtgctataaataaacatttaattttcttttctcacatttgatatatggggagaatggggtgaatttgagacaactacaatttaaactgtccaagtcaccaacaaattgtggtgtgataagctactggcctaaacagctggaagcatgacacgctttttaaagactaaagaaatgaaatatccagtttaaatcaaaggataataaatgcaagaaaaagttgtgtttgtcagatttccttgccccggccccaacccaaactccaaagagtgcatctactttaaaagcgtgtggtgaaagtaattccctacccaagtgttcccactactgtcactggcctcacccttctccacaactcagggattattttaaaggtttctttaatatcggccagtccaaatattctcttgtcaaatatttctgtggcccgtacttgaaatctgtgaacaggacactttttttttttttaatgtcaaaataaaccatctgcttgtacaactgtttctaattacttccctgcctagactctccactgaggggtttggcaccagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggtaagtttggtttgttattcttcagtacagacctgccctgcttatgtggcagggctcaagcttgcaggatggctgccctaagccaagagctgttattaaattggacaagggataaactgttttcaacctgttccttttcctctccttatatctacagcgtgtattgcctcatgtctgtccttttgcttttcctttggaaaaatgcaatcattgaataaaaatataattttcttttctgcaaatacatatcaggaggaattcctgctgtgagttaaaatgctatgtgtaccagtatcttctcacaacatgtaaagcagaatgatctgtttcccaagggcagcaacaggaggtctgtgttacattttgtatcatcctgaaagagactgagtgaggcacactgcaatagtgaaactaaactttttaaaagtagagttcctaaagactgcttaatgcaaattatgcccgatgctatcatagcatgtctaactctttctatagattcacgttttctcttctgtaatataagtgcccattggccatcagatagcagtgggacgttttttaaaggagaactgaaaagtcagctgagtgccgtaccttggattactttgtatttaatctaaatgtgcatataagatttagtgataaactaccaaagagcagggcagttcacctctgtccacctggaggaaggacctgtgtccgggggcaggtcacccattacacattttgggccctggtcatttctctggtgggtgatacctgtttgcttgggaaaatacagcccttccaggcagcgcttggaccccagagagatgtgggcctcaggcgtcctgttcttggggttgtacgtctgcacctggaggggacactggggaggaaacgtgggttcggagcagggggcggcgtccgcgtctgacccggcctgccggttgcttgtcgcccgcgcaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggtaagagggcggcgctgtctcctccctcgggaggtcgaaactcctcttctgggatttctgccactccctagaagagtgaagggtggggacacgcctcccttcacataagcaccaattaagttactgcgattgtcacactttggctagttaattctggcatcatttatcacaacacttttatcccccaggctctgaacttgaatggaagtaaagttttaaaaattcattcacttaattatatattttattgtaattatgattttttaaagttgggatcttgctatgttgccctggctggtccccccccccccccccaactcctggaatcaagctatcctccctcctgagcttcccaaagtgttgggattacaggcgtgagccactgcacctggccgtcatttgcttaattctaaaatctcacttgcctctaaagttcctcattatagactaaattccccaatgtcctcacaaatggagttattttactgggttctcctatccctatcaagaatgttaatgataatatttgtagatcttaggcctgtattttattttacataggaaacagtgggagggggaatgtattattttcctccattctagggaggcaggttttgtctttgaagcctgatttgccctctcattattagaatatagttcacaggcaggagtgcatatcagaaaactgtaacaaggaaaaaagtaaacgggcacatatttacttagaatgactgttcttgcattgttctagctgcttgaatttttgagttgcaatgaaacttggtattttctgagggtggagtgaaaatacattcatttcccttgcacatttttaaggagtgattcaggttctgatattggaaagggtcaaaaaattccttcccagagaacacccttaacctctttacctgtgtcgttttacttaaggccaagagcctcaattagtgccttgtgagtgacacagaactccattagtgaaagcacaacacaatgcattccagccagggtttggcaaatttgtaggaaaaaccagccacttattttaccctcaatgtagctaagaataataagacagccaacactaacatagaaagatcaagaatgagtttatagcaaaatatttttttctcagagcctgggcccagtagtgtataagttacttaatatgcaggctgcttggcaatgcaaaaaatagtcatagaagaaatttggaggggcgcaggtgcatctacttgatttgttttccctgtgaaggctgtggatcaactctttaaaaatactgaatgctgggtggggtggctcacacctgtaatcccagcactttgggaggccgaggcaggtgaatcacttgaggtcaggagttcaagaccagcctcgccaacttgctgaaacccagtctctactaaaaatacaaaaattagctgggcgtcgtggcatgtgcctgtaatcccagctacttgggaggccgaggcagaattgcttgaacctgggaggcagaggttgcagagagccaagatcatgccactgcactccagcctgggcgacagagcgagacttcatctcaataaataaattaataaataaaattaaaatattggatgccacaacttgttatttaacttcgcagtcctacaaaccgcagtataattaagggtagccctttggaatgaaagctaagttaccgcctaatatttcattccaaatttgactgttacttggcttctctgacctatggcctctggcaagccctcttcaatatcatgaattttgaacaaattttccagggctttttctcttgttttattagagaagtaagaggtaagatgcagcctttaactggtgaaagttgtgagtgtcgtcagattcactttccctgttgaagaacctaggctggtgcttttctccgagaaactatgcagaaggaatgctgtggtagacagcattcttttttccctcccatagaaaatgatatgttgtttactcatagcatcttagtcactgcattccttccttcttgatacgaaatgcaggactgagtcaagcatggttttgtttggttatgcatgcatttctgtagaagatgaaatgcttctctttattttaatactgaatggaataatgaagttcattttttattctcatcttgctgactgatgcccatcaaaacttactctacagggccttgagcagaatctgtccccgcaaatgccctgaccacgtttgtggggcccatgcggagatccctacaagtagcacctagggctgccttgcgagcccgtcgatgtattccatgcttcaaatttagcttctcagttttatttttaagagatagttccagttgtatcactggaatatggaaatatagcaggtttcctatgtttatgtgcccctgtgctttcacctccatgaaagttcctgtaggtcctttccagaaatagagtaactttcggagacctctccaacttctaagaagaaaacaaaatccttctcttatagtactatatcatggagtgattaaaagtgtgggctctgggctgggtgtggtggttcatgcctataatcctagcactttggaagcctgaagcaggtggattacctgaggtcaggattcaagactagcctggagaacatggtgaaacaccatccctactaaaaaacacaaaaattagctgggcttggtggcatgtgcctgtaatcccagctacttggaaggctgaggcaggagaatcgcttgaacccggcaggcagaggttgcagtgagctgagatgatgccgttgcactctagcctaggaaacaagaatgagacgctgtctcaaaaaaaaagtgtggactctgggagacaatttccaggattcaaatcctagtcctattacttaatagctgtatgaacttgggcagttacttaaacattctgagccttgatttcttcatctgtaaaatgggaataacagtacctaacttatagagctgttgtaaggtttaacatatgtaaaatacttagactagtgtctgacatgaagtaagtgctcagtacatattaaaatgtatatatacataatattattacaatgatgcataacaagtgggctagtatggatggaaggatgggtggatggagatgacagatgggtagatagatagctggcccagtgtttgttgggcatttaatgcagtgagagcaatttacttctcttcatgtagtctgggtctgttactgattcaaggcccaaaaagtcaagtagggataactattttggcccagcctcagggcagctgtattagatacactatgcccttttaaagttaagtccattgggattattatactgtgaatcataagaaccatacttattatagtttgcgctggttgaaagtgattaggttccctccattagaagtctgtttcttccagtgtccacttgttcgtggcacgtgcatcttccacagacttttatagcataaagatccagccaagtgagtgttcctatggatgtgatggtctattaaggggtaaaataattttggtagaatggtgaaaccctgtctctactaaatatacaaaaattagctgggtgtgatggtgtgcgccttgtagtcccagctactcgggaggctgaggcaggagaattgcttgaacccaggaggcagaggttgcagtgagccaagattgcgccattgcactccagcctgagtgacagaacgacactccatcacaaaaaaggaaagaaaaaaagaaagaatggcaaaatgtttgattgcatggaaagaaactttcagttgatatttctaaagcattcctggttgaccccatgaccagctacaatgacacttaaataatgtattgttttcttagaaatcttttgaaattgctgttgaaatatgtcacttaaagagtttcagttttagtaatttaggaagagctaattgaattcaatttagcaacacttatgaagcactgcatattttctaggctctgtcctgttgaagggagtgtaaagatgagggatagaaggcagcttaccattgagtagggagacacagagaaataccagatatctataatgtaatgcaaaatatcatctgtacaaatttttatgagggctccattgagccaggggttatatattatggctaaaagttcttgagaaagaggtagcatttgacataagcacttgagtactgggagattttttaatccaaaaagtggactgttggaattctgagtaaggaaaatcttaagcaaaagtgtagaagcagaaaaacatgtggatgtttgggaaatagggctacaagggttggcttggctggatcttagagctgtaaggaaagtaataaaagatatgttgagaattacagttgatcatattgtagagagtttgttcttgattaaacagcatataagagctattaagagtccaaatataggagtgatcattagtgctctgatttatggaaagaaatacagtcattccttgatatctgctgggaattagttctagggagcctcccccaccagtggataccaaggatgttccagtctctcatataaaatggtgtagtatttgcatgtaacctatacacatcctctagtaaactttaaatcatctcttgattacatataatacctcatgcaatgtaaatgctatgtaaatagttgttatactgtatgttagttgtattattttgtactacacttttttattttctgaatagttttaatctgccaatgaggagcccacagatatggaggcccgaccgtatggtgcccaaaagcatggcaagttaaagtagagaaccaatggggaggaactccacgggagaggcaataagaacagaattattatttttttaaaggccatttaaaagtaaaatcaatatgaattagtgtccaaggatgagtaagatgaattaaaactcatgctgggtttttaagtctgcgagatcagaagtgtgatggaactgatggagtcaagaaatcacaggaaagaaccagataaccaaatccatgacttaaagttcttttaaaagaactctcatttttaagtggaattgatataaaatgaaaaattaatgctagcagaaagagattctgatttcattggccaccacgtttggggcaggatgggaatcttgtctgaattgttaacgtgggttaacttgtttatgttgttaaccttgagccaggtttttaatttacctgatatttagtgcctttttctgtaacagtatccttatggatatgaagaaccttctattctgtgtgacattgagcatgattttatgtatgtatgtataaatttatttaatattcatatcctttatatacttctacatttattcagactatacgccatccttagctgggtgtggtggctcacacctgtaatcccagcactttgggaggctgaggtagctgggatggcttgatctcaggagtctgagaccagcctggggaacatggtgaaactctgtctctacaaaagatacaaaaattagctgggcatggtgcacacctgtagtcccagctactagggaggctgagaggggaggatggcttgagcccaggaggcataggttgcagtgagccatgatcatgccaccgcactgcagcctgagcaacagagggaggccctgtttcaaataaataagaaataaatataaaaaataaatataagccattcttataaacattgatttatgtgttcaaatattaacaatataacaattaaaataattagaatacattgaaacatttttaatatgtaaaaattagtaattttttttcttgaagatatttgacttttatactacgaagtaagtagtatgggaattatatgtggttattcatgagaactggacttcctggctcttgaggctgcctgaggactgttcgacttgcctttcccttccaattgcatttttcttagattgttgaacgatctccctccaagcctacttgtggatttactcaggctttttctttactagtctttttctatttttcatcttctctcccttccttcaatcctcatcctgtcttccttgcccactccttcacctccgtctagcccatcttggatttaccgccccctctctttcgcaaaatagcccttccatgtctctgagtcggaggcaccaagcacgtaagaatattatctgccttgaatccccttcaccagtaaataaatgtctgtaacagacagactggctttcacattgcctctttcctgtattttcttcatagtcttcacatcgcttgtagtttttggaaacacattcaggagttccccactagctcacccactgcatgtaagccatttttcgggagctctactttcttacattcatctgtgttcgataaatgcatattgtcttagcccaagtgacgtataaaagttaaatgttttctttctgaaagcaagtgccaaacatgcacagcaattttcctcaattgtactgctttatttggacagggctctgcagctctaccatggtttcttagtctgttttgtgttgctgtaaaagaatacctgagactgggtaggttgtaaaggaaagaggtttatttggcttacagttttgcaggctgtacaagcaaggcaccagcatgtgctaggcttctggtgaggcctcaggaagcctttacttatggaaagtgaggagggactggcatgtcacatggcaagagaaggagcaagagatagagggaggggtaccacattcttttaagcaaccagctgtcctgtgaacaaatagagaactcactcatgaccttggggagggcaccaagccattcatgagggatccacccccataacccaaacacttcccacttgattccacctacaagattggggatcacatttcaacatgagatttggaggggacacacatccaaactatatcacacagagacagacataccttgccctggactaggtcatccctgcaccttgatgatctagaggaacatatttatagcattgtggtatttagataaaatagtataaatgtgagaaattcaggagttattttctatgtaaagtttccccagaatgagaaaggaaaggaacatatggaaacaaatttatttgtattacaaattttaaatttgcaaaacataaacctccctcataaggttctcagagtcttcaatatattttgaaacacaatgctaaaactgacatcgcatgttcttgatatcataaacccccacaaaagctgctcagctctctgagcctcatatacatattgttacatctgaccttgtgactcaccatgttcatgttcttgaggtaggtgatcaatgccctaggagggactgggtgtagtggctcacatcgcctgtaatcctagcactttgggaagttgaggtgggaggatccttgaagcccagtggtttgagaccggcctgggcagcatagcgagacctgctccctactaaaaattttttaaaaattgccagacccagtggtgggtgactgtagtgccagctatcaggaggctaatacaggaggctcatttgagcatgggagattgaggctgcagtgagctatgatcaggccactgcactccagcctaggtgagagaattagaccctgtctcaaaaaaataaaataaaaaattccctgggagcagagagccccgttatcattctttgggggaattccctgtctgcaaaattatgaagtaagacgagacattttgccaagcttcatatcctgcccttgtattatttttctattgctgctacaacaaattaccacaaaccttgaggcttaaacagctcagatgtcttttctagagttctgtaggtctcaaggtcccctgacatgggacttccagggccaaggtgttgatagcctctgttcttttctgaagactctaggagagaatccgtttcctggttattggtgttgagataatttagttctgtgtggttgtaagactgtggtccccagttccttgctggctgtcagttggggtccctcttgtcttctagaagctactttcgggtccttacaagtaccccactcccaaatctcaaaactggaaacaggttgtgagacctttctcacaccgctgtctcccagagcctcttccatcatcacatcccttcttaccaccgtcggaaaacatactccacttttaaggtgtattttaactagactgaacccagataatccaggataagcttcccatccaagactcataaacttcatcacatcagcaaagtcacttttgccacgtaaggtgacatatttacaggtttcaggagcaagggtatggctatctttgaaggcccatagtcttctcagcatagtcaccctcctataaagtgcagggcactctgtatgtgtgaatggcaagggagaggttccaactccattcatatctggctgttggtatgctccatcgaggatgcaagggctgagtcttttccttcttttccgaggttatctatatgatctaattgctctggcccatcttttccatatcattattttttttgagttggattctcgctgtgttgccgaggctggagtgcagtggagcaatctcagctcgctgcaacctccacctcccggggtcaagtgatactcctgcctcagcctcctgagtagctgggactgtaggcatgcgcccccacacctggctaatttttgtatgtttagtagagacagggcttcaccatgttggccaggctggtctctaacttctgacctcaggtgatccacctgccttggcctcccaaagtgctgcgattacaagcgtgagccatggcacctggccttttccatatcatttctgataaagaacactaagtgtctttctaaagcatgaagagagggacttaagcccaacagttgcctgcattcagttcctgacattgtcacttgcccactgtggagctacagggaggttacccaagaggttacaacctctgtttccttatggttgaaaagagggcaataataagaccaaatagggataatgacagtgccaaacacatatgagtgattaataaatcactggagttattatgcttaaatatgctagacacccctctcctaccctagcgtaattcctggtcctaagatatttattttcaaataagcaattttctttccatgttatatcttcctccattactaaattcatgtcttggaattactctgatagtctttgaactattatatcccaacaagcttgcctactctatagtgccagggctgggtgtgccctcagccctggccagcatgaggaatctgagagcttactgtatcatgccccaactcactgcactgccagccgtctgagtcttgtatatgtctttgtctcagaacctgccttttgtgttcctgtccctgaaatctgtaccctgatttatatgatcataattgatctaatggaatgctccagaaccctaccctcagaactgtataattagtccttgaatttggaattttcatgctttttctctgctggaaacctttagacgtctgcagactcccagggcttactctataagtgcaattctgcttctgactcttccctccactgagatgcctgtacttctagggtgttccttgatctcctctaaattgttgatcccaaataggttgatcccagaaactgcttcttcagttgcaaaactgcagaaagcaacacaataaaaaaacaaaatcaaaataactcacatatttttaaaaatatgtaataaacattactgaatgttgtggagacattgggttgtgtgttatttaatcataagaatgcaaactactgaagattgaataggagtcattctagttctttttttttttttttttttccgagacagattctcgctgtgtcacccagactggagtgcagtggtgtgatctcagctcactgcaacctccaccccccggattcaaacgaatctcctgcctcagcctcctgagtagcagggactacaggcgcccatcatcacacctggctaatttttgtatttttagtagagactgggttggccaggctggtctgaaactcctgacctcaggcgatccacccgcctcagcctcccaaagtgctgggattacaggcatgagccaccacgcctgacccattcttaaaactcccaatgctttgttatgtacttcagcctctcttctttatcctgtttgatcccctccttctcatcacatttctgtttttttatttcactttcaaataatgttcatttttcacaaggagtttagttattatttctgtcatctcattttttgcccatccatggcctctaaaatcttggcttgtaccccaagtgttgatgtactcagatattaaggacacagacatatatgcatgtgtctgtatgtatatatgtagttttttacattctggtttattatgtatatgtatacatagaagacccagagagggtctctctctctctctctatatatatatatgcatatgtttatatatcctcctatatattatttatgcttgtatagccaatcaaaatacatatattttacccatttatatttggtatatgtatatattttgattgcctgtacaaacataatatatatacacatatttatatatgtatacatacatatttgataccctaattttatacacatacgccatacatatgtgaatatgtaagtatgtgcacaaacatacatatatatgtgtgtttgtatatatgtgtgagtctaaatgttatacacagggacatacatgcgtaagcccttttctggtagaccactacctgcagatcgaagtcaagtccactttcaaatttctgtaatgctgacactcttgatataaaggttgcttgggattgatgccacatgtgtaaacctgctagaaatcaatatctcattggggaatactttttgtgtctttatctgtttaatgaatgccatgaaaacaatgacgtatcatttgggtgattcataatttggattcttttttcactttggagttaactaaatgcttttaggctatttcaagtcacattcgaattacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttatttaaattaccattatggctatggaataaatatttaggtaaaggcatctgaaaagattaataattgaggatagcggtaactgtagagcgtagaggataaagacactcataactttaagagcagaggtagtgatgttactgataaacagttgacaagccaaccaaaatgaagacgtggagtcagaaaggccaagaaaacttggaggggaggggatcctcttagtcatccaactaaactatggccaactttgactcatccttttcatttgctctcatatcctgccaatattgctaatgtttttacttaattttctgctgaatttagttctattgctagtgacttagcttagccttcatttcccttgacaaggaatattagtaatagtaaagttcttatcacacctcatgcttcattcaggctgtcttcccttctgtctatcctgtataccaccacttggtgaatcaccgtaagtgacattttgtcaagtatctgtgcttttcaaattcacttcaaagatcattctaaccatttatactggccacttattctgtacccctgctttgattcacttcatgaacacacattgagggtatatactataggtatcaaatctaaattttggcttctaatctacttggccattaagacattctagaatctgattcctctttaatggcatgctgacccgcttcctctttctcaccttgtatgctcccatctctctagttagatcttaacatcactgtcacttaatacagtctacaccaaacacatttttcatgatttcacgtgttttcttatgtttacaaatatgctgaatattctgaatactagcaccatctcacatatttttctggaaactaaaaacaaaaatatttagcacaaaaaataggtatttagcacagttctgagtaaacagtacagatcgatctttcctggagctctgctttgtatggttttgaattactgtctagtgtccttttatgtcaacccgaaggaaggactcctttagaatttgttgcagggtagatggtttagtccattcaggctgctgtaacaagataccctagactgagtaatttagaaacaggacaaatttaatgctcacagttctggaggctgggaagtctagaatcaaggtgccaacagattcagtgtatggtgagggctcattttcagcttcctggatggcaactgtatcctcacatgttggaaggggtaaacaggctcccccaagcctcttttataagggcactaatcccactaatgagcctggagtgctcatgacctaatcacctcctgcaggcccacccaccttcttaatactgtcacgttggggattaggttccaaaatatgggtcaatatttatatcatagcagccggtctactagctgaccttggcaaagggaaacctcacatcagtgggacggggatattgaagcctttgtcctttgggaaatttagcttccaaacctggtctgagatttaaaggcaagagtcacatctaagaaggtggaaaagtctggtacagctagactgagagtatcaggggaatttaccagggcgtttttgggactctacgtgggtaaattctcaagctattttctaataacttctaaattgataaagatagagagctgcatgggggttgcaaatctcattttctttggaaaaggagtgctttgtctttccaagaatcacatttcctggcaaataagaaactatattttgtaatagaagtcattctcctgtctactctaaatcatcttacttaaggctgggtagaagaatgagggctttataaagagaaaagaaaaataagacttttataagggtgcttactgatttgactttgtacaaccccactcttaggttatacgataaaatcagtccctgtaccaagagccctatcgttgtaattgtttgtacatagtcactagttcaaacaccgaattatttaaagtgaatacctacccactctagtttcctgttctgttattttatctggaaacttcctagggaaaggtaggctaaatttttttttttaaaagaggtcaatgagtttgggcattgcttaaaaacttctcttacggcaaggtattaactgtaaattcatgacttagtcaatggggtagagtaaggagccaaaatcagaaaatgaaaacgtggtaaatgcatttcctaattgttcattactgctttttcaaagctatcattttctgctgagcaaaatagttagacaaaactagttatttttataaacaaagtgacttggccatttaagcagtttcctctccaaaatacaaaagacaagttatagactattttcttttctttcctgggcaacaccattagttatatgagctctaagagctgtcttgacatggaaataattcacttgcttcaagaaagaaagtatttgatttgttaactatgtgctcgagagacttctctcagttgcctgtttggataattttaagccttgaaattaatgctacattagaaatacaaatgagtaagagtagtatctacctatatttgagtatagtatgctggaaaatattttcatacatatgaattcattcactttttataataacttttaagagatagtcaaaacaattatcctccaactattgtgctaagtaagcctgaggagaaattcctcccaccccaaatcaatagaagggttttcttcagcattatagtaaaattatcctaaaagcacatatgtagggataatttcttcatgaattttggagtactgaaagaaaaacataattttcagaaactttatttacatttaaaaatataacttctttttggaaaagtagattttgattcttatttttgtcttagagagtgcatgtaaaagctcaaatggtaagaaagtactgggcaaaagaacccgttatgcatctcatgttaaagaaagtgagatagccgaaatcactgggacaaaattacttgtcgtactgataatgagcattttctcagctgtagttgaagtttttagagagattgcatttaacatcaaccatatccaaataagaaggatcctcctgagtcagcctttgaaggaactcctccataacctaatttttcttgtctataaaagtgaaagaaaaggtaggtaggagagttgaatctacatatttgttatttccttgggcattaccttacattattttgtgtattacatattttggctattacgaataagtcacatcagagattctcttttgttcttataacattacatttcataaagtgagctccaaaaatttaaacacatgcaggttttaatatacgtatagcctttttgagatcaaagctatgcgagccaacaatactgcaaagagagagaagaaaggcatttacagaaagctgaacagttttgaatggatcatcatgtaggttcactttgcatcttggaaatgaatgggtggaccgtgggtcataatatgaaggcttatggggacatcctgcctacctgggattctggatattgtggtctttcaatatttcaaatatccctgttaatacaccagttgttgccaggcgctgtggctcatgcctgtagtcccagcacttagggaggccgaggcaggtggatcacctgaggtcacgagttcgagaccagcctggccaacatgggtgaaaccctgtctctactaaaaatacaaaaattagctgggcatggtggtgggtgcctgtaatcccagctacttgggaggctgagacaggataattgcttgaaaccgggaggtggaggttgcagtgagctgagatcacaccattgtactccagcctgggtgacaagagtgaaactccatctttccatctataaaaaaacaaaaacaaaaaacaccacaaaaacagatgttgtattttaagacctatgagtggcaatgcgctgatcttttattaaaagatagtacagtctttactgaatttaacaatcttttccttgggaaaactaagcaggcaggtttgggtaggatgaaaatgcagaggcagaatgctctggaaaatgcttgggaattggaattaaaaaacaaagctgtttgatctttctccgctattgttgctgcctgtgtgatcttgcacaaatcacgtaacttctctgagcctcagttcagttaaattcaaaaggcacttattaaacatctccagaaggatgtctagagaagaacagggaaatcttatgatcagacctagcctcattagctgtgagatttcagccatcagatggcaacaggagctggatctccagttactgtagatttgataagagggtggaaagaatttgttttcttacagttgactgcaaaacgaaatattctgttaccttagctaaccttggaagctctgctttccttgaggatttaagaactttcatatccataaataattatttaatgcatgtccagtgcttgaaagatagtataatataggcattactattttattccttttttaattaatttattttttttttttgagatggagtctcgctctgtcacccaggctggagtgcagtggcgcgatctcggctcactgcaaactccacctcctgggttccagtgattctcctgcctatgcattactattttataaagtagacgtggtgtttgtctttaattccccaactatatgcacacagtctgttaaagcacaatgaaataatgatatttgtgtgcatctcaacatttaccctctgggtgtatagttatcaaaaaccataatagtctctgctgccctttatatgaaagtcaactaggcaacctagcaagagagccatgactttgaagaacaactaatgaatgaggtgtgtgtgggaggggtggaggggtggcgtttagaagagaatggcaatagtctggaaaaaaattccttttctagtaggacaacattctatggggtgcccttaaaaatctatttaattataatcatcctatatgcttattcttaatttgaaataaggtaatgataatacagctaacatttatttagaattgctacatccttcttgtgtggtgttaaattctcccaataaacaaatagcaggataaatcatcttaccattctaaagataaaagcatgagcctcaaaaagattaaataaaatgtttaagatcacatgttgtctgaaataaaaactgtgcaatcagtcactttgttattaagttacaccatttagtacagtgacactggctaacaaatgccccaagaagtattaaatctcttttctgaattttgaattatcacatgcattattaatctaccataattaaatgtcattttcatatgtgaaagtgtgagagggagaatgctgaggagattgaaggagaaagactatatgggttccaaaactggctcgattttgggaagttagttgatttgcttgtgcctctgtttcctcttatcatagtgttattattgagaaaactcccttgcaggtaataaatcctcaacagcaacttctttttgttatcagtattatcaggccattcccatgtcactatgattaaattatatactcctcaagggcaggaatagtatctgattttctgtaagattttctcttaggtctttgttgttattgcttcaagaatgcttcattacagaccaccacaacatttagtggcttacagaaaggcaacacaaatatatatgtgtgtgtgtgtgtgtgtatgtatgtgtgtgtgtgtgtgtgtgtgtatatatatttctcactcttgggtgtgcaaatgagctacaactcagctaggcaagcctggacttcaggctgaaggctggctgcattctgctgcacgttatttttatgctacccaagctacgttttcggtattgtggatcacaggagcactagaaagtgagacgaaatacttgagatctcttaaatctttgactctgaaccaataacatgcactttatatccaaacatcactgggcaaaaggagccacaggcccaagccagatatctctgctctgcatggtgggagtgagtgaggagctcacagcagtaataccatcagtaggatttagaagggatattcaaatattcagtgaaattaatttattgacatgatcataaacatctgacatttaaatttaatttggaaataaatacattttatttttattttaagtataaccatattaatcaattacatagtaaattatattgacatcataagacattaggtctatgtttagggaattcatttttatgagattgatatgaactctcttatgtattaacttctggatgtatttttacttgtttaaaaattttcatgtcccttcacaaaaatccttaatttcctaaatatagacttaatgtcttatgagttaaagaacactgcactgaaatatatccaatatgccactttatggcaccttccaaatgctcttagtgtaaatgtatgttacaaatcccataaagcacagcaaagataacaaccaaactgttggtacaaatcatgagacagattcagtagttgtctgtttttatatgcacattcagtaagctgcttacctatgttttgttacattactttaattttcgtgcgttttctaccttaaaataatattttatgtaggataatatgcttagatctttgaataagctacttttagaatttcttgagaacttcaagagtattggaagcagtcaacatattattattcagatttctgttttgggggtttttaaaccatataactcaacttacttgagaagaaaggaaaacgtaaatggttttaaatggtgttagctctcacacaggcattgggtggccagtcaactgttttaaattaactgacaatgctattgtgaagtccattaacttaatgcagagggttgtttcattttttttaatgaggaactttaattcctttaggaactaatatttccataaagtttcatcaattttgaaatttaatatacattttgatttgatgtccatatttgtataaatatatttgacaaacatatttatccatatcaaatgaacacaatctttaagaattaaaactctaaaaatggactgctttctcatatatagagtcaaggatttatatattgatatataaattaagagttgtatatatttatgttgtgtgtataattatgttgttcaatcaacagttatttattaaggaactactatttataagatgctatatttgtagctgcagaggttataaagattaaaatgtgattcttgagagggaagtggaacaagatagccaactagaaccctccaatgatcatccaccccacagaaacaccaaactgaacaattatccatgcaggaaagcacctttatgagaaccaaaaaccagatgagtgatcacagtacccggtttcaataccatatcaaagaaaggaggcaatgaagaggtaggaaagacagtcttgaatcaccacaccatgcctaccccatccgccggcagcagccatgtagtgtggagagatcatctctgtgctgttgagggagagggaacagtgattgtggaactttggattggaactcagttttgccctgtacagtggaagacaacaaggggcaggattcagctgatgcctacagacagatcattttgatcagccctagccagagcggaatcatccattctagcagttggagcctgagttctggctagcaccaccactgtggactaaagtagtctggtgttttaaataaacttgaaagacaatctagaccataagaactaagatttctgggcaagtcctgctctgtgctgggcttggagccagtggatgtgggatgcatgtgacctggtgagacaccagccagggcagccaagggagtgtgtgcatcacccctcctttgaccctaggcagtgcagctcatagctccaggaggagagggtaaagaggaatttgtcttacaacttgcataccagctcagccacaataaaatagtgtaccagagcccccattcgaggcactagctccttgtgccagaaggaaacccactaccttgaagagaaggacccagtgctggcagaattcatcacctggctaaagagcacctgggttttgaataaatatcagtggtacccaggcagtacttgctgtgggccatgggtgagacccagggccatgctagattcaggtgtgatccaacatatttcaagctgtgttggccatggagagagatttcttttgcttgaagaaaggagaaagaaaagtaaaggggactttgtcttacagcttgggcaacagcttggcccagtgggttagaggatcaagtgaatccctggggtccccagttctacagttctaggccttgactcctggatggcatttctggacccacactgggccagagggaagcccactgccctgaagggagagaccaaggcctggtagcattcaccacaagctgagccttgagtgaacattggtaccaagcctggggtggtaatggccatggatagacactctttctgactgaggaaaggagagggaagggtgggaagaactttgttttgcagcttgggtgccaactcaagtcacagcagaacagtgcactaagtagattattaagtttcctgactccacgcactggctcatggacagcatttctgggccagccttgagccagggagtagcttgctgccctgaagggaggaacacaatcctggctcagtttgcaacctgctgactgaagagcccctgggccttgaacaaaattggcagtagccaggcagtgtggttgctatgagccttgggtgagacctagtaccatgctggctttgggactgacccagagtagtcccagtagtagttgcaacaggggtgcttgtgttacccctcccccagttccaggcagatcagtgtgaaaagagagactacatttgtttggaggaaagtaagggaagagaacatgagtctgcctggtaattcaaggaattctcctggatcttatccaggaccaccaaggagatacctttacaagtctgtaagaatcacggcattactgggcttggggtgccccctaatgcagacacagctgcaatgaccaaagatttagataacaacactcaattccctttgaatgcttggaaatcccttctaagaaggacagatacaaataagcctggacagtgaagacaacaataaatacctaactctttaatgcttagacatcagtgaatatccacaagcatcaaggccatccaggaaaacatgacctcaccaaacaaactgaataaggcaccagggaccaatcctggagtgacagagttatgtgacctgtcaaagataatttaaaatacctgttttggggaagatcagtgaaattcaggataacacagagaaggaattcagaattctatcagataaatttagcaaagagattgaaataattaaaaaaagcagaaattctggagctgaaaaattcagttgacatactgaagaatgcatcagtatctatcaaccacagaattgatcaaacagaagaaagaattagtgagtttgaagacaggctatttgaatagttagaagagacaaaagacaaaaagaatgaagtttgcttacaagacccagaaaatagcctcaaaagggtaaatctaagagctatttgtcttaaggagaagggggagagagagatcagcatagaaaatttattcaaagggatagccgagaaatttccaaacctagagaaatatgtcaatactcaagtacaagaaggttatagaacaccaaatagatttaacccaaataaaactacctcaaggaattcaatagtcaaattcccaaaggtccaggataaagaaaagattcttaaattagcaagagaaaagaaacaagtaacattcaaaggaactccaatacattggagcagacttctcagtggaaaccctacaggccaaaagcgactggtgcaacatatttaaaatgctgatggggggcaggtggtgggggctggggaggtggggaacaacttttatacctacagtaacatattcagtgaannnnnnnnnnnnnnnnnnnntggggaggtggggaacacatttaatcttacagtacaatattcagtgaaaatatcctcaacattaaagaagcaacaaactttcccagataaacaaaagcttaggatttcatcaatatcagatgtgtccctatggaaatgctagtttttcaatctaaaagaaaaggatgttaccaagcaataagaaattatctgaaggtacagaactctctggtaatagtaagtaaacagacaaatacagaatattatagcactgtaattgtgtgtaaaatatttatattttgagtagaaagactaaaagatgaacctatcaaaaataataactccaataacttcttaagacataataacataaatagaaacaataaaaagttaaaaagtgggtggatgaagttagtgtagagttttcattagttttctctttgcttgttagttcatttttgcaatcagtgttgtcatcagtttaaaataatgaattataagatattatttgcaagcttcatagtaacctcaattccaaaaactgacagataaaaagtttaaaaatgaaattaaaacataccatcagaaaaaataatcttcacaaaaaggaagacaagaaggaaggcaagaaagaaggaaagatgacaaaacaaccagaaaacaagtaacaaaatggcaagattaagtctttacttattaataataatattgaatataaatggactaaactctctaatcaaaagacatggagtgacttactggattcaaaaactaaacaaaacaaatgagacccaatgaacatttgcccacaactaacacacttcatctgtaagacacaaatagactgaaaataaagggatgaaaaaacatattccatacaaacagaaaccaaagaagagcaggaatagctatacttatgtcagacaatatagatttcaagacaaaaactatataagaggcaagtttattatgtaatgataaaggagtcaactcagcaagaagttatagcaagtgtaaatatatatacacccaaaactggagcacctagacatgtaaagcaaatattattagagctaaagtgagagatagaccccaatacaataagagctaaagactttaacaccccactttcagcattggacagatcatctagacagaaaatcaacaaagaaacatcagacataatctgcactacagaccaattgaacctgataggtatttccaagaacatcgatggctgcaaagtgcacatgcttctcctctgcacatggatcattctcaagggtagactatatgttaggccacaaaacaagtattaaagaattcaaaaatattgaaattatatcacatatcttctcagaccacaatggaataaaactagaaatcaataacaagaggaactttggaaactatgcagacacacagaaattaaacaatatgctcctgaatgaccaatgggtcaatgaagtaattaagaaataaatttaaaaatttcttaaaacaaatggaaagactacatacccaaacctatggaatacaatgaaaacaatactaagaggaaagtttatagtaataaggacctacatcaaaaaagtacaaaaacttcaaataaacaacctagtggtgcatgttaaagaattagaaaagcaagaacaaaccaaaccccaaattactggaagaaaatagtgaagatcatagccgaaataaatgagatcaaattaaaaaaataacaaaagatcaaccaaagggaaagttggtgttttgaaaagataaacaaaattgccaaacctttagccagactaaaaaagaagagccaaataaataaaatcagagatgaaaaaggagacattacagctgatactacagaaattcaaaggatcatttgtgactactatgaacaactatatatatgccaataaattagaaaacctggaagaaatggataaattcctagacacatacaacctatcaagattgaaccaagaagaaattcaaaacctaaatagtccaataacagtaataaaattgaaaccatagtttattgtacattgatgaaaagtttcctggcctagtaaagcccaggactcaatggtttcactgctcaattttacaaaacatttaaagaaataataccgatcctactttaactatttcaaaaaatggaggaggagggaatacttccaaactaattctgtgaggctaatattaccctgataccaaaaccagacaaaaacacatcaaagtaagaaaactataggccaatatccctgataagcattggtgcaaaaatcctcaacaaaatactagcaaaccagatttaacaacacattaaaaagatcattcatcatgactaagtgggatttatccctgggatgcaaggatggttcaacatatgcaaatcaatcaacgtgatacaacatatcagcagaatgaaggacaaagccatatgatcatttcagttgatactgaaaaagcattggataagtcactattacttcatgataaaaaccctcaaaaaactgggtatagaaggaacaaacttcaacacaataaaagccacatatgacagacctatggctagtatcatactgattggggaaaaactgaaaggctttccttgaagatcaagaacacgatacggatgcccacttttaccagtgttattcaacacagtactggaagtcctagtcagacaatcagataagaaaaagaaataatgttcatccacatgggaaaggaagaagtcaaattatccttgtttgcagatgatatgatcttatgcttagaaaaacccacagactccaccaaaaaactattagaactgataaattcagtaaagtttcaggatataaaatcaaaatataaaaatcaatagcacttctaaatgccaacagcaaacaatttgaaaaagaaataaagaaagtaacctcatttacaacagctacaaataaaatgagttaaccaaagaagagaaagatctctacaatgaaaactataaacattgatgcaaaaaattgaagaggactcaaaaaatggaaagagatttcatgttcatggattagaagactcaatattgttaaagcatccatactacccaaagcaatctacagataaaatgtaatctctatcaaaataccaatgacattcttcacaagaatagaaaaagtaatcttaaaatttattgaactacaaaatacccagaataaccaaagccatcttgagcaaaaagaacaaaactggaggcatcatattacctgacttcaaattataacacagagctatagtaacccaaatagtatagtactagcataaaaacagacatatagactgaaggaatagaatagagaacacataaataaatccatacatctacagtgacctcatttttttataaaggtgccaagaacatacattgaggaaaacacaatctcttcaataaatggctctgggaaaactgatatccatatgcagaagaataaaactagacccttatctctcaccacatacaaaaatcaaatcaaaatgtattaaagacttaaatctaagacctcaaactaggaaactactaaaagaaacagttgaggaaactctctaggacatcggtctgggcaaagatttcttgagtaataccccacaagcacaggcaaccaaagcaaaaatggacaaatgggatcacatcaagtgaaaaagcttctgcacagcaaaggcaacaatcaacaaagtgaagagacaacccacagaataggataaaatatttgcaaactattcatttgacaagagattaatatcaagaatatataagaagcccacacaactcaacaggaaaaaaaaaatctaaaaatccaatcaaaatgggccaaagatctgaatggatattttttgaagacatacaaatagcaaacaggcatatgaaaaggtgctcaacatgacagatcatcagagaaatgcaaatcaaagctacaatgagatatcgtttcaccccagttaaagtggctttaatccaaaaggcaggcagtaacattcccaccaacagtgtatgagagttggagaaaaaggaaccctcttacagtgttggtgggaatgaaaattagcatagccactgtgaagaacaatttggaagttcctcaaaaaactaaaaatagagctatcatatgatcaagcaatcccactgctggatacataccgaaaagaaaagaaatcagggtatggaagagatatctgccctgttatgtttattgcagcactattcactatcacaaaagacttggaagcaacctaagtggccataaacagatgaacagttaaagaaaatgtggtatctatacacagtggagtactattcagccataaaaaatgaatgagatcttgtcatttgaaacaacatggatggaactggaggacgttattttaagtgaataagccaggaacaaaaagacagactctgcatgtcctcactaagttgtgggagctaaaaatcaatgcaattgaattcatggatacagagagtagaatgatggttactagaggctgggaagggcagtgagtggcagaggggtggaagtgggaatgagtaaagtgtacaaaaatatagttagatacagtgtataagatctagtatttgatagctcaatgatgctattttttccatttgataacacaaatactagatgaatgtagggtgactacagtcaaaaataatttattgtacatttaaaaataactaaaagaatacaattggaatgtttgtaacacaaataaatgataagtgcttgaggagataaataccccatttaccctgatgtgattattacacattctatgcctgtatccaagtatctcacaccctgtaaatatatacatctaccatgtacccataaaaagtaagaataaaaaaataaattcagagtaaaaaatcatatgattttgtccttgagaaacttagtagtaggtttatagtatagcataatgcagtattagagaagtacaaagtgctttatatgtgaggagttggggttgttttgaaaatgagcatgatgttgactggtgggtatgaaaagaattgcattgtagtcaaacaagcgaaattttaaggtaggatatcatggacattttgcttgcctaggccagcaggttcttttaaagaagctgttggagagaaaccttcagagatcaataggagcagctcatagggagccttttaatgccaaaagatatgtgtgtgtgtgtgtgtgtgtgtatgtgtgtgtactcatatatgtgtaactatatacacacacatgcatatatatacacacacacgcatatatatatatacacacacgtgcatgtatatacacacatatatatacacatgtgcatatatatatgtatatatatatatatgagagagagcatatatatacatatgagagagagagagagagactgtgaacgcccttggcaggcaatgtgagcagagaattggcttttccagaaaggagtttctgggacatcactcttgggataaataggaaaaagataaaagccttcaaatggaggtaccaaggagaaagctatttagctattttaatagctaatagtgaaattaataatattctaaaattttgtgggtggctataggaagaaaagggaaagaatgatgctaggcacattgtgatattatagaactgacaggaattggagactgggttaagaggtggagatggggctgcaatttggtaaatgtaactagttatggacttctggctctcaaatattgcaagttctacaacccttcctccaccgtatcccagagatatctgagtgtctttttggtttgaatttcaagttaaaaccctgaatatctggaggaacacccacgcccatcatgctctgatgttaagtactaataccttttgctcatccttggttaaatctttttaaattcattcattgttctctctatatatactcctcactaacatgcaagatttttcttttnnnnnnnnnnnnnnnnnnnnttttcccccatttaatttttagttgagattaatgttgcacatattcacggtaggcaaagtgaatatttccaatatatgtatacaatgtataatgatcaaatcaaggtgattagcgtatccatcaccgcaaatatttatcgtacctgggagagtcaaggggaatgtggtggggccagaaaggggaaatttagaaggcaatatttgggaggcaaaggaatgaggggcagttgttcatgaaatgacagtctgaaggtagaaagtgggggccaaagaagacatcaactcccaaagattaccagtttattacgtaatgagcatgtattagccgagaaggcttgaaaaagttgacttttgaatgcgacacattttctttaaaatattgaatctggatgtttttctagttatttaaatttttatttgtaggtatctgtctagggcactttgaccctttaggtgtgggttagccatttctcattaggactgggaaagatgagtgagaaataaaattatagattgcatgttaaaaagaaaaacactggttgtgacactgagtataggtttttttttttactatatctgaagtaaaatgatacttatctgccttgttaattatatttatttgtaaaaatagtttccatttaaatttgtcaataataaaattcctcatgaaaaatatcagaaacctactctcttttataatgaaaagaaacctaagtattagttttttatgtacctatgacatttgattacaatatggaatgaaatttaattgtagcatagtatgaaatggaaaacaccctaaatataccatgaaatttatgttatgctgtgtaataatttcctcatatactttccatatataggcactaaataaagtgaagtaatttaggttaatttaggaggcagatgtttttcaaatactcataggtgtatcaggtaggatacacctgattgtgacattatttggggtccgtataatagaaaacccaagccaagggtgtgtaaggaaaaaaattgcaatttactggaccacttaactgaagtagttaggactgtgatttccaaagtgtgattcttgaatcagcagcacacgcatcaacgggggacttgttaaaactgtgaattctcagtttcatactcacggcatcagagactctggctgtggagctcaacagcctgtgtattaacaagtcctccagcttccgatgcttccatagtcaagtttaagaaacactggtatagagctggatctatccctgggtgcaaatcaacttacggttcaaaggataccaccaggatctaaaggtggactctgctaggcactgggatagccccacacccaggcttcacatggtggctaatgacaacagtagatacatatcatcacagcaccctgtccagtggacagagaaattatctcacctggaatcctcttgatgttcctgggtagcctgactcagggagtatctctgtccttcagccaatcacaatgctgagtgaatgggatgttccagttgtcttattctagtcatattgtccactgtcaaggttgcaattaatttagtatgggggcattgccacaagaaggacaagaagatgtagaatatcattgacaatgtgtcacaaacagcaaagattcagttgtttcagaagacaacctcaggccaaaatttatttaactgaagttattgatgaaagaaaaattcagagatgctctagaagtcaatcacttgactggagaaggagaaaaatgttcacttgcacagaaaatgcacagtcccattttccaatgtcctattacctagagggcaattttagtttcataaccttgattacactattaatactgggctatttgggctagtgtggaggataggcttgatgtttgtaaaataacatttatttgaatatgtttttctaaaattcaatttttttccttcttaatataaaaattgtccttattttactatcttaccacatatttttgaaatctaatctgattgttatcacatatttctttaagtggaatggcttaaataactcagataattaaaggctaattaaaggctttgtcatcattaagataattaaagtatcaattagctttttaaaaggaagcttagccttaatcagaaatcctctattcacacagcagggcctcagatatggcagatattcctgaaatggaaaaacagtacttcaaagttgaggctctgtggaacttcgtcatgatttttcttcatcaatctctattcttttttgtagacggcatatttggttttttttttcccctgctttttgtctaactagttatatattgcttattgtagatacttttgcaaataccaaaaaaaatgaaactcccagaagcaacattttagctaatttttcccagcatttttctaagttttatttttatttttgtggttaaaagggataggtaaaaacccatcagcataaaaaatttacttctctaataccctaggaaaacaagagaattacaaaatacctagaactgaatgataatgatttctggtttcaaatatttcctgccatgaatttagttttatttatcctatcagtgattatgtatagcttttctacatggtttatttaattcttaaaaattctcagtgatttttctattccaacattgtcaattgacccaagttgagtttctggatatgaaaaccacaatatttgatatgaaaaatactatatgggattaacagcagattcacatcacagaagaaaaaacggtgaatttgaagatggagcattcgaagctatccaaattaaaacagaaaaatgtttttatttgtataaattttaggattacaagtgcagttttgctacatgaatatgttgtatagcgggggaagtctgggtttttagtgtaatcatctcctaggactattcagaaaataggttttaaaaatgaatggaacatcagttagctgtgaaacaattttaaatgatctaatagaggtataatttaatttgtgaaggacaggaactggcaaaatatttgaagaaataataatgaaaatatttcaaatttgatgaacattgtatatccacaagcacaagacgctcaataaacttgaactataaacaaagaaatctgaagacactacactgaggcatgtcaaaattaaattgctcaaaaccgttaatagggagacaatcttaaaaagcatctagagaaaaaaccgtatactgtatacagaggaacaaaaataaggatgatagcagatttctcttatttcaaagacagtagaacaacatctttaaaggattgaagaaaaaatgtaaacctagaagtctaaactcagcaaaatacttttcaaaaacaaatgtgaaattaagacttttttcaggcttacaaaagagaatcatcactggtcgatgtcagctagaagaaatgctagaggaagttctgcaggcacaaggaaaatcatgccaagtggaaagatgaatctacactaagtcatgaaaagaactagaaatggtaattacatgggtaaatatatgtggtgcatttttcttttattcacatgtcttttaaagagaagtttgcatcaaaaagtgggtaaaggatatgaatagacagttctcaaaaaaagatatacaaacagctaacaaacatatgaaaaaatgctcaaaatcacgaatcatcagggaaatgcaaactaaaacctcagtgagatactaccttactcctataagaatggccgtaattaggccaggtgcggtggttcacgtcggtaatctcagcactttgggagaccgaggtgggctgatcacgaggtcaggagatcgagaccacagtgaaaccccgtctctactaaaaatacaaaaaattacctgggcgtggtggcgggcgcccgtagtcccagctgcttgggaggctgaggcaggagaatggcgtgaacccgggaggcagagcttgcagtgagccaagatcacgccactgtactccagcctggtcaacagagcgagactctgtctcaaaacaaaacaaaacaaaagaatggccataattaaaacatcaaaaaaacaatagatgttggtagggatgtggtgaaaagggcacacttttacactgctggtgagaatataaattagtgtaatacaaccagtatggaaaacagtgtggagatttcttaaaaaactaaaagtagaactaccatcaatccagcaatcccactcctgggtatctacccaatggaaaagaaatcattagacgaaaaagataaacgcacacatgtgtttacagcagcaccattgcaaagatgtggaaccaacctaagtgtccatcaaccaacgagtggataaaaaaaaaatgtggtatatatacaccagggaatactactcagccttgaaaaggagtgaaataatgtcttctgaagcaacttggatggagctgggggccattattctaagtgaagtaactgaggaatcaaaaaccaaatatatgttctcacttataagtaggagctaagctatgagaatgcaaaggcataagaatgatataatggactttggggacttgggagagggaagggtgtgagatgggtgagggataaaagactacccattgggtacagtgtacactgctcaggtgatgagtgcaccaaaatctcagaaatcaccactaaagaacttcacctgtttcccaaaactattgaaataaaaataaaaattagaaaagatcagagggaaagaatatgggggaaataagacccccatcaaaaaataagtgatgaaagatactggggaaaaacacaggagagcaggttactggggaaataaagactatttgagaaatgggcaaaaatgataaataatgcaaatccacaatgtaagtttcatattttaaaagtctagacctcttgcagctttgaaacttcatgatgctatttaaatgtcatgtttagtattgtaaataatggtaattttaatcattaatgctaattgctattctctgtggctatattactattcatttattcagtcaatgcatgtttgtttagcactagaaggaacataagcacacatccagtagtctgtattttatttggtttaatttcacacacccaaaaatgcctacgtaggtattaaatgtcagctcttatttttaatgctttctagattgcatcagccaaatgggaagaattataaaaaaatgtaaataactacttaaatacattcataaggtcaataataacaaaattttataatacttcttcataaaccttggatttgttttattgcttctaggttctcatagtgattttgatagcctatcttatcatttgttactatatctttgttaggtataaatgttcaggcttcacctattaccaggcatattaaatttcacaagagaaatgtgtagttatagctccaaggcaggtgttatgatcctgtcaaattgctcaggctaattttaaatcatatcaggtctgttgctgggagatgtttgaggaacacaggaaattatatggagcctgttgataacagcctgtccttatcctgtgacctaaaataataccaaacttgccacattaccaaccctcttgtttaaatgtaaaacccatattggaggtttacaccaatgtcattaaaaaaagaaagttaggattcaaaaatatgattgtaatttttgaaatcctggtagcgaaaatttagctgaaattggcaattatatttgacaaaatatttaatataaatcaatgtgatgtttagttcaattacctcaggaatatatagagttatcactgatggcctaaggccatgcattccaagcttgggtgatcataagcattacctgtggtgtgtttctgcaatacagtttcctaagccccttttccgaagtgcattccgtagatgtgcaggttaaccagtgtcctcggtgaatctcctgctcagatatactggcagcacactggcctaaagtaaggaattcttatgctttttaagaaactggatgcagagagctcttctgcatcaactgaagtatgttcagtcttagcttgtaggttttatttccttacagttcattaaggtcagaaagaagggttaatcttcctaactcaaatgatgctccgaagacaggaattgttaactaggtttgtgttcagtgtgaaactggcacagggggcctgactgcaaacagccatgcagggaggttgaggctgaggaggtggtgatggtaagaatgctgggcttcggaggaggagatcaaatgggcctccctcatgatgagaagggagagaagggatggaggatggcagggattgggacttacagtaaacagatactggtttttcttgaaggatgtttggatttcacagcccatgcttttctaaccaaggagccagccttagcattgacatttgagggagtatacaattccaaatgaggttgaagataaaggagcaattgctttttacattaaaggcacagccttttcagagcaatctgttcatcctctgttatcactttaaagggagtctagtttttagcttgatgtatacatttaactgactctctataatggcagagaagactgcatggcacttccaagttcatttctttacctttaagtggattaaggcatatgcctgcttagctttcccacgttcactgctttgaggggagtaaaactggagtgatttcaggaattgacactggaagagtttcctggtcacaggctttgaacccggaaagacctaagctgactgtcaactttaacttgagagagctgttaaccaccctcagtttccttgtctaagcggaagaacagaacatgttaatagaaagtgcagtttactgagcatgtactgtgtgctcaggcattgtactaagtaccctatgtcttattcgtgaaccccccactacaacctttggagatatgtgttatgttctgacaacagcaataattttgcgtcttcctcatggaattttttgtttatgtgtgagtgataatgagattagactcattaaagattaaagaagattaaagccatgccaatattaggttcccagttctcaaaaaaaagggagttatattccttttctttcatttgtgactgttccttttcatcttttggtgttttcaggaagccattttgcctgcagccgctgaagtggcccagctgcagatgttaatggctgtttaccagtaggagccaaaacaccacactaaagaagctaggaggtgtggttattttgccttttctgtaagataaatttcttaatgctaatgcctccaaatgaagacatttgatttatctctaaagtatatttttaagtatagaaactgtaatgagtggctagattactactctgttttaaaatgtgttacaagacagctttcatcatgtcaatctacggatccaacaattaaaagaaaggttaccgaaattgtacacagatagaagtttacttcatatagccctggcattccagtctcttctaagaatgtgaaataaaggattgatagatggataaacacatggtagatggaggtctgattcaggtggtgttaaaaatcaaacaaaaatctttccaaagtagggatcaaattctacttcttttgagatataaactgtttatagctttgaaatgacagttttcacctcagcacacccattaaatttttatggaacccttcctcgtctattaatacatggcatataggaggggctcaatataatttagttccccttaaatgctttggtatgtgatttggagagagcagctgacatagttgaatatatatcagatatatggttagaaaaatatcgcatagcatctgtagcagaaaaattagttttctgaaaagagtgaatgtaaataatgccagggaagtatgcttttgaataacatttggtaagatccattctgaaagaagagagttagggaacttttattttattttatttttcacagtacaggaaaaaagcaaaacaaagcaaccaaatgtcctgcttgggatgaggtcattgatatcagaggatgctgcgatactgatcaaactgataaaatagcattcagtttgtctgactcattggtgaaaaatagaaaccagtgagaggtggactaaaggttagtgtgacggttgctagcttttagaacaagcagaaaacaaaatatttttactttaaactttgtctcatgaacttagttgcagtgatgggagcatttaataaaggtaagtagtatttttcattaaattttattagcattttgttatggactgaatatttgtttacccccaaaattctgtgttgaaattctaacccccagtgtgatggtatttggaggtggggccttttggagataattaggtttagttgagtacatgagggtggggccccataatgggatcagtacctttataagagaaggaaggaacaccaagagctttctttctccaccatgtgagggtacagcaagaaggctgccatctgcaagccaggaagagagccctcaccaagaactgaatcttcccgcactttgttcttgggcttcccagtttccagatctgtgagaaataaatgtcaattgtttaagccacctttttatggtatttttgttgtagtagtgctagctgactaagacacacttgataagtagctactatgcacagagtcctcttaaggaataaagaacagtctaaccctgaagccagtgaagacaagactaattaaaataatactactaacagggctgtgagtaatgtgttgttcacacacagtaagtagccattaattctgcctgggattatcttgtgggtggtgctgtttgagctgagtcttgaagagtaagagggatttgtagccttgagatggtacagcttctgaagacaggaaattggaaatgggcacagagaagaggctaaactacaaataagtgttttgacaaaatatgccaaacctaacacatgtaggcaaagccacatgcagtagttctggctctgtttatcttcctgctcagattttagtctgacagatttatagagagaaggggcagagtttctggttcatttgagaaatcatggctgaataacaggtttttcccttgattagctgggaatccctagggttgcccaagggccacagatacttactgacatttagtaaagaacctctaaaacatcttcagactggtctcattgttaataagtggtgtgacacacattgtgtgtgtaatgtctgtcttggtttttggtggaccacttaaaagtttataaaaatagttttttaaggttctgatgacttttctgcaatataatttgtaagtgcttatatatctccaacctgtaactatgtaaattactgtgaataattttgtccttaatgaaactctgtctgcttctctgtctgtgattaaagattatgaataaaatgcatcggtcttttttgtcctacattctcctctgcaaggtcaggagatagggtttgtcagggcccagttctagcactgtcttaagactccatcctcagaccctccttctccccgttaccatcactgcaaaacttaccctataaagcagatagcttccaaattaacctactttgaacattttttatcattatgagcaacttcatctagcagatataagtagtgaagttttattcagattgttacatttgaagggattttataatttgtcacattacggtagagagccctgtggcctcccaaattgtaacaacttttcctccatcacacattgtcattttcttatgccacacattcttctgatgatttttaagtggatttgtaagatgaaaaattctgaatcacctggatgagcattgctttctttttctttatttttttttaaattatactttaagtgctgggatacatgagcagaatgtgcaggtttgttacataggtatacacatgccatggtggtttgctgcacccattaactcgtcatctgcgttaggtatttctcctaatgctatcctccccttagccctccaccccctgacagggccccggtgtgtgatgttcccctccccgggggttcaatatgttctcttttgttcaccccccaattgatgagtaaacacacacaggtgggggtgtcagcattcctgttcctgggttattttacaaaaaatggtggttccccccttcacccatgtccctgcaaagaacatgatctcatctttttttatggctgcatagtattccatagtgtatatgtgccatattttctatatccagtctatcattgatgggcatttgggttcgttccaagtctttgctattgtgaatagtgctgcaataaacatatgtgtgcatgtgtctttaaagtagaatgatttataatcctttgggtatattcccagtaatgagattgctgggtcaaatggtatttctggttcttagttcaaccattgtggaagacagcgtggtgattcctcaaggatatagtgcatcgctttcttacagaggtgtctgaaataaatgcagttccttcttttgaaagttcaaaggcgttaagtcaatatatgactgtatttgtggtcctgctcagcagttattcatttaggaggtgatttgctattttctgagaacagggatatgaaatgaatgtggttgcttttagagtccagaaatccatttggctcaatggagctgacacagtttattgcagtttttaggacctttttgtaatttacagtggatactaatttcctgctcaagttttctttggcagcttctgtacagctggaacagaagctggagctatgccctaagagggtggtctggattcacttctgtgggtctactcctctgcctcttcttctctgttccctctttcctttgcctttcttttcccaaattcctcaaagcttgaaagggtgagattttccttttctttcccttgctgccctccttggaattccattatgcaattcaccagcctcagctgttggtggaataaatggtagctaccagaggaatttagacaatcctttctcttggctctcaagtatattgtctcactgtacaatcctcttttgaattcccaaagccgaatattaactctttctttcttcgcattgcttctgtaataatcctaaacttcctcactccctttccttttccaagttcaaatgcagaagcttcaggctgcctaaggataaaatgcgtttatgaagaattcctttacacagaacttttctgggagtaaatctctgttaagcatgtagtagatgttgtacaaagtttattgtgtagataaatccatgggttaatgggtggaaggggaggtagaaattacagactttgtggaatgagtagatttcaaatcatccttggaattttcaagattttactcaaggagctgatatttagagcttagatacacctctactattttataaataaagggccagctgaaccgtatgagtttcttacttagcagaattggagctcttgcttttttgtctttcatcctctatcccaaagatttgttgaaggatgatgaactgaatgaaggctgggtatctttaagaagataccaacaatgtcacttattgaaaaaaaaaaagctatttcgattacatagttttaataatcctcatgtcatgtactcttattacgattctcaatattgcagtaaattgtgttttgtggggctttgattaaaattacattttgcactcacttttatggtctggagtgattctgatctatggggggagtgataacatcagcatcaagattttctttgtccgggacgtgcttcagctgcatgacaactctcctcctgagtgatatgtgacttgtgccttcatcacctgttcatcctgccaatatattttccacatctgtcctcccattcacctaaagatttattccacatgcctgatgacaaaatgtccttgcacctgggggacctaagcctgtagaacatctatctcattttctttcttttgacacaagtccattagcttcatctgtcttgaggacaatcccggctaagagcctatctgatgtttcttctttggggacctttcagaatttcaaggttataggaaacttggctttgtgcaaagtatgttgccatctgttgctagtttctaatttcagatccatttaagagatttgccaggttagatttatatagacattttaactaattctatttctttgtacttaacccaagatcacatacttaggtttgtcctttcaatatcatttatcagaatactccactattcagccactttgaggagacacattgtttacctgccacttgctgtgataagacattacatgcagcatgtgtttatttggtagttatcaaataataatgcctggtaacagacagccaaaaagcaaacaggggatttagaggttcctgtttatttttgtttgtttgttttgttttaaataagtaaattgaaactcagagcaattatgcggcttacttaaagtctcaaaattagctcatatttcagatgaaatttgccttcaagttctagatcacctgcagcactgaagttttggtgaccatttattcttcagattgtatttatgattccttgattaacaaatctttaaaaagttgtgaaaattattttctggcaaacattggaaaagggctaaaatatgataatactgtagtcagaaaaaaactattcaaagacacacttgtatacaaataaatatatttttattacatatgcttcatacgcactttctcacatacagagctctaacttcagtgacaataagctctttccagagatttatcttaagacaataatccagaagaaggaaaatgctatacatatgatggctataatagccaagtgttataggcaaattgtgtatccaataatataaaataaatgatagcatattaactaatgtggtaatttacagtcattaaaatgatgagtatgaagacaatatatggaaatatgatgaacaatcgagtttaaaaagccagaaccactgtattcgctttcctttcaactatatgaaaagtatacatgcataagacaaaaatgtaaaagtctatgaaatacttagtgttaggttgatgatattataagcgcttttctacttttatatttttctgtaagttaatgttggttctacaacacaccatgattacagtggtatgatatccactgccaaagaataggaatgcgttagaccaagagtgatggggattatttcacacaagtgctatatttctctacttcccatgattgacattcttaattgatgttggaagggttttgaatccttctaagttagttcttcaggttcatgaactgatcagcaagagcatggaagttgccaaccctttttaacttttatgtagtttactctatattccaaattaattgtccagaaagagtattgactttaaatgggctccaaaatatataagtagcaggaatggtggctgagacaaaactcctggtgttcattgcttagaaatgtctgatgtggaagtgatggaaatggtgggatctgagctggccgttgtcgtagctgtgaacgaattcacatttgtttcccaggccccacacaggtaatgctctgtctgtattccacagacagacacacggtcaaccccacaagggtgcttttctgttcccttcctagagtcctctcatgaaaatgtgcttgttctcatctcatcccctcaaggtttggctttctacttcactgactccccggatttaatccatgtatgggtgcagctcctcaacagtgggattgctatttgtgtaggaatcttctgggtccccacactttttttttttgtacaaagaggtaactagcaaaagggattttttttaagtaaatgatttttggtacacttccaatcagtctatatgaagggcctacctcctataaggatgggcatgagtaggggaattagaagaagattaagggggggtctttagttggagctaccagggaggtgtatgagatttcatggtgtctgtctgggacctggtaaggagtaacctttcccatttgtgtaggtgtatttacagttgacataactggtatagctttcctttatctcaagacaggacaaataatactgtaattctaggtaaaagcaattcattgagagagaaactgatatatcttacattgtatatttcataatatagtgaaacattttgaaagcttacttgtcttatattggttttcttaatattctttaattttcccaccagcttcaaattccacaatttatctacatgcagatacccaccatttctcacagatacatatattccagcctatatttctccagagttgctatttcttacagaatatttctacttgaatgatttactaatatgtaacctatttttgttgcaaaacaacagatagtgctcagtgtagaatttcacactccaatccaatgtaatctagaggtagacgctcccgggcaggctagtgttcagcagggacacagccctgggcatatagttgggagacttgggctggggttttctctgccagagcacagatctctgatcctgtaagtcatttaaattcttgtgtttcaaattccctcactgtaaaaggagtggcttgacctagatgatctcaaaagtctctccaagcttgaaaattctggttctatgattttaatatttaacaatacacataattgtgcttgtgcttgcatgataattaggcatgcatgataatggggcacagtgaatgactgtaattagctttactcctacagagaaaaaatctatttttaagtctttccacttctcatcttattggttttttaaaatattgataatcagtatcaatggcctttgactttcccttggaaccttttacccttaccatcctcaacttccttcttgccactgctctctgtcattatagcggtaatcacaaatccacacatatattagagaccattatgttgaatattaattcctgcagagctgaattcttcctgttctgactttcaggtaggacaatcctctcccatgtccttaattttcatccaataaaggtacttttgtggaagcttcctgccatatcctgaataaaggtgtccttaaaaatccagagatgaacatggaggaattaggtaaacaggatctgtttcacaggggcctgtggaaagcctgggatgttgtagtatcaggcatgtagatcatagtaaaggggatgtcaaggagccaggggagcctgggacaagcatggcagagggcaaagcccacagtgtgagaggcctgggggcctgctgacccacctgggagttctgaggccagagggaaaagagagggagagttgtccttacaggatgagagaagctagaattgtggccctttactttagaagtagccttctggctctgtaagtaaatttacctgacaatcatattaattattataactaacattaattctacaaatgtgcaaggaactgtgataagtactgtaaaagaatgatttaactcctcacattattccttttaagtaaatccttttgaatccctcaattgtaggttgatgatctaagtactagagagttctgaaaacttgatcccagtgatatgagtagcaggcgatggagccagctttagacacaaggcgatgacattttcttttcccttctactcaccccacagtccgtatgccatcctcaaaatatgtaattgcaatgtcaatttttcctgtttcgttggaccaggacatgtaaaccatggaggcagagtctgaaaagttctacgtaattgagcaaagtagtgaaaaagtgaagctggaaacgaaagacaagttttgattccacttggtgtgttttaatttaagttggccaccaggagttcctgagcaaaggtgctcactgtctctagtggtacttgtcttcctgagatggaagctctcggtccttactccccaagtgaccatgtcacgctccttaagggcagtctctccagatgatgaccaaatggtttgtagggaagattttaactctgatgtggaggggctcttcaagcaaatattttgtctcttctcagtacagtaattaagctgataattttttttttttttaccttttcgggccactacaacattctctgctcttggattcaaagatgaatgttccttccacacagtttaatacgtctacagttccagccgaggttgggggagattttgtctgatcaggatgtttttccaatagtagtgtctggttctgtgttgggatttcactcagtaaggttttccattcagttttatgatttggtactcctggtatgcacatcttaatatatctgacccttcactttaaatttttgttgcactttttcttttttttaaattttgtaccaaaaaaaaatgttctgtatccgagacctcatatagcttctattgggagttgtctccacttcaaacttacatttcctttgaaatcccagtgagtagccttactttccatatggcctgatgagaatgtatttcccttgcagatgtgaacaagctttttatttttaacttctcaaataagatgtacatccaagactgttaaaataatcttccataatgatttgtcttagagtagaaatatgtggcatatttttaatcataaatacatatacacattataattgttcttctgtatttaagttagtacctgtgatttgtttatccaagacagatggtaaggggtgatacttttgtcagcttacatctagagatctatagtagggttaatttagaattcaagtaatttttgttcaaggctttatgattttatgaagaaaaaataggaagaggttaaatgtcatcaagcattcagtttaaaaaatatacagatgacctaaataatttgttcagttgtatacttatatataggtgtatgatgtattactcagcttaaacctccagtcctttctcctagagcctaatagcatgaacggccgcagatggggattttacctaggtttctgtgttagcctgtttttaggctgctgataaagacgtacctgagtctgggtaatttatacagagaaacagatttcatggactcacagttccatgtggctggggaggcctcgcagtcatggtggaagagaaaaggcacgtcttacatggcagtgggcaaggaaagaaatgagaaccaagccccttataaaaccatcagatctcatgagacttattcactaccactagaacagtatgggggaacctgcccccatgattcaattatctccctctcacaactcatgggaattaggggagctacaactgaacgtgacatttgggtggggacacagccaaaccatatcagtttctgaatgtcctcttcaggcacaattttgccttgtgttatctgtgctctaagttcatgctgcttgtttcctggctatctgcaaaaataataaaataaaatgcagcttcagactcctgcatttgccacatatacttttcttatgctttacaaactttatcctagttatcaaagaccaggtgttgctggatatttctgctttggcttctacttttctttaattctgtcaacccctccctcatgtctttacactgcaattacatagaggtactcagtacaaaatatattgtatcagcagcatagatggctgcagagattgccttacagtagaaggcagtagaagtttttatggttttatatggagaaagaaaattgtttgctagcactcagatattcttctccttaagttcgtttctcccgactttgactttcactataaaatgccctgactcacttttggaactggagcaaagagaacaagagaagtgatctagagttgctacttcttgcttgggcaaataaatgcctcatgcttcccctgtccctttagtgtgagtcacatagaagactttggcaattgatttttctatttataatcagatatccccataggaatctttactggattactctgactttaaaaaaggagagagatttctgtatttaaaatgtttcataaaaataattggggaaaagagaaacaagaaataagagatggctcagggcttagatgcctgtgtcccctaatttgcccctgagatggaggacattcctgccttctgctgcgtcagcctccttccactggctcttcaacctcctggacctcagtgtggctttccaggtgtggccactggctggccttgggcctgtcaccactcctttcatctgatgccttcccccactgaaggccataggtttatcttccaccatcagtttgtcttattaaaactggccactcgacccttgcattttctgtggtctcacaaaataacacctaaggataaagacagtaaatccagaatacactttgtttaattcctcatgttgaggatcatttttgatcattgcctgctccaacaagccagaaaaaaaaagtccaataaaatatattatgcagtatctctttataaattgttttcttgaatagttatgagtggagtccattggattcccatttataacagagtttaatgtagtgaaattcctgctgactgatattggaaatgaaagtttcatttataaggatgcaattaaagcattgccaagttaaaaatgtcatgttgctctttgtcaatgaggttcattatgctatattattatatctgtgtgaatcctttcttctcaggagcgaaatgttctttctgaatattaaccaactgctacaaaattcttcagagattattattctttcaaattacatgaatttaaaaatcatttactaatgaatcctcctgaatttctcagaaaaagaaagaactcgagcagatttacccattggtaaaggaaactgccccttctctgatattgggttggttagtaaccattcagttgcatttttcctgcactttcatgtaagtcagtcatagatgcagaagggcatcctggtgggaagtagcattttacagcctttaagcagactgtttttctaaatataataacaatgaaaactatttggatacacatgtaagtcctttgtgaggcttgagtctagatgaaatatcagagtctactgcaacatccagtctgagggtgcctttgaaccatttcaggacaaaagcaaattaaacttggaatcctatcccaacttcattacctagctgaatgtactcacagttcatctaacctaattgctcttcctgcttcctcctgacagtaaatgaaataataatgacaattattttaaaacagtaaagggatatataacttagtggttgttattctgattactactgtgtgtctcctctgcttcacaatgggtagagtttagtttgatgggtggttcaccttttggctcctgctatttggcttaattgatgattggcaggcaatctggcttaaatctgatgacctttcttcaggaaaggaagggtgaaatgaagagatggtaagaattcctcccatatttcctgatctatctttggtggcccaggcttccagaattccctgaatcacactcctctgcagaatccttgcagtaatggttgaccatagtatggagagtgactgtcctgttatctactgttggtgtggctagacttattctgccagcttatctgctggctcccaggaacccagtggaatgggagtcctggcatgcagtgccctgtgaattcaatttccaggcaaaaccaaggaagagctttcctttcgagaatgcagctgacactgacatcctcaacaacactttaaatacaatgattacagtaaacaaaaatacaatgtcgtaaaaaagaaaaatgactcttagatattacccagcaaggaaaccacagtgttccagagaattgtaatgccccatgatagcccttaaactccctcaccactcctactttttgatagaaagatctgtaagggctacatgaccttaggctctactccccagcaaggtcagttttgttctatggaatatactataatgttgattgttgtgttcccataaggtcagcacatctccaaggtctgtcctaacagataaacttttggatcagtggtgagcagactaggacaggtataacatgtgctccctaaccagcttcctgaagtggctcatggttgaatttttgggaatcctttatcacaaagatggagaaattggggaccagaaggttgaatgtaagccagttccttttccccagaggcttccctctcacctgaaagggcatttttgggtgagcctcatcgttgaaagaaagtgggatacaaacaaaacaaaaaataagaatgtgtattggcccccaagcagacaccctaatttagggattaatggatatcatagatataagtacacacttaaaaaaaacaactaatgctctttgatagcttaaaccttaagtctttaattttatgcacattattattttttattttccaatttaaaacatttgcttcgttaaataaaacacacattaaggaaaccacataggaccatgtgtgatataataagttatcagaaggttgaattcttacatttactactcaggctaagaaattagtctgtggccatgctggagccctgtgtcccatcctaagtttgttctcactctctttcttcaaaagagatcattatcttggtgcctagtccttcatttatttattcacttattcaacaagcattatggtgtgcctggcatatgtcaaatcttttccatctgaaagattcagaatggcctcttaggtatatgagataacattctaaattaattttattctcctggcctgcaaatttattctcaaaaactgctagttatatggttgctctgtttacttggggacaggtaggctggttcatacatttactaattaaattacttttattgctaactctgaatatttaatgccttgtttggcaattatgagagatatgagtaaaccacagtctttgcttctacaatgattatacattatccaaacataatgcaaaggaaatgttaccagtaagaatgccagaggcccttttcccctaaattctcatgtgcctcgttccaggaagaaaaaaagaaagatttaggatgtttctttctacatcagtcattcccttggagacaagagagaatgaggcaagatgtattggattgttccttagtgtttttccattatgcctctccatctacagattgtgccctccaacaatttcctccctctaattcaaacgcagtgctcttgggaacttattttatgtgtacccaataaaatggcattaatctgatagtggtttgttcaaactcacacaaaatttgaagcaagtgctgtgttccaccagccagatgtcatatttggtaaaagaaatatggggtaatcaattttaaagtcctccaagttttcctatactgtgaaatttagggaggtaaaattaggattgaggcaaaaggatctggatctcctgaaaaaatatggttgtgcacttagtgttgtacacatctttcctaaccctctattccttggactgtttgtactcagggtcagggagtggtgaggctctcattggcatgaccatttaaggggttcaggaggtgtgtactccacagaaggcattgctgaacctgtggaagaaatgctaacaagaatttgaagaatcagactccaggaatgggaaacactattctgaaataatggaggaaaagagaccacattcctttcttgggggctgggatcaagaaagggcccccaggtgggccaggaactcacctgggctggatccatgcagagtttgttcatggttattagagattatgcctttagaagtgacactagtgggcacccctgaaatgacctccaacacaccccctaggggagtacaccctgagtttcccgaaaaatgaggaaccactgacaacagaaagaactggttttctttgtgtggaggggttagtccctgggagggaataatcttccttcagtctcaatagctaaaactgtggggaagtgatgaatggtagacttgagactttcctttgctgttaaggatgatggactagatgatggatgctgttaaagatgatgatgttttgggacatcagagcaaccaataactaaacagcagcctgtgataggctggagcaggttgtcactaggaagacagggagtattcaagtctggctttctctaaatcgtgaaatcattattctcactttgatggttttaggctaatttgacttggtaaagcaaagattacataaaaagttcagattgtggctgaaacacaggcatgtccttcaatctgtaaaagataaaggcaattaaaaaatgaactgtaaatgaagacatatttttgctaaatgttggaataattgttaaaaataattattttgctttataaacatatatttccaggagggctgtcaaaggcactgtggttaggatacatacacttattttttaaaaagttaaagatctgtttttcttataaaactgttcatcccttttgtgcttgacacatgctaccagagatacaaagtagatggaaaggaatcatgccctctcagagtcacgatccagcaaagaacctgaaaatgacaatctgacacccaagtccaagctcttaactactattttacactgattctcagaattgcttggaagattaaataagatgataataagagtgcatcataaccttatggccaaatagaataccattcactaataaagcaaatgttctgtacatttccttccatatctatatcaaattattcatcaagaacatcaaaatgctattatccatccacaactaatatttacaaccaacattttagtaagttaattttaggtaaattaattgaaacacggcctgtatatatattttatgtgaaagtattaatagtgaagtcagaaacgttgcatgagtgtctctccttagctttttatacctattctgtggaaagataatttaaagaaggtgaaatagcccttgcaaatgatagctggctggctgactcactgctatgacttgctttggtagctgctgcttctgtcttgcctgtgttttagggggaaaatatacctggcaaattcctctaatgtgcattgcaccatacttggagaaaatgaaatcttcacataatgtcaaagaaaaaaccagcatcacacagcctttttgtacaattagggataattctacctaagtggaagaagggaagggcaaaatagaacattcagcaggtcatctctccaggaagtgtttaatactgaggcgttttgggtgttcgtgttgtgctttaagctgttaccatctctcaagcctccctacttatttattataaacatttaaagctgagacctttacaaaaggccaaaattaacagtgagtgcattcacacaatgaaaatgtatttgaatgagatttctctgctgttagatggatcgtcagtggcattgtctcaaaggatatttgtgcttctctccttgtcgtttggctttgacaatcagaatgatgaagattcctgtagtagaagtgtgcatgtaaatggaatttttttaacctattttatgaacacttcctgagtccctactgtggactggatgtgcatgttcttgaagaactcataatctagcagaagatgtaaataaataaatctatagagtaggatgtgatgaaatgttggagagaagggtgtttatttgccctggggaccctaaacaggttgtggctaactccgcctggaggatttaggggagtaataatgaataaaacattcattatcttattcaatctgtattgaaatggataaaacatttattgtcttattcaatctttattgattgcttcagtgtatgccatgcactgtatttggtgctaggaacacatgggtgacaagacagcgttgtgaagaactgcaaaagatctgaggtttctaccctccttgccagccaatgagcttaaggctttctctccgtctgagaaaccatcaatagtcgatgttcccttcctcttcctgcttgctaatactccccagagcaattctaccactgtttgaactagccactgaataggaggacactgacaactttgggtggcagctttccagttcttcagaaactattaaactggcaacagagaagaagcggagcttgctgggactaggcctgcaggtttgaaagttgcttcagcagcagagcaccagcatctgagctcccttttttggctgcatgtcggccctgggatgacagtacagtagtgacatgagaaagagatctattagcaagagactcagctgcttctgaagaggtgggctttcctaccaagtgaatattcttttgatggcaagcctactacaatgcgctcactgtggaactaacctaaggacattcaagaatacttcagatgtcctaaaatgtgagaatgtactgctgagccaaataagacattcctgatgtgttggattttggaacttagtttgatttaggacaaaagaccaggaggcatatctctctacatttttctagcatctgtgacattgaagacagaagaaatgttaaatttgtttgattgttaaagacaaaactaacatgtgtcaaagacaatgtcataatttattttgtttattctgggataactttctagagtaatgtgtatcagattagtaatggggtcttgatgggaggcattgttgttcatagcgactctgaaagaccacatgcagcaaggtattgggatgcttagaagatttgccaagtattcagggtgaagtagcaggtgcacaaatgggcaatcagggcacagccaggtcggcagagccagaattgtccctgccctgcttccatacctctaccaaccgtcacctgcaggctgcacacatttccatatgaagagtgattcctgactcttgaggaaacataaaaggtgttgtaactgagataaaatttgcttcagcttaaagaattccttctattatttcctgtgacttgcattttattttttatttcctttgacttgtgtgacatgtaggatccttctctcctgagatctctcttgactgtaaactaattacccattgtgacatgaaaacaaaatatgcttcaaatttccaagaactgtggatcttaaagagagtcattgtttgttcagtggagatgaggggtttgaagatgtaattggaagaggtaagcttttgtgtatgaggaaaggaaatataaagacattggggaagatctgggagaaggagaactgctggggtggaggaagaagaaataagaaaaacctggttgctgaggtgaagaagacatttgggagaaaaaggaatacatgtagagaagattccttctccacgccccagtaaagtcttcccacataatatgtaaagtcaacccttttccttgcaacttcatgaaatcttcaggaagatagtggttcctcattcatctattgagaagtcagagctatttattccctgcttttcctaccagaagttccatgagggcaggaggacagcctgctttgttctctgctttaccccggcaccaaggacagtgcttggtagagtggatatccagaaaatacttcaacaaatagatgacttacttatttacaaataaatgcttttgtttacaaataaatgcttttatttttgtgattgtgttgaacaaaaagatttttcttcacatatcatcctgcttcaaataatacctatttctagaatgattttttacctttcctaatgataaaaaatatataaattatttgatattttaaaaatacacaataatgtgaggcaagaaagcacccacaatatcatcgatgttaggaaacttaattcttttatgtagtctttcttgtcttctttgcatacaccatttttatacagcgtcatttctggctggtgttttaaggcaaaatggatatattgaggtcacagagccattggaacaactgaaggaagagattttaagactggccttttggaaataactttaaggcaaaatagatataatgaggtcacagagccattggaacaactgaaggaagagatttcaagatagcttttggaaataacttcacatttatcctgttctctttccaagttgcattcataaaacttagattgtacatagggcattgctcgcaagggagtatgggaatgtagtttttaaggcaccaaaccttttcttgtgtatttttgtagttttcttttgtctggacctctctttctgcagctggctctacaactaacctattgacatatttcaaatctgagttcaaaagtcaactctgatgagacgagagactttatctgctcactgactcacagcttacctctcccacttactctaccttattacccagtttattttctttgtagcattagtggcaatctgtaattatttatttatgtctcttggctgtctccactactagaatgtaagctccataaaagcaagaactttgtctttcaatactgtatcctcagtacctaacattttgccagggctttatgtattttatacacatttgtaatacgatcaattcaccaaaagttgtacatttagtttctttccagtttactataaacactgcatgatgagcatctttacataaaaatatttgtctacgtttctgatcatttccataagatagactggtaggagttattgaattggtaggtatggaacatcttatctcttatatttgccaaactgctttataagaatatggttctatttactttcctgccagcaaagtgtgagcttccattttatcacatcatcactggaattgaatattttcatatttaaatatttgctaatttttctcactaaagcttagagggtgtgttttctgataaatattaagttttattatattatggatatttatgcttggtcatatttttgaaataaaatttacattgttttattctatgttagaagtcttacatttatatgtagtcaaatcaattgattttttatttgtgatttctgtcattattaagaaagtttttgtccagagctcagatgaatattccatatttggttctttgatgttttcaatatttcaactctttgagaaactttttaaatcaaatttattgtaataaactgtattttaaggttttttaaaaaattctctcctttcccaaacttgaaactggctcccgttagtaaagaacattggctcatattaatagaaaacattgactaaggaaccaaacataaatcacaaacaaaaaagaaaagaaaagtaaagctttcatatctgtcatattagtccattttcatgctgctgataaagacatacccaagaccgggcaatttacaaaagaaagaggtttaatggacttatagttccgcatggctggggaggcctcacaatcatggtggaaggcaaggaggagcaagtcacatcttacgtggatggtggcaggcaaagagagttgttcatggaaactcccattttttaaaccatcagatctcatgagactcattcacgatcatcagaatagcacaggaaagacctgcccccataattcaatcacctctcactaggttcctgccatgacacctgggaattgtgggaattacaattcaagatgagatttgggtggggacacagccaaaccatatagtcttttatatctgtttattcttataccagcattaagcaactctgaaaatcacattcaaacattcatccctcattttaattttatttacaaacataaattaatattctacccaggttctaaattgaataataccattggacccggtttacttagcacatgttgtgattgtttcaatattaaccgatattcaatatcattattattattggatgataaggtttgtacatggacctaatttcagatttgaaactgatcatagtgacttcccaaagcaaaaatgaatggggaaattttggttttagtgatgcacaaagccagtcatcctccgtgtctgattccagagtgaacagaaatgacttcccatagtccctttaaagttttaacctatcaaataaagtcctttagtctaatctccttgaaaaacaccatttttcaagtttcctgttattaacttcatgtcagaattcaaatccccaatgttttaaagaatgtcattggttactataacaattaacttaattcaacagagtgccttcctagacatgaattatgcagtgatcttgaaagaacaaaagatagtacaaaaaagaaatccaatttctcttttttttctttaggagtactagctttaattaatttatcttttactttcagcttttattttagatataggtggtacatgtgtaggattgttacatgggtatattggacccaggttgtgaacctagtacctaataggtagtttgtaaaccagtgctcccttcctccatcccctcctctagtagtcctcagcatctattgtatctatgtttatgttcatgtgtattccatgtttagcttccacttgtaagtgagaacatgtggtatttggcttactcttcctgtattaattcacttaggattatggcctccagtttcatccatgttgctgcaaagaacatgatttcattcttttttatggttgtgtagtattctatgctatatatgtaccatattttcttgatccaatccaccattgatgggtatgtaggttgattccgtgtttttgctattgtgaatagaacagcagtgaacatctgaatgcaatataatgatctatattcctttggatatatacctagtaatgggattgctaggtcaaatggtagctctgttttaagttctttgagaaatctccaaactgatttctaaagtagttgaactaatttacattcccacgaacagtgtacgagttctctttttcctgccagccttgccagcatctgttgttttttgactttttaataatagctattttgactggtgtgagatggtatctcattgtggttttgatttgcattttgatgatgattagtgatgagcattttttcatatgtttgttgatcacatatatatcttcttttgagaagtgtctgttcatgtcttttgcccactttttaatggggttatttgttttttgcttgttaatttgtttaagtttcctatagattctcgatatgagacctttgttggacacataatttgtgaatattttctcccattctgtatgttgtctgtttagtctgttgatgatttcttttgctgtgcagaagaagctctttagtttaattagatctcacttgtcaatttttgtttttgttgcaattgcttttagggagttggccataaatcctttaccaagcttgatgtcgatgaggatatttcctagattttcttctaggaactttatagtttgaggtcttacattcaattttcctaatttattgttttctttcttagaataatcattctcttctactccaatttgaaaaaaaagaaaacttcaggagtagaaagagagatgactttaatttgcagaaagtatgggttcacctatttaggccttatcaatgagaactcttaaagaaacagcctttgagtatacagtactgtggcacacacccctaaggaaccttctatgagtcatgaccttgtataattcctttttcttgagtggaacctgagacttgcctttagccactacaatatgacaaaagtgatagaatgtcactccagtgattttgttaacttatacacaaaggtgaaaggatttttgcagaatcattaagtccctagccttttgttttgagctaatcaaaagagaaattttactgggtggggttgacctaatcaggtaagccctttaaaggaaaagccaggccttccctggagttagagcttcaaagcagcagagactctcgccctcctttcctggctttgaagaagcaagtttccatacatcctatagccacaaggaaatgaattccacaaacaacctgtggttgctgggaggtaaagtctaccccgttcaagtctccagatgagaatgcagccagacatgcaccttcatgtcagcctcctgagtggaatacccacctaagttgtgcccagactcctgatctgcagagctgtgagatcatgagtagatgttactttaaacatcttgtttgtggtcatttgttatgctgcactggaaaatgaaaaccagaagtctccttgatggcatcagctaagggaggaagaattccttctctcagacataccaaaatgtgcaatttccttttcagtctgcagattaatttgaatgttgtcattctaatttgaaataatacccctctgacaaatagtagcagttactcctgtggattttgtgtttctttgtaattcgactactcgtcctattttttctatcctcatttaagtcattttacttccaagctcagatggatatccctcttccacttgcctttgtgtttgatgatctgatctcttcttctgcatgttatttctactttgcctttgctgggttatttctgtatttcttcctcacttctcgcttatttctatttttattcccattctgggtccactcgtgcttctcctcaggccactcaccatccaggaaatttctgtctccacgtctcttctaagatttacctgtacttaagaatttccattttctgaatgatgtttcaaatttagaaatgtggatttaggtctatttgctttgtaagatttatgtttcacaaatttatttattttccttgagaattagtgaacaaatggttaggtaaccttgagtggacatgaagcttttcatcggaattggatacagattgtatttaaacacctcatcaaagatttaggactgtgggattgtcattcataggttgtgagtgagcacaaggacccttcccatggggtggttgaccttttgttttgagagccagagtgctgcaaggaaatgtagttattctttgactggaagatgtcttttctgttctgaatgttctgaggtatgtggattcttatctataattaccttcccttaagtcaatctgcatgctaaagcctcccccaggtcctgcatctgtgcctcattctttgaagctgggattcagaatatattataacagaataaattataaagattgcttgggtgtttcctgtaccaggacatagcagtggtttggtgtcctgcccatttgtgtggcaggaaattcttttgtttgtgctggtgaatcgttttgtctggggcttctttctttgctaaaaatcttgcattctttcatttggcaagcattttgtcaacaactttaacttgcaagaactatgggtccacctatttaggcattatcgatgagaacttctaaaggaacagcctttgagtgtacagtactatggcacacacccctaaggaaccctctatgagtaatgggtttgtataattcctttttcttcagtggaacctaggacttgcctgatattccagagagtgtgaagagggatatttaaaaataaaaatgaaaaagtgttgcccccatagtatgtaacaaatgcctctcaggtgtgacagatgtgagttatactgtgaaggtgatattgatgagtctgggtaggtgtgcaactgcttatggcataaggcaggtacacagtaagaccagtaagactaaatgagaattactgggtatggagcttggggatccaataagcctcccaagtgattcctgtgtacactgaaatttaagaaaattattacatggtgccaaaattttgttgttgatcatgatgatcattggaagacaaaataccaaaaattttatccaacgtattatgtctttaagagaatgttataattttaaaagagaaattatatactccttaaaatcattttcattaatcaaaattacttatggctagaattcctctgcctttataatgctcttgcacttctaagtctaaagcctttaaaatggtcagtaattattatacttcaaattaatgaagaaccattgaccccatgaaatcaagttctgaaattgaccaacaagtaatgaattgttaacgaggatgtattattcacatctgcagtaattattttgcaccaatattctagatttaagtgatcttggaaaatatcatacatgtgatactcctgatctcaaagaacaacttagtaatgtataattatttttatttttctgcaataactgagaatgaagtgcatatttaaataaatatttatatagtatttgtttattcaatgtgaatttcatcatataaagttaatgccctaaatttaatatcttttgcattattgtggcaattgtgatagttaacacatctgtaaacacaaacacatgttctgtgtttccatttgatgacctataaatgaagacacattctaaagtgagacaaaataactatatcctaaatattctatcctaaacgtccccatattcttgcattgtatgaagaagtgtgttggctggtgtatgctaatttaatagttagatataatttggttgcttgatggaagataaagggaaacttgcagtttgaaagcagtcagaatgttaacatctgttaaaaatttgctaagtttcatcactgaaattgccatgacttagtactttagagggaataattatctcccttggaaaaaactaatcactttagaagtgcataaacacttctaagtcacaaaggtgctgtttcatgaatgacatcaaattattattattttttttggttaggaatcagttttaggagctaatttatttcctaaagtctctcatttcttctttaatgtcatttgtgtagtgagagatattaacaagctactctacaaatgatgagaaatataaaaacaaattaattgtatctattaataaccgtatctgttaatattatgaaatttccatatttctccccctagctgttgtcaacatcacatctatttattgtctgaatttcaatttctttgttatccctcatatatgaaagtttaaccttgaacctgaaatgaccactaaatatactgccttaaaaactggaatacacatgggtgtggtatgtgtgtaccctcacttattccaacttagatgccttccattccttctatccacctttgctcctgaggtcccaggctaggggaatttgggttgtactaataagcactttaatattggccaccagagggctcccatattccttccatctaagtatgaaaatacaaagtgcaactaacataaagttcaccatcaaatagaaaatattataggaatttatgatatagttctctctagagtgaaagtgttccaaacccattgtgttcttatataaaatacttacaatgaaccaatttgggatactcaacactttcattaaaataaagttatgaaattatgtttggttttgtctttgttttgggaggttatgataagacttataatacttaattggtgattccacattttaaatattaatgttagtaaatctggatgtaaatccattatttacatatgaatgatgtaaaatacaactgattctagtcataggagtacaattttttatcacaagctagctatataaataatcctctattaaaaccccgggtatttttttttttagcccagcattttgatggtacacaaaactttagacaacaagatggtagggtttctttaagtgtgtgttggtagtaagaaatagttccattggagaaaaacaaagaattgcttcgttggtgagtctttccactagttcttgttgggttgtgttagccgagaaccatttgcagttactgagacatgctgggatacctctcagggttttagaagcagcaaaggtatctgccatttttttttctttttctttcattgatggtaatttgtttggttttgtactgaccaggtgctgaccaaagtatttatgtatgcagacatatttctgctgtgcagtagagggtagggttagccaatagtgaaactgttgtaattgacagcggaacagactttgaagtttctttaggaactctttgaatctaggtgaaacatttcatatgagtcatcagattgatcttctctgcgatgtactttaaaaattacaattcatttatcatcagtaaccgaaaatggcatttaaccattctacctttttcaattgcttttcttctagaacacattacttatatttctgcacttaaatgtgcatcaaagaggatagcaacatggaaggcctgattaactaactcaattatacacccacacctagatgctgtctttttgactgtgagactgcaatgttgtgttgcagaagaaaataaaacaatctgttcccctttttttatccattatgttattctggtctgagaattattgattgtactttttctttagaaaaagagaataaaaatgagctaattttggtgcaccttgtatttattgaaatagttttaaagcagtgttttgaattatgttttgatatgtgtttttaaaacggtttttctgaaagcaggctttctttgtttaaatcctcctctgtcccatcctttgctttcttttcatgagacaattgtgattaaaaagcactctaatctctagggttagattatcatgtctaaatgaaatgcggttataaaactatctttgtatacaatctattttggaaatttgaatagttttattcagaatcacatagtaacaaatccagtccagtttgtcctgatgattcagtgggattttgatctgataatgttcaccaggcatttgcattcaatttctgctcaaggaaatccacaatatcgcaactagtaattgactgcattttaaaaatatgcacaagcaaaagaaaaggtagaaaaaatgcaacaaccaattttgatagtgactggatattatcatagcccaaaagctaactgtattatgttcctcttagaagtctttgaattaacaagcaaggcaaattttcagggttagatagattttattcaggaacatctttgttaattatcatattatttctaagtttatactgtctaggaataaaaaatacctggaaatgttttaattagtatgttcacacacttccatgtaaactgatttgggttcctaagtttcctgaataattgctctaattttgaaattcagcattcttagataccactccaattgtatgtatttaccacttagagagaaagtttattcctatctagcttgtgtgaaatcaaattggcagagaatgaactttggcttaaaagcttctcctgacatttatttgcaaaggtttctatggctaatattcttgcactcaaggtgacattaagcttccttggtcactagggagaaatgtggcttttctcttcactgattctgggtatgagaagaaaagaatgacttgaggatatgccaacctcaccttgcttctgtctgcccctagctatattttatatttacatttcaggcaagagaccaaaaaactgaattcccaacacagagagacagtggcgagcgagaggacctgcatcacccagctcttaaatcctacatcagtacctatgcctaaagccaccaatgatatccagagaccttcctatctgaagctattgatgtttatttttttcaagactttaagacctctcaaaaaataaaatataaaatttaacttagaatactggtgcttaattgtgactgcacgttacgctcatctaggggtgctctttaattcctaatactcaggttgcatcactgaccaattaatcagaatgactgggattcaaccagacctcagtagttttgtaagctctctctcatgactgtgactacactatgggttgagaagcactcaaagtttgagaaccactgtcttgtaaaccaggaccactaaatgatatcataatcctacatcctgacatatgtaaaggataaggatcttagactgcaaatccagatgttcaagaaatacaggttgattatgagttgtgtggtccaaattctgtaattcagccagtgtggtggagggttaatcttggccaattcagggttcttcctttccataagaatgcaagtgaattacaatgggttcagagagtgctacattatttgggggtagggctggagaggactctgtcctgggtggctacttacctgtgccagccttgctgaaatgtgcaccaaggcatctgtccacagtggatcagtggtggctcaagtccccacagcactgccccttcaccccaccaataggccattttctttcccccatgccatgttatggcatgacgtgagctggtgtgtacctgccgtgaagtgtccctcaaaattttttcctcttcggtcttctccacacttgagaaaatgactacatgtttgttgtttctcagagatttgacctcagatgaaaatgttaagaaaggaaccaatcattaaactgagactcctggtcagtacaaccgatgtttcctcttctttttaaagcaaaagcttgtaaattccttttttcaattataaggaaccataaaatcatgcatttttgtcctgaaggaacttttttagtatgcaataatttgattaaaaataatcactaaaaagtatattaccatcaatcgttatgttaagatacataatacatgaagtgttcatatacatacattgttatgttgctggataaatctaattcatctctgttttcccaaggtacttttgtcatctgtccaaacagttaagagtcacgtttaaaatggtatcaactgatacctactccagagtatttatcttaatctaatcagtgttattgctcctgtcattcagaatcttcttaattattgatttggattaattacctggtgaacatttaaagccaattcaaggggagaaaaagaacagtatattgattagcaccattactgaggatatcatttcagtttgtcttagacagggatcccccaggtatgtataatattggccttgagaaaatgtaattctgccatacaaagtctaattcaaatataatggcatttatgtttttatcaatgtaacaataatttacattaattacattcttactatgtgttggagaccatattagtacattgtaaaccctgtcttgcttaatccaataatctcatggggatatttactattttatctccatttacagttgaggaaactgctcaaatcacttttccaattactcagctagttaccacagttaggacttgcactatgtttttagctattatacttagacatacaagttgaaggcagttcttgatgttttaaagtaattgttgtaaagacagatacatgcacacccacatgcagaaaatactcctttttctaatagatactaaactttaaaaataaagtcagtggtacgcattaaaaatacgtatgttcaaatccgtaatggaatatcaaggggagcctggaaatattttgaaaataaacctttttgggggtgatgtgagagacagtacccgggcctctgcaaaaatgtttttgatatgagaatactgcactaagggcaccatagtctaccccagggctgcctgatacagctatatgcagtgatgaaaatgttcttcatttgcaatgcccagtatggttgtctattgagcacttgaaataagcgtagtgcaaattaaaaactgaatttttaatttttaaaatcttaattaggttaaatctaagtagtcatatgtggctattggctacggtactgccaagtgcaggctaatctgcacttactctgcttctttctctctctccctttactcccaccactccttccttcctgcctgtctgcctgcctgcctgcctgtcttcccttcttcctgctttccaataaagagaataaatataaagtttggatcagacaaataaaattcgctttttaataatctgagtaaatgcatgcgtttttccttcttaaatgcaaacagtaaataacaacacctacttatatcattatttttaggactaatgagacaataacagatcctgattatggtaattttttagagctaattagataatatatgtaaagcatcaagtagacttcctgctataaatgatgatccattggtgatgataatgattatgatgatggtgatactgacactaatgctgtattcatttagcaaatgggatagaaggaggtccccatttctacatcagtgtctcatgtggtaaaaagattcagatatttactcattgatgtagtaatatatttcctgtcaataaagccatgtgtgtatatagtgatttattagtatggggtaactgctcatgtttgagcatgtcgacatgctttttgagtttagggttgaaatattagccttgtgttactagtaataaaacgaaaatccagtgagagggatttgctgcagatcacatagaatttgtactcaagttcctgtcttcttttccatctacttctctttctgtgttatcatagttcccataaaaaaataatatgaaagactctaagattcaatgaaaaacataaattttgtgggatttcttcataactttttgacacaaaataaataagatgttagaatcagtggttgagtacgatcaaaactccagatgaaattattttttgcatctctttttttaaccaattattagcagtgctttttagagagcagcatttattttgtttaaccttgcaatgagagagtttcaggcccagttttttaaatgagtgtgatagtagccaatgatagagaaaaatccagtattcctagggaataaaaattgaagaagtaatcatctggccttggaagtatgtatcagcatggccaagtcatgtatcagcttccatctttcactgttgccatagttccatggaggtgatggaatccaatcatgttcttttaaaggataaccactgctctgttcagggcaccctgctcactccgtggggaatgctggaaggatgtgggaccctgcaaggctgcctcgctggaaccaagggatttagcaaatgctaggaaagaaaagcaagtttaagctgggaatgcaagtcatttgctgagacggcaaaacaagaagagagaagccagaggattgctggccatcacaaagccaaggggcctaaaggaggtggaaatgcagcatactagaggccagatgtgcttccactcaaacccattggtggcaagggcctgagaaggaagtggtaatgagtcacaagcaggatgatacagtattaacccacatcctttagaaggcttgaacatcgtccttttgtagctgattcctgtcttagatcagaatgccgactgagagacaggattttgacagaaataaaataataaagggttaccaagtgaaagagtgataaaaagtgctggaatggaaaactatgtagtacatttacaaactctgggtcgattcgaaagaacagaactttgctaatgtaagagctgtgtttggggcatagattctgagataatattggaaagttattcctcatccttttattcactcattatttcacttcttcattcatttccaagcatttttctagaagcaagggacatagcaacagatacaactgacgaaaatctctgcttacatgcatctttcattgtaatatgggaaacagacaataagtgagaaaataagtaaaaaataaagtaggttagatggtgataaatactacagaaaaattacatgggagggaggatcagggatttttgggccgatgagaagcaattttaaattgggttgccagggaaggcctgcaaatccaaaggacctcacttttgtatccagggaacaagacagagaccagtgtgcctggatctggaccgaagggaatgagaagggagggtgggaggagatgacgtcagaggagtgatgggtggggacagaagatgccatggagtctcattgaaccagctcgaagacctggacagaagaggattgcttctccatcctggcagcatggagaaggccttgttccctgtgtgattcccacaggagtgccgaagagcatcctgcccctttcctgatgtatccatttacaatccgcacaagtaaaattgcaacagctgtccctctggactagttcttttcctttctttctttttccttacctttccttttcttgcttttttttttctttttgtcttcagcaacagaaattcattttctcatagtcctggaggctcaggttcaagatcaagatgctgttaggattggctctaggtgaggcatctctccttggctaacagacaccaccttctgctgtgacggcaacatggtctttatgctcacggtgggagagaaagagagagggaggaagagggagagagagaagagagcaaagagaagagaaagagattgagtgctctggtgtcttcctattcttataaaaacaccagctctatgagatcagggccccatccttatgatgtcatttaactttaattatctcctaaaaggccttgtctctacttacagtcacatgggaagtgaagacttcaacatacgaatgttggggggacacaatttggctcataatagtatatgaactaaagatgtagcattaaaaaatgtctatattatactaataaagaccttacagactagttactttgcatccacaaagctacactacaagaaggagaagaagaaagatactcttactattccctccctccattgggccagccctggaggttatgatttctgttattcttaacacatgtcatagagaaatttgagttcagctgtgaagagccatttaagccttttgagaagaaatataccttgatcagaaccgtgatttaggaagataaacatgaactgctttgtgggaggtaggaagattaggagaagggagacttatcaagtagattttagagtactctaagaaaaattcgatgtggctattatgtgggacattgacagaagtttcctcagtcagtacatatttactgagtgtctacaatgtgcctgtatctactgtaacacatttatacagttctaggtgccaggaacaagtcagggctctttgttatttgcctttgataaaaatgatgacaagtcagatttgaggagctttaaacccagacacaagaagacattgttttgatccaggcagacaagtgacaaagagcaagcgcagagagtaggaatggaataaagtcttggagttaggacaatgaagcaatatctacaaaggacaagccgttggttacatcgctgcaggcaaaataatgccaaatggacagacatctcaaaatgcattcctctctcgtccaaagatttcacctcagatcgctcagagatgttttttcttttatgcaagttaaaaatgcagacaaatggaaataatgctgctttatgaaaattcaatctttagctacctttattagcacatatctgttctatgaaacaaatgttatttgtccatcctagctccatttgtccttgaaataaatatttggccctagctcctggatttcttaggaaattcaatttattgctggacatgtttcagtaatctgtgaatgaccccaaattacctgttcataagagaaggccaggcctggatgacaaacacagaaggcttttcatttttcccatgacttccttttttggcaaaccatcctctttgtgagagtccgcctccaagttggattagaagatgtcctggagcgtgcagttcaccacccactatattgtaagctgaaagtgtttttgctaactgaatgtcaaattaatgaggttttgctatctacatggcatgttttgacaaaaatactgtgtacctttattgacagtgaaccttctgctctggagtaatgctaatccaagactgctggtttttcatgttaaaacccataaacttgttattagagcagatgacttccaaaacgtcaaaactaaagatgttgcttattcactagaggagtttatgttgttcacatttaagatgatttatttttattcacttgacaacacttcgaacttcaaatggatgcacacaagccaattcttggagggttgtgactgcagaaaaaaaattaaatcttgtgctcatgtgttgctccatcatagtaatcctcagttttgtcccagaagtagcatgtgtcacttccagtgattcaggaccagctggtagaaaggacggacatttcatgctgccatgagcaactgctgtgtggtccaggatgacttttccaaaagcttcactcactgctcctcagaccacgtctgtttttgtagaggcaaaatgagatggctgagagaattgtggactctggccaaatgagtagtcattccctggctgtaagtgggtgaaagagaggtgacagaaccatttttactgcagtgcagtgtgattaatctgtgtcttcttaatgagattaaggggaaaaacaaactttttttttaatttttttttttttttaactagctctcctctatactgcaagttaaacaacttattctggcagaaggttgaaagaagggaacaattgctcctttgctagaaattctcttcattaggagcatagcctttcaaaaaacaatgccactcatgatatgcttcagattctatataatcatctcatgttgcacttctcctaatttattttataaaagaagttcttttttggtgagagatagattgtaaaactcaatgtattcttattcttttttttttttgcaattattcctgaatacaaaacttaaaaaatgacaccagggctttatgtctagagtagactgtgaaaaaaatgaatacacatttatttgggaaagatattggtggtcattatgccaattgacatatagttgtcatcactgatgtaattttgcatttgtttgtgtaattatttaattaacatctgtttctcctactgtagtatcaggttcttttttagtgagagatagattgtaaaactcaatgtattcttattctttttttttttttgcaaatattcctgaataccaaaattaaaaaatgacactagggctttatatctagggtagactatgaaaaaaatgaatacacatttatttgggaaagatattggtggtcattacgccaactgacgtatagctgtcatcactgatgtaattttgcatttgtttgtgtaattatttaattaacatctgtttctcctactgtagtatcaggtatatgtagaggtaatcacagatgcatcggctcaacactgcttttggagggctgcacacaaccttggcacatggttggcactccatttgtatgtttgttggtgaaaggatgaatgaatacctataattgaaattttatgcaatttattttttatttttgtagtgcttgtccaagcttttttgagcacctctagctatagagaaaaagttttcttcataagggtgctcaatgtgttttcagaagttttggatattacaaagttttttcttttattgaactgatatatgttcatatatagactttaccatttaaaaataaaataattgtatggaaaaatgactgatattaagggacaaccttctttatgtaatttatgtcctgattaatggacttttcttgtttgggattcattccttttcattcaagcattgttcacaaaactggattagttgttaattacaaatggcctaaactattttaagaaagaattttattatggaaaaataagagtactataaaaaaagtcagttggggtcaccttgtctattgcaactaaaatagaattgactcagagctacattttcgtcacctccttttcctacctctttcttggcccccttattctggccttagattactctgcagaaacacaggcaccttgttttttttttttaatgtggaaaaaattaggtttctttttcttattcttccactattccagatgaattccgtgtctattttctaataaatgttaactattttgaagagaaatgcattactcccatagaaagaacaaatacttgcaatcagtgatgttttacacttactatttctattttaatttgtatttattataaaaataggggatatgtgcacacttgaaaacattctcgttgtgtaacattagagtattacagttaaaactgaagccctctttaagcagtaatacctctattattaagcatttaaatatatatgcatatatacatatatcattgtttttatgggttttgatatgtggtacctcaagactctcttctctctatttttccaaatcaatatcagtgaatcataaattttgcattttcatatatgttcatatatatttctgatatatgttgtttgtttttacttttgaaaaataacaaccctattttgattacttcacatcaagaagtctgtttcactcttacctttagattgttctgccttcaaatacaaacattttacttgaaactgtggcagtaagaactctggagccaaaggctagtttcttcttcttcttcttcttcttcttttttttttttttttaaatactttaagttctgggatacatatgcagaacgtgcaagtttgttacataggtatacacatgtcgtggtggtttgctgcacccatcaatccgtcatctacattaggtatttcttctaatgctatcccttccctagccccccaccccctgacaggccccggtgtgtgatgttctcctccccatgtccatgtattctcattgttcaactcccacttatgtttattgcagcactattcacaatagcaaagacttggagtcaacccaaatgcccatcaatgatagactggataaagaaaatgtggcacagatacaccatagaatagtatgcagccataaaaaaggatgagttcatgtccttttcagggacatggatgaagctggaaaccattattctcagcaaactaacacaggaatagaaagccaaaggctagtttctaggcgctcttttggtttgattttgaaatctgaaaaatcagcattgaagttatatgtgtgtgtgtgtgtgtgtgtgtgtgtatgtaagaaaagttcagtaaacacctttagcacccaaattaaacactagttagcatttttctataatatatttttatgtttattcatctataatgccatcatagatttatgtattatctgcttataattttttctgaattatttgataagttgcaggtatcatggcattctacccccaaatactccagcttgcatttactaaaaataagaacattttcttgtatcaacataatgccataatcacacccaagaaaaataataatttcttatataatatctaatttaaagtaacattttcctattatttccagaatatttttaaagctagataccttctttgattctatgccaacaaaaattcagacaccctagttatgtctctttagtctcttttttaaaaaatcacatctattaagataaaatttgacttcaatgaatcgcacccatttaaagtatacactttagtgcatattgcccatacatgcatgtttgattctaacttcatgatcaagatacaaaacaatatcatcatctccaaaatatttcctcatgtcccttgactattcatctctccttccatcagcccataggcaaccactgagctactttctgttgttaaaagttagtttgcatttcctataatgtaatataaaaggaatgttgtacattgtactcttctgtgtccaacatcttttgctctgcatgcttttgagattcatccatgctgttgcatatagtagtacatgtatggatatatcactatttccttcaccattcaactatggatggtcatttgagttgtttccatttgaggctatcatgaataaaactatgatgtatattcattcctaagttttcatgtaggcatgtgttttgtttctcttgagtaaatgcaataatacatttaattttagaagaaactgcgaaacagttttacataatcctcaacaatgtctgggagttctggttactctgtatctgtcaagacttgtttttttcagagttttaatttagccattctaataatgtgctcaactttcactgatatcaaatttcagttaaattttactagtatcaaatttcactgataagtatgttttgaatattttcatatggttattggccatttatacacattcatttggaaagtgaatgttcaaattttatcgtatttatttaggaatttgtcttctcattactcagaagaacatttatatattcttgataggaatcctttggcaggtatacgtattgcaagtaatttttcccattccatagcttgccttttacttttcttattgtatgctttgaaggtaaaatgtttatggttttgctaaaatccaatttgtagattattttttctttaatggctcatatgttttgtttgctatataagcaacctggtgttttcttcttggaaaatgttttattacaaagttattgtttttatataaaaatatatataggtttattaatatttaatggtttattaatatttttcttttttgtcagtttttatatttctgtctttcagtgaatttatccatttaatctaagttttcaatttattggcatagagctatttataatattgtcttattgcctttataatattcaaggaatctctagttgtgctcactctaatttagaatattgtaatttgtttattacttgtgtttttaacataaatgtttgtgtacattgttgtttataaatttcagtgatctttccaagaagtcagcttttggcctcattgatttttctctatagtttgtttttttatttcctttattttagcccttatatttattaatttatttgtgccatgttgtgttcttcttttcctagattcataaggagaactcttagatcattgatttttagcattttattttgttattattttgcttaaaatattttttaaatttatttgtgattccttattttacctatggtttagaaacaagttgtttgttctccacatactgaatgtatataatgaatgttctgtcaaagtcgttaagtagttcttaaaatgaaattaacagaagagggagctttgtaaaggtaaacaaggatttctgaacttcaaaattatggatcaagtaattttctataaaaataagcatagcaaaatatttaggcccaatcccatagtaagatattgtaagacaaaagagaatgagacaaataacatccctagaggtaataaaaactagtcaaataaaataaataaaaatatcaacttgtatttcaaaactagctaaatgacattaagaatataatgcaaaacatggaataacattataaaacagaattagaaaaactcaaaaattaggcactataccatagggaaaaatagaaatgaaagaaaataataatttcagaaatgaagactaaactagaaatatcaaaagaacaaataaacacatggataatgctttaagaaaaaccgaagttgaaagtagaaaaaaattgagaaagagaaatgcagaaagaaatacaaataatttgagagagaaattgaaacgtggaatatgaataaagaacttcttaaatatggttaataggcatctctaaagaaaaaaaaagcaagggaaagaactgatactaaaatctataattcagaaaaagtttctgcagtgagaaaaagatgaaaaagatttcaaactacgtgttgaaacagcataccaaatgccacattgaccagaattaaccaagaccaaaatatgttctaataaaactaccagattctaaagaaaaagaaagaaaaaataacaactgggcatccagaaagaacagtaagtgacactggaaaaagaaaactatgttagcatccctatttttggcaagtatagtttactccagaagaaaatgaggctacatagttcatgtggtttggctctgtgtcaccaccttgaattgtaatccccacgtgttgagggagaaacccagtgggaggtgattggatcacgggggtggtttccctcatgctgttctcatgatagtgagtgagctctcatgatatctgatggtttaaaagtggcacttctgcctttgctcgttttctcctgccgccataaaagacttgctttgcttccccttctgccatgatttaagtttcctgaagtccctgcagccgagtagaactgtgagtcaattaaacctccttcctttgtgaattacctagtctcaggtagttctttttggcagtgtgaaaacgaactaattcagcagttaagataatcaagaaaaaaataacttgtgagcccacaattttctatctaaaaaaatcaccttccagtataaaaggcgtagacaaactgttatctataaggaagaactcagggaatattgagtaatctaataaagaaacagcctaaaacaaccaaaatgcctagagagaagagacaggtggtacacattaaacactggtgggaagcattaaaaacatagttacttttgttgacaagtcttactttagtacgaagactagaacaagtcttagtgtagaactatgactaaatgcaggttaatgggggaaaagtatgaaatgtaattatatatagagagagagagagcgcgaggggagagagagagtagtgatggacaatcaaattacattttcactttaaagaaaataatatactatagtgatgtctactagtatcttataagtaagagtaattataataatattagcaattgccttgctgcttctgtgccaggcataattgggtgccatgtatcagggtgatccttttccccacccagggttttgcttagatggttctcccttaaaaatgcttttgccactgtcttctagtttcccagcccttcccttttggtggaaggcttccaaaaccaagactgaaagtcaagtttgtttatgctgatgtgtactctctggacatttttcttgtaatagaaatcagtgttattttattttacatcctgatattttatatattttatctaaatttgtttgaatatgtttggtaatttacatatgtagcctttagcttacaaaaaaattaacacacacattaaatcttcaattttatctaatctaatacactgatgagattttgattctttaggttggctattgacctaaaaacacatttttgggatatgtcgcatgtaagcagcaacagtttctaatgaaatcttcttggactgactatcaacttcaaattcttgaagggcaaaccacatttacttagtgtctggttgggtctagattcatcttaaaaaatcactaagaaaagtaaaatcatgttcgaaagtccatggaggtttcttgtctttctttctttgaactactagaggagctgtaatataggaagaaatattagaggatttttttttattttaaaaactttggaggcatacaggataaactttcaataatggctaagtttatgaaatttaactgaaatgtgtgtactatatatttagttgtaactgttgattttaaaaaaacgtatactagttggttctaatcagaaattgtcaatatttatgtaatgtaagtgactaaaagttatggaatacaaaaaagtaaacaattgtttacatgatatgttttcggggctctgatatttctgctgctgctccactgaattgcagtttaacttagctgtaacttaaagcttcagtttcagtttttgctaatcattaatattcattcacttattcagttcttaaatatttatccaggtcctgctacttttgtgggtgtgatattgtgctgttttaaagcaatactctggaaaggattaaaaagccattaacaatatagagtgaagtcaaggtcagtgagtaggattttgcagaattggaagtaagacatttgcactcgaaaacaggggtagttggtttctggaacacgctacacccgattacttcatagcgtatttttttggggggggggatttactttatttcttaagtagtttaggtattttattagtgattttgatttttcttgaaggttttattttttttattttgttatttattttgttatttatttatttatttatttatgttttttagacggagtctcgctctgtggctcaggctggggtgcagtggtgcgatcttgactcactgcaagctccgcctcccaaggttcatgccattctcctgcctcagcctcccaagtagctgggacaacaggcgcctgccacaggcctggctaattttttttatttttttggtagagacggggtttcaccatgttagccaggatggtctcgatttcctgacctcgtgatctgcccacctcggcctcccaaagtgctgggattacaggtgtgagccaccgcgcccggccagttttatactttttaatttactctccaatattcaagacatacaacatgcacatcttaaaataagttgtgtatctgtatttaaagaacgaatttttttcaagttatttcttagaagttatttatttgaagagattatttttaatcatatggttgctgttgaataaatttttaaaacaaaatatgtaaagaagtacacaaaatcattttcagtaattctctccttatccaagaaggcaagttctatcttaagaacctgcacagagtaaatattcagtacattatctatcaagtagtgtgttattcactgcaaattgaaaatcatcaaattcctaattgttctgcttaatagatgcttaactatattttagcagattccaaatatatgttaatatatatttttggaattcagcatgagtatctttagatgctaattgcaagttaatctttcttcctagaatgtaagttccatggattataaacgttattcctattgcagattttctaaatagtgtttctgctggtgaagtcttcttcactctctggtgcttaagattagaaagaaaaaaggaaagtaactgaacaaaagaaattctttgaacatgaaattatcaaatgaaactgtacatatgcaaaggaattttaaaccattgccttgcaaagtctttttttgcataacaacgttttgataaaatgaagagactgaccaaagtaacaactctaaataatagcatttcactgccataaggatgattgtaattatcagtggaagcctagagcattaggtcccaactcctaatattagtttcaatttttatagcctggttgttcaaagacatgcaattaaactaacctagtattattggaatagaaaataaagaactactgttggaaacacaattaacaatacataatagaggggccatatttccaatggctgcatattaaaatcaacattgagctaaactaagcataggccaaagctgaatatcatcatcataggacatacttctaggattacaagagtgtatctgaaagtgactaccactttaatgatattaattttatcattaaaaggttttatggtcaaatttcaaaatcatggcattgtaatgtagggtgaaagttcctcagcactgccatgtgattatttctgcaatgaacctgctgcacatttgccattctaaaaggacactgactttcaacttgtgtctctggaagagccagacccacctctgctagtatagcttactgctaatagtcatgctgcagtaacaacattatcaagcttttctccttctctcaaagaaaatgattcaggtaatgctttgcttcctttgcaacccagggattggacctactgtcttcaaacaaagctctgtgcagtgttggtagaaatggtttctgaatatttttagaagcagacttaaaactgtagcatgatttcttgtattttccacaaatgcacttgatgctttactcattcattgagatacgtaatccttcaagtctggatccttccctatatttgatgttaaataaatgttaaatgtattggttaaaactttttgattagaagttaagtgtaaatccaaacactaagttttgttcatattattcacattctgaaactcatttggtatgatattaaactttataacagagaagactttgcagcaggtaattgagtattatgatttccaatgctgaagtacaataaaagagtttggctaagcatcttggctaaggcctaacattagtgttttcctaatatgattcataaaacattcttttctaataaaaacaatctatttggctgctactttggacaccttgaaatcaaagaagattaaatattccattaataatgttaaattagtaaagtaggaaatggtccaattgttcaaatctttgcctattttccaagttaaaaaataagccactaaggcaacaaagaagaaataatcagagatagaaaggcattcagaaaatagtgtgtcagggaagacaaagatagtttttcaaagaaaaaataactggccaacagcatcataatcagcgcagtctaattaaacaaatatagactaccgttcttgtatccacagcacaaatgtcattgtcaacgttgaaaagaataggttcagggagtaatgacagcaaaagtttggaaggggagaaccattaatgggtggggaggaaggagaaacagcaggcataggctactctttccagaagcttgggttgggaaggaaaggataaaacaagaaataggtacgtaagtcttagaattgagaaaggttgctttcatgtttgcttttgttttttagaagaagaaataggtaggaatggttttaggttgagggcaacacactaaaagataagacaatttaaaagtgtaagagaaagatggatccaaatccaggaggaaatagaagaaggactccaagattcacatacaccagtaaggaatcaacaggcagtttcctgtttcctctaaaaatggaaagaccctggaaagggtcagtgcagaggttggacagtcacaactgacaggaccagtgagaagaaatcttagttcatgatggcctccatcttcctgatgaagcagaaaaaaaggcagcctgttagcactgaaaaggctgaagcttaggaagagggtgttaaatgttcataaaggtcaaaaagttgaaagaaggtgttggagggttttttaaggccgtaaagggcttattaagctgtgttgagtgctcagagaaatctggagaccatgattttcattccataaatctgcacataagtacaatttttttccagcagtaattattaatccaggtggagaggagagattgtgaaattaacccagggtaaaataaaacagtgtaacataagatgttctggtggtgctacagcaaggagagatggagcatttgtcaaagatgattgtgaccaccatgcttatggccttcattctgtagctttgtttgtcatattcctcttgtcttcacagtatcttcgtcagaagcatcattgcttttactccacttgggattggctttccataattgaccccagaaagaggcttttctttctctgctgtcattggcccttagctgcattatgctcaatatatctacgtggtgataatgccctattaaaggtgaatcttcacagatgatattttaggaatcttaagtatgtttttattaactcaaaaaaaagagcaaactttcacctactccagcagaagactaggaaaagtgtactctgatgttacccagacattaccttttgatgaggcttcacccactctttcagagctccaggaggctgtgttcttctgggagtgcttggagttaatgctagaccttatagttagagaatatgatgttagctggcagagacatcctggtcaaattattttagtttaaactttcaacctctctcaaaacatctttgaatccctattaaattcatgaccagacagttttctaaaattcctctgacttgagaatctaggctgactcaaagcttgcccttgtgaaaactttatctaaacttaatctaggttcagactccttccttaaggataagttgagagttcatatatcagaactgaaaacatgttgaagctaattgacataatcttcacaaacaacaacaatgacaataacaataacaacttgttcggagatattcttaagctcttcaaagatgatttgattccaaaaacttttgcgaagagtctgaaaaaaatttttccttgcaaaattttgcaattcgaatctcttcttcataatcattcttaaaagtccaagtgaaaagttctcatatggctgttaggaactataagttgaatattgataattggcttaatttgtgttgaaatagagtttttaaagtatatttctcatggttagttctgtactttagcttttgaaatagattttgtgtttgatcctcaatttattctctttaccttaaatatgaatatctggggaaggttggtggcccttttctatctttttttttaaattatactttaagttttagggtacatgtgcacattgtgcaggttagttacatatgtatacatgagataccatctcacaccagttagaatggcccttttcttttaaaaggactctgcgtggcaaataatcaaaagactaggctatacttgtttcttctaaaaacagtatttgtaccctatccctccctgaagtcaggcttactaatagaacaaattgtatttttatttttaacttctagacgctttcagtttccagaagaggaaatataaaaaacaacaactattttcaccagagtgactaatacaggaaagattatttagcataatttctaaacatatataattgtaaaataaataaccatgagggcacgcattttcttgaaagcattattgagaagaggcaaaattgagagcaattgttgaagctgagtagtattgtagaaaagagaagaccatggatattaagattgagtataactttatgatttgaggcaagtcagttggtctccctgttctaaatgttggctttctcattctcaactcataagttgtggtcaataattcattgtgctaataaatttgaggacctaggtacaatatgtattcctttcttaccctcaggatttttaatctgcctcataaagacttctgagtaaattgatgcaagacttctattatttccctatggttgtctcactagtaaataatacctttcaatacagaagatgatttctggtcaaattaatttactataatctcatattaataattatttccagaaaatatctggagcagatgtcactgggagcatatttaagaaatgaatggcatttaaaggtttaatttaaactgatcacatttaataaacttttaatacatagatattctttgcttatctctactttgagaaggatgcttttgtctgtgatgaaaacttatctacattttaaaataaaccatttcctaaacctgttctagcacccagtgtttctattccccattggataaaacgtatgtaagcatatagaggtgacaaggttaaagtcgtaccttctctaacattcaataatcagtctcctgagacatgtgaaattcatcatattctaatcaacttgtatattatcagccctgaaacacaaatattatatcagctctgactgcctcaaaccacatcttagcagtcagagactggctctccaggctattccatctcatttgagaagaaaaccaagaaccaaaacaaattttggtcaagtaacttaggaaatatttaaaatggaatacatatttccagtaacaaatggatgatattaaaataattttatatgaaacttaatctttagaaaaatataacatttcaaaggaaggctttgaactcagtcatgaagtctgatgatatgtggcaattttgggatgctgttgctcactgtggccttggaaaaggtcaaattaaaatgaaagtgtacattttaaatgacagtttgtttcacttagcatagagcagtatggtaccttcactaaacttcctagattcaaggttgattcaatcatcttaacaaaactaaattattaatttaaaaacacacatttttcatgtaaagcagagggttccctcttatttcccagagaattaaaattgtcatgtggatcacaatgtattaaattgctttgatcaactcccagtcatttttaccttagaatgaactttacaggtagtctatatctttagctttgtttaatggattctaagattgtttgcatgaagatccactgagttttagtcattatgattgacaggtggtcagttgcagcttaatcaacttaaagaattatacaataatttcatgaagaactgttaatcctatgtcaaactttggttacatagattaaaaactatgtttggatcatgctttaaagtctcacactaattaaagcttattaataatgtctatgcacacatacatcataattttatcagtattaggataaataagttatttgtaagagtcatttgaaggataattataatttcatgtatgtaaaacaggtttttgaccgagactcaagttttaaaatttatattggtgtaactaaggaaatgtatagtaggaaaataggatttgtagagacaagaactagatccatattctacttttgctatttatcagtggtgtgcccataagcaaatagttctaaagaagatgaattcttagttctaaagaaggaaacagtttactggggttggggggccgtgtaaagagatgataacagactagaagtaatgaatatgaggaggcatactggggggtctagaaaagtttcctctcccatttgagggttaagaaggctttcaaatagtaaacaaaaaggaagaaacactggcttacagttgttggtagaaatgaaaattgcttataaccattttaaagaactataaggccatatctatgaaacttatgaagattggattttttaaatttacctttagaaattcatttttgaaaaacataacacgaacataataaacaaaactccagaaaaaaaatcagcacctgaaagatctcaccatagaactataaattatgaacaatttttattttacaaaattaaaaagaaagtgtttcattctaataagctaatggatatgttaacttcctggaaataagagctcaaaggagaaatgtcaggcatgtaagggaaaattacatgagagcagagataagttcttttttaaaaggatttaagaaatacttacatagtgtttattatgtgacaaacactcttaagcagtttatagttattattttacatagaaattctgtaatgcaaatactaccattttctcattttacagatgaatattctgtgatatataaagaggttaaataacttgctcaagttcacacagcaaatccatgtagtggagctttaccatcagtggtacggttgcggagtgtgtgactttgagatttatgctgtgctgcttcttttttttttttttttttttttttttaagttttagggtacatgtgcacaacgtgcaggttagttacatatgtatacatctgctgtgttggtgtgctgcacccattaactcgtcatttagcattaggtatatctcctgatgctatccctcccccctccccccactccacaacaggccccagtgtgtgatgttccccttcctgtgtccgtgtgttctcattgttcaattcccacctgtgagtgagaacatgtggtgtttggttttttatccttgtgatagcttgctgagaatgatggtttccagcttcatccatgtccctacaaaggacatgaactcatcatttttatggctgcatagtattcccatggtgtatatgtgccacatttttttaattcagtctataattgttggacatttgggttggttccaagtctttgctattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacagcaaatgttgctgcctgatcgttcctctggaagttttgtctcagaggagtacctggccgtgtgaggtgtcagtctgcccctactaggggggtgcctcccagctaggctcctcgggggtcagggacccacttgaggaggcagtctgtctgttctcagttgtccagctgcatgctgggagaaccactactctcttcaaagctatcagacagggacatttaagtctgcagaggattctgctgccttttgtttggctatgccccgcccccagaggtggagtctacagagacaggcaggcctccttgagctgcggtgggctccacccagttcaagcttcctggccgctttgtttaccttctcaagcctcggcaatggcgggcacccctccccgagccttgctgctgccttgcagtttgatctcagactgctgtgctagcaatgagcaaggctccatggtcataggaccctccaagtcaggcgcgagatataatctcctggtgtgccgtttgctaagaccattggaaaagcgcagtgttaggaaaagtgacccgattttccaggtgctgtcttttatccctttctttgactaggaaagggaattccctgaccccttgtgcttcccgggtgaggcgattcctcaccctgcttcagctcacactcggtgcgctgcacccactgtcctgcacccactttccaacacccctcagtgagatgaacccggtacctcagttggaaatgcaaaaatcgcccatcttctgcgtcgctcacactgggagctgtagactggagctgttcctatttggccatcttggccccacccctatgctgtgctgcttctaaaacagtaagatgagctggcggtgttttggagaaaaatatagaaaaaagtaaaaatactctaagaattaacagtgttagaatgaatgttgtcacaagaagaatagatgcacacaggcccattgggaacaagaaacacaggcttaaaggtattagaattgaatgaaaagtaatcaagtgttacaccaatgagtagagagaaaataatatagaaggaaaaaagggaaatccaacataaacaaaattggtgcacttgctgaagagaacagaaaacatagaataattttcaaagatgtaattcaagattacttgttgaaaatatgtacacttttatctgtagacagggaaaaatatgtcctgggggaaaacacatattttaaaaaaacgacatataattcagcagtaaaatcttccatggtaaagttagtgcattcaaaagataaggaaaaaatctaatgggagaaccaagctaaatataaacaataaaaaaagtcatcttcttcagggaatttatagtaacagccatcactggggccctctgctgggactcatggaccagcctatgattcaacaactaaagggagaaggcagagcaaagcagcaagcctctgactgttgtatgttcagattggttactcctagttaaacattttgaatattatacctgtttataattacattcctagtatgacaactactgaaggcaatccccaaagtcccacagcagaataaagaataattttttaaaataatcatacaatgaactatatcaaggtgaaaaagaatgaaatacagctacaagtagccaaatagatgaatcttacaatattatagatattacaaacataatattgggtaaaatgttatgataaaaaataatagctttgagtgacagagttcatgtagtatgattcctttatgaacgttagaacatgtgaaattaaactggtcacatgcatatttaattcaataaaactgtaaagaaaagcaaataaatcataaacataaaattcagggtggttggtgcaattgcagtgggctacaagggatactcatgattttggttttcattgtcgaggtggtggttacatggctttaatttcattattgggtgttaaacgataggtagggtttatatatacactttagtgtgcatgatattgtggaacaaaacaattcacatggcagaaatgaaacaaatgaaaatgaacattttaagggtccaaaatcgaagtaagaaaataacagaataaacctaaaaaagtaaagaaagataatgaaaacaaacaaaaatgatagaaataatttaaaaagtcaaatgttaagtctttgtatagtcttcctgcaaacttaattttaaaaactaacaaactcataacagaacaaacaaaggtgaaaagcaacagacaaacctaacagaaaagcaacaaagaaaaaattggtaaatatattaagaatgaaactgtatacattaactatagaattagcatagaattaagaatatagcaagcaacttttatctagcaagcttataaatttagatgaatctcaatttcccagaaatattttttaatctgactcaaaaagagatagaacatgttaaactatcaggaattaaataaggtggctaataatcacaactgttttcatatcttactgaagatgctaccaagtgaagtcaaagtagcatagcaatgtgaaggaaaaacaattctcaaatattttagtatcagtagatctctataattttagaaagaaaagaataataaaaccagagaaaataaaacacaaaataaaatcctattgattactaaaaatatctcttggaaatcttacaacaaaagtcaaacccagactgcagaccaccaagattacaaaaataatgaaaatcctgaatatcagaaatgtgtttgtgtctatataacctatttatattgtttattgacttagcactttattttccttttagaatttattgctaattttttcttgtttgttttgtgtatgcctatattcctcctttttgaatttattatgaaagctaatgactttgccattttactagctattgaacatattaagctcacttactcatgtgattattttctaatttattaacttctgctatcatctttaattagtccttctccttttctaagaattgatatttaatgactttatttttaattaaaagattaattttattctttcttgtttagtaagaaaaatattttaaaatacagcttttttccttaacacctctttggaagtatacaaaaagagtgttgcaaataaaaaaatctttatgcatgtaaatattaaagcctagatgaaatggatgtctgggaagggtagtggggagggaactgagatggttaatgggtacaaaaatataattacatagaacaaataagatctagtatttgacagctcaacaggatggctacagtcaaaaataatttattgtacatttttaaataactaaaatattggattgttttttaatacggagaaaggataaatgtttgacgtgatagatctgcatttaccctgatatgactattatgcgttgtatgcctgtatcaaaatatctcaggcaccctataaatacatacacctattatgcacccacaacaatgaaaaagaaaaattgctttcttacattaaatatatgtatatatctctgtgtgtgtgtatatatatatgtgtatatatatacacacatgtatatacacatacacacacacacaaaaagagataaagcaaactctaaaaaggtttattaaccatagttaccattttagatgtttaaaagtcttgttaccaccaagtgcttaaaacaagacaaagtgtttcacagataaacattataaaacttttaagaataagtttagttccttcttaaattctgttagaatgtagaaaagaaggtcaatttccaaagtttattcttcaaggctgcaaaacattgactatatccccagataaatatgacaatacaaaacactataccaaactcactggattgctaagcctttgagtaatgtattagcagatagaaataacagcatgtttaaggatactatgctattactaatggtgtcagtacaaaagagggaaggctggcttaatcttagtatcttttaatatcattttccatattgagagatcgatctactttaaaaatcctgtgatcatttctacagagattgaaaagctatttaacaaaatttatcttaatctatgccttaaatgtatgaccacaatttaaaatgggtgaatattttctatatatgaaaagaatgcatatcatagtcttccccaaaaagcagcattaagtttagtgcatttaagtgaagaataagaaacatatatccatgtctgttatcattttaaacattgttttatacatagaagggaaaataacaaaataagtaaaaaattgtcttcactatttaactatcattaacttgataaagatcttattatatagctaaagcaaaagaaaacaaaatatctgaaacaaaaggattattagaattaataagagaatatagtagacaatttattgaaattgacaaactgtttctatattataaattattgtatatctgtgaatttaccttacattaatctttatgtttaatgtgattaactactctctccaagaaattccaagatttatttttggaattaaataagctgagttgaaaaataaaggcttaaaatgaagaatacaaaagggacatcagacctaccaattattttttaaaaatacattattacacttgaacatttaaaagtctggcagtcacacatgaattcacgcataaattgagatcagcagatatcaacataagattatacagagttgagaaaaagataaatattcaggaatgtagtatttaacaaaggtgactttaaataaatgagaaagaaataagttgttaattaatggtccttcaaaaacctgtctagccatatggaaaaaataaatatggacagtaaccatattttatggacatacgataaccatattttatgtccatatttatggacagtaaccatattatcttacagtataaaatttccagatttatgcataaaatcaaactttcaagaagaaagcataagagaatttgatcatatgatttaggagtgtgagaaactttatatatgtcacaaaacttagaattcataaattaaataattttcaagcaataaatattaaaattttatggaaaaatgccatttattaaaagtcaaaagatcaaaaataaactgaaaaatggctgcaacatgatggaagtaaaaggctgaaaacaacatacagaattgaatgcccagaaaaataatgaaaatgttcaagactcagtagaaaataagccaaatatatgaggagaacttctaagaaaattttttaaaagattttttatataacaaaaacgatttataaaccaatgagaagattttgaatcttattcacagttgacacatgtcagtgaaaatatccagtataattttcagtgccaagattgacacaagttatttggtaattttttttttgttatgtgttggtaagtgtattcttacacattgtcggtgaaaataaatttaatataactttgaaaacaaatctggctatatctattaacaatgtattgatatacatagctttcatccgtaaattcaacatataataattgatctcagaggtctagtcacacttctgcacaaagatgctcctgtaaggaagaatatttatgatgatataatttgtagtggtaaatggtcaaaaactagttagttaataaaggactgctagatgattatggctatatactatagtcacaaattatgcatctattcaaaagaataagtctttttctatgagctgggatatagatatgtttagatattgggagaaaattctccatgggcctcttgtgtttgcatatttttgtcaacataggccctgactaattttgttccagactatcttttcatggctgtttgttcagagaacagcctgggaagacagacatggtgcctgcctctggagaaaaagagtatatttatagcataatataataaactactgtctccttctggggcaaaggtcaggaatacttactgcccactgtgaaagagcagggaccccctatcctgagggttcctctcctggaacacaaccaactgcatgttcaaacaccacttggttctcattgtgttgccttttgggaagtaaaacttgataactatctcaaattgatattccagttactgatcttgccattataaagccccttgacgctgattcaagagtctcatgtcttctgccagaatccgtgaaactgtggcaggctaatttgttagtttgaaagtaaggtgaaatctaatcccagtcccctttcacagttctcaacaaaagttctccaagatatattgtaggtggaaaaataaaccaaggctcagagcagtatgtatggtagagtaataaatttaagaaaactgataagtgtgtgcttgtggaagattaaacttcacattctttatcttgaaggtgcaaaggaaatatttcttttaattcctttctattttctctgatgtttctcatgagctttcttcctatttttcaactgctcactgaatgccaggaaaaaaaatagaacaaagcttaataaaacataacttagttcaagcctacttaaaacttagtgtgattcagtcatgtgaagaatatctttaggtttaattaacattcttcagaatacatgttccagtcttgttcttttatttgcttcatcgcttcttggatgcactggggtgtatggattttgctgaccctctgtcatcatgtaggcatgatggagaggggtgaggatacagaggaggatggggagggtaggagaaagaagagaagttgtcaaaagacaaagaagcaacaaatgaggtaaggatttaacaggcaattgaactaagcagtgaaaagcatattagtttatcttagagaaatgtcagtaggatggtgggaataaaatctgattgtaaataaaaggtgagacttggaatgaaacctaccttcgcctaatgtagtactgattatattttgtaaagaacaggagacacttgctcagttgtatggtttaaggggaggtatcgaaaatgaagccaaggttgaaatagagaagagagaggaattcgggacccaaagaaccagaaggcaaagaagtcaaggctccttgaaaggaatggacctagacatggccttgggggctggagaaaagggagcaagatggatcaggaaggaagttcaggaagggaggggatttctgtcttgctcctcagctccagggtacctgagctgggtaagtgacttgagaaattggctaaaaatttggaggaatcatgaaaagacattcaccaagaatttccttttctagaagtgaggatgattatgttttctgtttttcatgccattttgcaagtcaaagtgatttttaactcagaagattaacatatgcttatgttattttatgcattataaacttggtaaagctattttccaaagtaaatattggtatgccaatgcaaaaggaagacaagatgtattatctagaatgattaaaaatgagatagtttgtaaatgtaaaactaagtgaagattatctatcatgacagattttcagaatgtggggtgatatagcccatgggtcaagagcagggagggcagccttgatgggggtggtgagttttgaactgatcatattttcatgggaagatattcctttttgtcgaagtgattgccaccactgttttcatgctctttcctcaatctccaagctccttggttttaaatggcttcaaaacagctgtgcatactggccactctagcaacctttccttaactgcatacctgagtacagtttgcagtccctttaccaaaatacatgatttctatgagagttctacttgctgaatgaactgtgtccagtgtttagtcctcaagaaaggagatggggcatcagaacagagagagagtatcatatcctgcaaaatattgcttggcttatggatttattctcaatttaatttttctgtctactgatctaggtgtttttttttaaatagaatcaaaagtgacaattcatttgaaatatttctcccttgtccatgaattgctttgtaaatcttgtgagctacttcacgagttatgaagtttttaagaataaatagcaatgaactcactttagtctccatgccaaatgcagatgtttttgtgatagctgatcttgttttgtaggaaaactcttgccttcaagtccttctattggctttcaagagaataatttccttgttttaagtcagatcaagcaaactgtcaataatgtttattaactacccactttacaacagcttacagtggaggttccctagggagttagagttaatagaaaagtcattgcaattagaggatttacaataaagttaactcaaaatataaatgtttgttaattttgaactgagtgagaaggaaagaaaaataaattattgcaatcttctccttttcagttgggtgaggagaagataacattccaaagaattgagtgatcataacatttgtagatcataaggtgattattggtaatctttgtgttagccatttcacaaatttatttgaaggagcagtaaaaatgttctctctgtctatgaaacatcttctcctcaggcatgatttgtcagctttgtgtgggggattctttacacagcccactggaattcagtgatgcaatgttgttagtaggagaggactgacatttttttcagacaaagaaagtggtcttgttttttagacaacaaactttggggaatggaggaatcccaagtagaattagaaagagaagtcatggagagacatttggcctgttacttagtgattgcctcagctgtgtgtttcattatatgggagatttctattgcttttctttcctactgcctttagacacatgttagcaaggagaaatatatacttttgttaagaactttttgccttctgatgtaattttcaggatggccctgggtatgtcaggtacaatattcagatttaattatttctcccaagattcatgtaaatttcaaccctcatttatgaggtcacctcttaagcatatatattaaaatgcattaatatgtcaatgtgtggcagttactttttgaaactgcaaactcagaaacgcaaaatgatataccttcattttcctacaatttttgaagactgtaccttgagtttctgccttggtttgcaagggttactataacagagtgccacaaacgggatggttttgaattacagaaattttttgtcacaatgttttggagaccagaaggctgagatcaaggtgttggcagacttggttcctcctgagggttatgcgagtggctctgttctatactcccttgggagcttctggcggctgatgacccttggcttgtagacacattgccccgatccctgccttcatcttcacaaggcattctcggtgtgcctgccgctgtgtccatatttcccccctttttttgagacagagtttctctcattgcccaggcagaagtccaatggcacgatctcggctcaccgcaacatctgccttccaggttcaagcaattcaactgcctcaacctcccaagtagctgggattacaggcatgcaccaccacactcagctaattttgtatttttagtagagacgggttttctccatgttggtcaggctggtctcgaactcccaacctcaggtgatcctcctgtctcggcctcccaaagttctgggattacaggcatgagcccccgctgtgcccggccgaggtttcccctttttataaggataacagtcatatcagattaagggcccacctaatccagtgtgatctcaactaattctatctacaaccaccctatttccaaataaggttacattctgtggtactggggtctaagttttcaatatatgaattgtaggaggacacaacttagcccataacagctctcagtccactgatgacagaatgttattaaattccatttaggttgctctcaatcaatgtggattttccccggagtcaagacaataatccttgggagtaaactgttcacagttcacagggctttgccactgtcacctggtccctgcttatgtctcatttctctagctgctgtcttacacgatgacatctgtatttgccatgtggtcaatggtgggcagtccttgtgggcccatctacttgttctcaccataggtcctcttcagatagcaaccttcctttgaagcaattatggttgttctcatgagccatgctgcgtctgtggaacatttggtggcctgtgtcaggcatgtgtggccttaacagccacaagtgccttattctgttgaaattgttctgagatgattcagagaaaatttgcaactctccagggatatgcagtttggacctgaggctctgtctttccctgtctgtactccacccctcctggggtggggcaggggacagggcccttttgtggagtgccacacaattcatagcttttctatgcatttctcatactggcatcacatttttctgaataatagtgtccttttcatttaaatagtcattaattacattctcttggctcttcacagcccctcaggttgcaaagattagtattactctgtcttcccccaggcagtgacttatgaatgtgtcaggatactatgagttgtaacatctcttgatttcactgaaatcccaaaacaacatcatagttaaacaacatctttaatattactgcttacagaaagactgtttctgacatatgtttttccttttttaaatttttgagtgaaatattatcataaagtataaaaagtgacaatattaatattgtgtgttcatcacccagcttaaaaaatagaatttttcttatagctttgcaaatctaagcttacatcaattcaaaacttttttgattacacatcaaaagtgaaacttacacatacatgcatattcatttataatttatataggcatattttacgtcaatatgttgtgcacataaaatgtacaaaataaccatttttaaagataaaacaaaaataaggatatgtattaattctagtgttttcttcttgtatcccaaatatttttttttgtactccctcaacgagggccctatattttggaaaccaccagtgtgtatcaggacctttgctctgaagatgaaaaacacagaaaaattaatttttgctgttggttatgtttctgttgcttttccaaaggcagctgatgtcaaggtataatatggatatgggaaggggtggcgtttaggaatcttaaaataatacacagacaacgcacacaagaaaatatatatgcatgtatttaagtatctacatatatgtatgtgtatatatatgcatgtatttaagtgttttgtgtgtgtgtgtgtatgttttatatagataaaacattggttagcactttaaagtctttaaattcttatctggctccaattggttttgaattcatctgttagtaggtttgtctgttagttttgtggacattctccaggaaaatttcttatctctgtaacccagatgcactattagtatttgatcagggatttttgtgtgccatatgagagaaggactcagactcagaattttcacttaatgtcctttatttcattctgcaaaagtacttcttcatttaagcttagggttgtgatggtcaagacagttgtgttagggcaacctgctctccaaacactttcagtgtggatagtaatagctatgatttgactgataagcagtgttctaagtgctttgtgcgtactgacttattccatacatttaacagctctatgggagaggggctatcattagctcctttttcacaaaggaagacacagagataatgagaggtgttatgagttgaactgggtctccccaaaagatgtgttgaagttctaacacccagtacctcaggatgtgatcttatttggaaattgggccttgcagagataatttattaagttgagatcatactggagtagagtgggtccttaatctgatatggctggtatccttataagaagaagaaaagaagctgggcgcggtggctcatgcctgtaatcccagcactttgggaggccgaggcaggcggatcccctgaggtcgggagttcgagaccagcctgaccaacatggagaaaccctgtcactactaaaaatacaaaatagccaggggtggtggcacatgcctgtaatcccagctactcgggaggctgaggcagaattgcttgaactccagaggcggaggttgtggtgagccgagattgtgccattgcactccagcctgggcaacaagagggaaattccgtctcaaaaaaaaaagtagaagaagaaaagagacacagagacatgactggagaaggccatgtaattggagtgattggagaggcaaagatctgagtgatgcaactgtgagctgagaaactccaagaaatgtaggtcactgccggaagccaaaataaggcaatgaaggattctactcagagtctcaagagaccctggtcctgttcgcaccttggttttggacttcgagtctccagaaatatgagacaaaacatttttgttgtctggagttactcaatttgtgggactttgttatggcagttcttaggaaactaatatgatggattaaatagttgcctaaagttacatagtgagcaagtcatacaagcagaatttgagtcaagcagtctgtcattggagcctgcactccacagccctgccttatccctcctcaggggacagacagagcggtgccatgctgatgcacagctcctgctggggcatgaggaataaggctgtgggcagagatttttccttaggcaaccagtggaacttaggatgaagaacgcagcactgtcagatgaagaatattattaatgtttatcaaagatgcacattcaagatttctgaaaaacattttcaacactggaaggcatgttaaatatcatctcattacacagtgcttttactttgagtcgccatttaaaagataaagtttatagccttgctgatctccttggcatatgcttacatacatatgtgaatacatagacacacatatatgcacatataaatgtgcatgtcgttcttcatttaaccagattccttgtgcccctgtattaaaaatggtcaagtttctatttcaaaccatgcaataattataatatcagataaagaattctttcacaatcttttcttagaattctagatgtgacttagtttccttcctctacagtgagggaggaaataagagtgatttgtgaagatgcatattttttttcagtaaaactggggaggtttcacttatctcgggtctcctattctggatacaacatttcaagagtcttggattcctgtttgattatcaagttcacttccactgaccaataaatattggtagatgttaagttctcaggcttgagaggcttctgtcatttggtgtgtccgatgctaacagacactcttaaataaaatgcctcatgaggggccgggcacggtggctcatgcctgtaatcccagcactttgggaggccgaggtgggcggatcatgaggtcaggagattgagaccatcctggctaaaatggtgaaacgatgtttctactaaaaatacaaaaattagccaggcatggtggtgcactcctgtaatcccagctacttgtgagactaaggcaggagaattgcttgaattcgggaggcggaggttgcagtgagccgagatcgcgccactccagcctgggagacagagcaaaactccgtctcaaaaaaaaaaaaaaaaaaaaaaaaaaagcctaacgagaaggtaaaagagcaaggaggaaactaaagcaaggattgcttttattgcaaaagaggtggaggaatctttaaagatttctgatacagcagaaaatcagatattgcatgttctcacttacaagagaatgagctaaacaatgagtacacagggacataaagatagacataagatactgaggactccagaaacggggagggagggagaaggtggaggttggaaggttaccttttggatataatgttcattatttggatgatgggtacactagaagctcagtccccaccattaggcaatatacccatgtaacaaacatgcactgctaccccctgaatctaaattttttaaaaaagatttctgacaaatagagtcttagaactgaaagctagaaggtgacaaagagaacggagaatgtctgtcatcaaatctagtggtcttccctttctctcgttcccttctcaggacacctgagatatgccatactctcttttattatcatggattctctggtagggaaagggtcaccaagtttttgggatttacgtggatgaaacggcagaggaagataattccgataccctcttaaagggacatgccttgcctccctcaagaaattctgatctcatatacatttttaatttaccagacaaaaatattgggaccagaaaaattaaaagattaaccatctggctgaaggccacagagctagcagtgacataatctatactaacacctagaggtttcctgaatcccaaactagtgcttgtgtatttgtatttgtgtgtgtatgtgtgtgtgtgtgtgtgtttatataactttcatgaatttgatacatgaatatatgtttgactttataaaattttctaagttcagccaaaatactgtgttttgctttactataatttcaatttcatcctttagtcacaggttattagaaaaccccctaattttagtagcattaatgcaaacacaccttaacaataaacatatcatgattatctgcaatactttaatggatactctgaatgacacatagaattttaactggtcatggttgcttttagtagcaaacaagatctgatcacaattaattgatgtctgtcacccccttgttttaatagattgagtgcccaatttgaaaatactactttgttgtgagaaaaagaaaataattgaggatatagtatgggattttgcagatgaagggaatcttggggctattcaatccaatctcttaattttgcatgtgaatacagtgaagtaggtcaagaaaaatttcatgactagatttctgaattatttcatgtagttttagcattattcaattttaaatcgtgaagttcaataatttactgttatagttctttcaccaaggattgtgaataatccaattctaagcatgtgtgtttcaaaggaagcagtaaaaataaaaccagtgctatccaacaaccaatccatagcttttactaacaccactcttcctacagcaaaagagtcctttcaagtccattgctaaattccagaactaaacagataatgttggctgtcatgggaaaaacatagcttttgagcttaccagctatatgaccttgagccaaaccaaactacttaaactctgctcagtcttttcacttgtagaatggaaaaacaaagcccatctcactggctcattatgaaaatcagactaacttgcataaagtacttatcatagtactggaagccaataattattagattccctttcttctcttcttttttattttccttcaagattacatggctagttagtgtccaggcaggacaagagtggagaccttttaatttcgaggcagtggaaccctctatattcttccgttgtccacatgaaaatgctctcaggaatgaaaagcagaaatacctaaggaacattttttttctcagcttgagaagcaagccagggactggtgccctgtcttaaaaatggtgaagtttctatctcaaatcatgaaataattgtactgtcagataaagaattctttcacaatcttttcttagaattctagatgttacattgtttttttgtttcttattactagagaaggcttaggaatctatggtggctcaaaaatgactagagaaaaattgagtttatctgttataaactgagcatatttgaatacactggaaaataggacacaaaacaggtttttggaatttacatatttggaacaaagcaaatgaattttagctggcagagtcaactaagtgttcaaattaaaatacccctatttcaaggttatcatgaggctgtagcagtggtacacctagcttatcagatgcacagagagaataaatttttaatacctatccttctctatgtgataaaattgttgccagtaataatcatgaagagataattaacaatcagatttttaaatttgttttttagtcttaaannnnnnnnnnnnnnnnnnnntaacagtgtatgtagaataatacatttacttttaaaagtatattgcaaaattaagttaaataatttatatatgaacaaaaatttgcacttacctcaaaagttatgcattacatccctctgtatgctgttttaaaatgtaaaacaagtaaacattccaagtggttaagaagacaaatacaagtaactcaaattatcctttttttgtatttacaatctctgagctataattgtttatttccaatatacatgtaaatgcagggctgtgtagcatcacaggttttggggatgggagctatagttattctttacccttgatgaacttatttgcaaagtgtctgtaagattttggtttccacttagggatgtagaaagttacaaagtgtgattcccattcttacactgaagaaaagtgggacgaattaaaaatccccatgtgtttctgaattcatccaagatctgaagtcacaggaaaagcaactggccccaaatctggagatagataggcagatgaagggagagaaatgagctcgggcttagctgggtagacataattaggtgctgagaagggtggtgggaaagttggtagcggccaagtatgccctcgtgaatgagcatgaagccccgggtgctgcagaatttgagagagcccaaaccctcttcagatttgtatctataaatcctactgagctctcacagaaaggactggaagatgcttttgaaaacagatccaggaagtggggaactcaaggaagagaggagcaactcctccaggatggtcatgaaactatccagacatttagtacctgtttcccctataaaacaaaatctttcactgtcggggaaagggtaatacatctccttgctcttagggcacttgtaagtatccatggcagctatgggaaggaaacaggaacataaataaatgaaagctcgacatagataaataacgaagaaaacatatcacacaaaaacaaagaggtggacttatcattttcaaattaccaaacacaaaaacaaacagaaactcttacaggcagttacagaaaaagaaacatatgcagaggaacaaagatactaatgacaggggacttcttgtcagaaaccatgcaagcgtggggaaaatggagagacgtctttgaaagcctgaaagaaataaatgttagcattgaattctatatccagcaaaaagtatattccagaaatgaaaacaattaaggatttttatgaggctattcattacagcagacctaccctaaataaatgtaaaggaagttctttagacaaaaggaatgtgatacttgacaaacttgaatctacacaaagaaatgaagagcaatgaaaatggaataaattaaagtgtaatagcattatagttttatttttagttgctctaaaaataactgactgtctaaaacaaaattaatggcagtagattgtgtgtctataggaaatgtgtgtgtgtttatgcaaaaataaaatggcacaaagaatgggaggaaagagctgggaatttaatgttttaactcttacagttttaactctttcctagaattacatataaagtggtacaatattatttgaatgtaaactctggttggttaaagatatataatgtatacactaggacaaccactaaaaatcaaagtatacaaatagcagaggaaatagaataaaaaataatgctcaataaacaaaacagaaagcagaaaaaagaggcaaaaacaagaactgataaagctaataaaaattgcttagaaagttggtagatttatatccagcagtgtaaaaaatcatgttaaatgtgatctctttaaactcaccagttaaaagatagagattgtcagattgtataaaaactgagacacgactaatctataagaaatgactttaagacattgacaggttaaatataaatgaatgggaaaggtattctatgcaaacacccgtcaaatgaatactggatcaactatactgatgatagacaaagtaggctttaggacaagaaataatatcaaggataaagagagatattacacaatgaaaaagtaattatatcctaagttttaaaatgctaagtatatatacacataaagcatttcaaaatacataaatttaaaaaatgacagactgaaaggggaaaaaatccacaattgtagtcaatgtcaatactcctttctcatagtcgacagaacaagtagatagaaaattagtgaggatatagcaaacctgaacaaaactatattaccagcttgaccaaattgacatttatagaacagcagaagatacattattttaaaatgcacaaggaaaattgaacaagatagatcatcttctgggtcataatagaagccttcagaaatttaaaagaaactgtattatcatataataatgtgattaaactagaaattacagaaatagatctgaaaaaaatttgaacaacacacttctacataacccataggttaataggaaatctcaaaggatattaaaaatattttaatgaatgaaaataaaataatttataaataaaaatatttaactgaatgaaaataaaatataacatatcaaaaatttgtggattgcagctaacatagtacttagagaaaaatttacagaattaaatgtttatattagaacagaagaagtgtttaaaattaatttatacttctaccctagaaaatagaaaaaaaagacctaattaaatccaaaaacaggagaaggaagaaaataataaagattagagaaaaaaatagtgaaattgaaaagagaaaaacaataaagaaaatcaataaaaccaaaagctgattatttgaaaataacaataaaattgatttatttttaagcagactgatcaagaaacatacaggacatacaaatattaccagcatcagcatgaaataacatacataatatccaacactatgcatgttaaaaagatagtaagcttatgatataagcaagtctatgcctgttaagttcaggaatttaaatgaaatgggccaagtccttgaaagacacaatctgccaaaaatcaattaaaaagaaatagatgacttgaatagccaatattggtcaagcaaagtgaatcatagttaaacatttgtaaaaatgaatattctaggctccaatgattttactagcaaattctaccaaacccttaaggataaaataatgctgattctatactacctcttccaaaaactaggagattagagaatacatttcaaatcatttcactagggcaaaattttccttatcctaaaagtagacaaagaccttacaacaaacaaaactgcatgccagtatgatttataaacatagaacaccaaatctttaatagaatattagcaaatggaatccaatatataaagaaatatataaaaatataatacttattaccaaccaaatgaggtatatctcaagatgcaaggctggtacaacattaaaaaatcaaccaatgtatttcactgtagtcacagactaaatattgttaagatggcaattctctctacttttatctatagattcaatgcaatccctatcaaaatctgtgcaagcttttttgctgatgtcaacatactgattctagactttatatagaaaatcaaaggaactacaagagctgaaataattttttaaaaagaacaaagttggagttctcagaatacttgatttccatacttactataaattagggtaatcaagactgtggttgtagcagaagaataagcctagagttaggcaaaggtttttcaagtagataccacaaaaaccactattaaagaaaaaacttgataaattggatttaattaagatcaaaaccttttactcttcaaaagatactgttaatagaacaaaaggcaagtcacaaattgggagagaatatttgcaaattacatttgtgacaatgaacttctatccaggagatacgtacatatatatgtatatacaacaatttatatacatatatatccgtacatatatgtatatataacaatatataacaatttatgtacatatatatgtatcctggatatgcatgtatatatgtgtatatgttgatatatatatatatgtttttatatatacatatatatgacaatgaacttgtatccaggataaacatacatatacatgtatgtataaatttttaaacatatatatagaaacacaggtatatatgtatgtgtatatgtacatatatgtatatgtaattatatatgttatatagtcatatataaaaaatgactctgcaatttcaatacaaaaaatgggcaaaagaagatagatgtccctaaaacttaaagtataataataataaaatttaaaaaaagaagatagatgtattgcaaataagcatatgaaaggatatgcagtatcatcagagcagagttacactgccacaagccaagaaatgcccaagattacctgcaaccaccagcaactgagagagaggcatggaacagtttctccctcaggtcctccagaactaaccaacccgatttcaggttccagtcttcatcactgtgagagaataaatttctgtttttttaagccaccaagtttgtggtgctttgttatggaagattcaggaaactaacacataacaaataaattattttgaaaaatgaggtgttttttgaagccatgttattgacactgtaatggagattaccttgccacaataatatagcaacctaatcccccgaggtctgctaaagctcttactaaccttagaaaaaattgtaaacaatagtctgaatactattttttaaatatatatttatctttaaacaaggttacacaggctatttgataattcttgacagtcagaaatcaattcctattcaatgagttttcctaaatggaagaaaatgaatcatggaacccttactgggcataaagcttagaaagaatgtaaaggcagatggccctgtctgacattagctgtcatctttgcctccaaacagatgctaaggaagaagctgaaaacacattacagtgtctgacacagtgttagtctaagcatgtgcctaagatgctaatacaggttatgagaaaaggggcctcgtagccaaagttttgcaaattctaagctaaaaaaattaaaaatatttttcatgataggatatatgaggctcattagtgtgctgatatatatcgtgacacattagaacagaagatagcagactcttttccatgtttattttaccctagaatcttctgtgaagaagtttcatgaaactgagcctccatgaactcacttcaggggataagcaacttagaatattgcttctattgatgcgtcattgggtcaatttggaagggatggatctctccctatcctgtatacattttgtttattttccccctttctttctatttttaaccatctcacctttaaaaagatgttcctttgacccacaaattatttcccatctctactgtgtatactttaggatctaagatgtcctatttaatataaaatttaaaaaatcacattgagtagtcttttattcctgattcaccaaattactgctaccataatgctttatcttctaaatcatttctattttctttactgtttattggtgtggaaccataagaaacagctgatattcaacttatgaaagtggcaattccatatggttcaaccaaatacattaatgttattaaagagtcaacacagtttccaagatagttgatttatcaaagagccttaaccactgcaagaatttggcttaatgcttttataaataggctaggtggttgacaggtgagatcacttatgcttaaaaatgataccaagttgggcaagattgacaatattttgtagggccaggcaggaatgcaaaatgatgcagtcaatttgagggagtaatgtgtgctgaatagaatgaattcctaataaaatacttgcaaggttttggttataaaatagaataattaattttataaatgcaacagaaataggaacatttacatggactggtccacataaagagcagttttaaagtcacagccaatcacagattcaggctctgccaaacatgcccaaatgggcagcctccaagccattcatactgaccaaccatctggaccttatcccttggatttcagctaccatgttgaatcagatcaatgacttcatgtggcctatgaattttaggcatttagacatagtagtattgtcttgagtaatatatgtacactcttcctgtaacccattcaaaatctgctcaactttcaagggccagttaacagtcaaggaagtccagaaagtctctgctgttacgtctataggtcatagactttatcgctcagcttaactcaaggtgacaatcacttctggctgacaatcacatcagcttctttgtatattagccttgactttgaagtttgtacattctttgaggacaaggaccaagtactgcacatgttttgcacttctgtcagactaatgtgcaatcaataaaaacattagtaggcttcatcaagcaggacttaataacattactgatcacaacaatgaaaacaacatgcattaaagcaaaatgactattgagaacattaaagattgagaaatttatgtggaggcagatgaatatgaaacaaaatatatacgtattttatgtccatattactgaagttggtatttaatatatccataaatttcattacatgcttaattcgagttaacagtaaggccagtgtttagtttagtagagtttcatgtaagagtctttattcatggtttgtggtttaatgtgttatgtaaaatacagtaaactagaagtattttttcgttggacttttgtctcttaaatactgagatgctggatagaatggtttttcagtgctgaattttctgaccctgtgatttattaggctttttaatgtattatcctaatgtctttataaattaatgtttttataatttatcggttgactattgaaataaaattttcatattccattgcattttatataatagcattacccctcagccactgcgatatacatgagtttcaatttattatagctcagtcccaaatcaatgtcactgttaagagtatgtgttacagtagtggttatctttggaaaacaatttgagtctgactagatgttgttcaatccccaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtaagaagtataccctgtgaaaattgttaagtggaataatcaaattttgtttttaatggaaatatgtgggcgtggagaaatgttgaatctcagagtgagtctgcttttgagtatgttttttagaagtgaaattcagataaatcaatagaaaaaaaatgccatcttgctgagactggcaagtttgatgctttccagctgttccaaatgcctccttctagcaggatattcactggaaacaacaccccaaccacattttatgtaaattgtgagccatgatattgaataccggattacatctgttaaaaaggatttatataaactgacttaattattttctgttacagatcacgggtgctttgaatttttaccttcgcaaaatagaaccaaatactttaaatttgatagaagtttcagatatactggttataaagctctttgaaggatacagtcacagaaagattttttgtttgatcaaaatattttttatttcatagaagttatttgaaaatattttttacaaaattgtagcaatgctgttaaaatttattagcaaaatcatataaaagagttgcagtttaggtttcaatggtatttagcgagtgttaccgtaattaaatattctttttacatttgggcaggtgaagcctcaaaatcagattttctcaaccgtggttgaacatcagcatcccaaggagaaaggaataaactgtcagttctcatgtagtacaccagaggttctgtttcaagtgctttggtgtgtggccttgacgttggtggtttttttaaagctctctgggtgattttaatatagatgagtgtgtgacccattgctctaaatgctaaaggtgaggatttgacttcacgaatgagtacctttcttcctgaagctcacattgttggtagggcccatctctaaccagagctgagaattccccacagtctgattgcaacagattgtgtgttttagactgagctcagttaaaggtgttttgctgataggaatcagaccatatccaaagcgaggtgtgagtggatccgtcaggggtcatgacaaatggtcttagcagttaggtccctttctgtgttcatgatgttctcatcatatttctctagcacttcagtctttctttcttcttagtaggatttctctacgtccaattcataacacccacccctccaaacacacacacacacacacacacacacacacacacacacacacacacttctctacttccaattcataacacccacccctccatacacacacacacacgcgcacgcgcgcgcatgccccatagcgtctttcatcttgaaaaaattattcttttcaaacttgtttcagtaacaagacttgaattctgttttgggtttgaaatctattttgggatttatttatttattgtttgcaaatcaaatttagggtttttttttagagaacattataatcaaatgtggtagtctaggattctaaagatgtttaatattaaggaatctaaacatgtaattcaccacattaacatatcttaaaggagaaaacatacagaagtgtttcagtagatgataaaacatatttgatacaatgtaaacgcatttctaggacatctgtactctctcattttttaagcatggatgcaatacctttgttcataacctgctttagtcaagggacccagtaatgtcctgtatagcgttttcctctccttacaggattcagactattgaaaatgttatgtttatatctctctttagtcttctttaatctgggtcatttccacagactttggctttagagcattgaaacttgtgaagaaagttgtccccattttattaaaagaaaagtgtacttatcttggatttgtctgatgtctcccccgccatgattagattcataatacatattcttaggtaaaacactagagaaatggttttgtgttctcaaaatgtttcatctggaagcacatgatgtccatctgctcatattggtgatgtcagttttgatgagctggtcaaggtgttggctggtgtcttaactgtgttatttctgacttaccctcttcacaaatgtgcattctatgaggaaatactttaaagccatacatgtatcacattcctcactaaaattaccccagatttaacatccgctgatgacaatcacctgacacagtattgacaatgatgactggaaaatgatgatttatgaactgtaacattctctctgaattgactagttggcactcagtattccaccacaaacaggaatcctcctctctcatttatcagttatttgttatttcatttacttagtgacttattatcagtctagaagcacaattcttattatttcattgatttgttattcattttgtacataattattctggtgcacagagttttccagattaggtattaaagcccatcaggctagcttttgtgtttttgtgacatgcctgccttttgtttttgttttttgttttgtttttgcaattctttacttgttggcataataacatattccagggtcatattggacctgcttcactgcacctttggaatcatccacttatccaaacagccctgattccttttagtgaaaatggtatttgaataaaaattgtgggcacagggatacttatttccactggagggtatttgcttcttggccctttctgcaaataggcttgtgtcaaaaaagtagattgaagcataatacaatttttattttatctgagcaaacaatgattcatgaatcaggcagctccaaatcagaagtgattcaggtgcttcattgagggaatgcaagtgggaggcttttatagggtgaacagaaaaagaaagcaaagaaaaatagttggttggctaatgttatatggttgccttatttagtctatcctgttggaaagtccctagttatataattataagtttgttggttgcttctgattggttaaacttaagttctgttcttctttaatgtagacatttataagaaataacttaagctaagtttcacttatttttgcctgtcaggcaaggttaggatcatttatgaggcctaactggcttagtctgctcaggggttctttaggccttgtctccattttaatttatcttgacactagtaaatatatgcctgtgcatatacacacaaatacatatacacatacttgcacacagatatgcatgtacacatacacatacatgcatattttagaaatcatgaatttacaccagtgcatctaattccagtccaacctcacaggattacttcttgttttctccattccatatttgcatgtcccattttcacagggagaaccctggctcccaataccaccaacatatttacttatttgctcaatcctatactacatctctagttacttctagaagtgctgcagacacaccactaaaccaagcaaatgtaccaaaagagattaggatttgcagtccacccctctccacttccccccactcactgtacctcaatcatgcccaagattggggtatgtagtcgaatgacgtgttcataagtcactcagacttattttattttcttctcttttagtgtggttatggtactcatttgaaatacaatttagcttatttatttcagatcactttcaattttaggttttataattccttcccatctgtattaatatattttataatgtatagtacactaacatgcttctaaaagtcataactatgcagaaaagtatactcagagaatcatccctctcttcctcaaaccttgcaccctgcttaccctcaccttatagataaccaactttattgctctcttccttctctgtgcatgtatttctttttgtgtaaagataaatagacatatttgtgtgttattatttctcatttttttcctgtgcaaatggttgtgctttcattccatgtgttcttttgcactctgcttttacgactcaacataatctcctggaattcactccaaatcagttcatagaaatccttctctttattttttcaaaagcacaggactggattctatgtatgcaatgtaatttattcaatcaagctcttatgcttgagcatttagacagtagtcagtattttggattgtaaataatagtgcacagaatgatctagtgcacatatatttttatatttttggaggtgtgtattcaaggcaaattaccagaaatgcaattggccaaaagatacatttatattcagtgttacatttaatcttttctgtctcatttactcttgtagaaatatctaagcctttcatgtttactttggcagtctcattctcacctgtctttcttttaatacccacttccaccctccgagttcaggaccattttccccaaattgcattagcctatgaagtctctctattaatccttccctttcatatcacagtgtggttttctgaagtagtttggagcagaaggggaagaggagttaaatggattggggaatgagactgaagggcagaatgaggcagagctggggatcaaagtgttccagaggctaactttgtgggaaaagtagaagggaggtccagtgtgcagagcagggtgaggccccggcaccactgtacaggagtgtgggctggtgtacatgtctggtcagtcatcctagagagagtcagttctattgggcactatgaaaaatgagagctaaaaatcatcaagtgtaaggcagaagaccagtcctagaggctgagttaactggcaaccacgagagagaagctgtgtgtgtcatagcatgagcacaggagtctggagcttttgcctgggcgtccatatgccatgtcttggaggctccgttgtgaattctgctttatgggtgagacaggaagtctctgagctgttgtaaacttcccacatcagccgggaatgtttccgatgtgtggatgagagggagctgcctatgggggacttcagtgaggagtcatagaatttggaggcagaggctgttccttcccatctttcctgaaaaaacttcctcatacacagtcctaaccaagtgacttcctgctctcatattatatatgagaggcccatattatatatggttacatgtataatatttgtataggtttatatttgtagttataaaacaagaaaacatatgacacaaaggcttttgcaatagacttgtggcaaatgctatacaaaatgtattaatagggtatctcttcctggtctatgatttacttaattttaagcatctcattattttctatagcacttagttccttgcaaacaacataacagataacaagaaagcttaatggctggatatgtgggtggttgagagacaggatgaataaatgtgaaaatgaaaaagaagggtgataattagagaacaaaaactagatgaagcaatagcataaattatagcattagatttcaaattacttttatgaattgagttagcttttagggaaaaatgcaataaaatgaagtttaatgacaggaaaattcacatgagtatttgcaagatagaaaaataaattctgcaaaatcaccatttatatgtaactgtgagtgaaaaatttatagataatagtgacttgcaagtgatctgggtaacagaatcatgcagaggatatgaaaacaaggatattgtcagcatccataaatatattttctggagaaaatgtttgtaaatatgatgaatatactctatatcttaatgggagaagaggaagaacccaaattttctcaaatcctactatgtactaggtgcagcagtgcttctagaaacatgactgggtacatattcatcacttggtattggcagcagttctatgaagcagagattatttgcagatatggaatctgggaattagaaatgaaagcaatgcctttaaaaatgcatagctcatgaggattaaaactcggaattcagctacagctctaccttactcacaagttcattctctttctaatagatcacatatagatttgctaatatctagtaattcaaaccaaattagcaacagcttccttggttccttcccatccttcaccctttacactcagtcaccaaatgccctctactctttctcctaaaaatatccccagatgtatttgttccattctaaactcatcgcatcatgtgtctagccactgtcttctttcctgcagacaaatataacagccttttaactcatttctttgcatccacttttgcctcatttcagttcattcactcttatgctattgcttcatctagtttttgttacatgacaaccagagtaatctggtaaaaattcatacatgatcacaggactcccttgcttctatgtcttccaattatttttggattaaagctggaaatctttaacatgacctataagacttccatgaactgcacctcaggttgctttattcatttcatgccacttttcatgctgttctgtatacatcgtggtgtttttccttcacttccccttttattgcagagcctgtgctattgtctcatgctggaagtaagcctcttcaccatctcacttctcttagctatgctttttctcttggcttttagttctcagctacttcctcagggactctgactttgacctactggtctcagttaaatccccttgctatgtgcttctgcaacactttgcacttctgtatttattttatcacattggtttttgctcatataaaactctgagaggagggttatggctgacttgattcccgttggattttcagagtccagggtggtttcttgtgagagatcaagtctcagttgatacatggtgatggctgtgatgagcattaaaactcaaaatagataaattaacaaggaaatttctcaagtgggcattctacctctcaaaattgtttgagtgcaatattaatgttggtgaaattacatttgggggatgtggtagaatcttcagacttggatgagtatatggctcgtggtagaccagatgactaccatgcctctctaacgtggaggtcccctgagaatctggtgagttaccagcaatccatgcctaaggaaatccactcttgtcccattattgtaaggacatgtgtatcagtataagttaatgctgaggaggagaaattatcaggggcacatatgatttttatttatgcatttgataataaattatttccacaaatatttattatataaatagtatgttcaaacatagtgcaaaacattgaataaatactggtgaggaagataagcaaggttgcttccctcacaaagcttagaatttgctgctttatttcacttcagacccaggtgtaatcagaagacattcatgcattggttggatggctatatgtggagtagctctgcacttggagaggtcaaatttacattcattaaaccattagaggtcaataataatagttgtgtgatctaaaatataattgccatgctaaaataacctcaagaaagagtagcatgtgctttacctcaccatgcccacagaaatatctaattgaaatattaaattgatttggattatctactctcttgagagagatggtataaaaattcattaattataattttatgtgcatgtaacaaacagtcttttttgttttcatggtttaggtacatgtcactgtggcaggtgtaagtgtgataattcagatggaagtggacttgtgtatggtaaattttgtgagtgtgacgatagagaatgcatagacgatgaaacagaagaaatatgtggaggtatgtatattggctctgtagaaattaataaaagtacctgtttttttcacctatttcattgttcttttatctctacataagtttctgctctaggtgtgctaatgtagtttaaacctatgtttatctggaaaacatttcacataaggagagtgagactatggcattaagagtagactagtactttttagatgcaaagccaaattgtccccagaggagagctgtgtcattatggcaacaggccaactgcatagctctgaagtagtcctagtagaataccatctcctctgctcaccttagtcacttttattttcctttctcctactctcttaagtgtacattttcatttctttgtttttccctttctaaaacatgagtctcatgtcctatcagggacaatgaaggtcaatagggttattagcctagagtttacctccccctctctgtccctaaacacttaaataacattttcaatgaccttttctgtgtaccaccattactcaattcatttttctgttgtagcagttcttgcatgtttgctagtgacaaattctgcaataagtgctttacattcattatgttttgtctcacaacatcactctaggctaagaattatgtttatctacatagatagatgtggaacctgggacgtggataaattaggtaacgaacccagggtcagtccaccaataatagtagaatttgggctcgtgtctgtgtgatgccaaagtctatgttcctgatgcctcaccactcacgactgcatcagtgccttagagctcagagctccacaagaggagtctctcctcaccacttgcagttttcatctcttctgctcaacctgcaagcctgtgcccagagttcccatttgcaaccttgactggtgtaggaaaagaaaagtagaaagcagagagaatcatttggtttaggtaaatttttctctgctctgaacttatatttcactcctatctcatgggattccagttgaaggaagactgccctgcgtgcagaaatggtagttttagaagtattgtttttctggaaggactagggcccaatggggccacgtggaaccagagaaccctgagaaactgtggctagcataggacaagcttgttcttttgtttacatttcggtagcttcaattcctgtgagtcatccaaatacacttattttaggcctgattggccctccctccttgatctcctggctgtacaaactacctggataaaacaaacaaacacaaaaaccttattttcatttttccgagccaatgacctaagcaagatgctgctcagacaattctttcttaaagggctcagtccaaaataattagatcaattagacaaatccatccacaaatatatgtgtttgtcctcttgatgtttagtttccaattattatagatgatgaaaaaaaaaaaaagaagaagacgggaacatgctttggggccagtgtgtgttgataaacaccacaaaagcagagtctatttgcatgtatcaatagaaaaatgtaacttgaaacaacacaacagaaaatgtttaactttcaaactttctagttgttatttccatttgtttgaggcttaagcaatttcatggtgcaaagtctctgaacaaggacaccagcactgcagtaaacaccctctgggggtgacattgcctgggattgtaaatctttccatgtgtcattcacatgaaaccaatctgctgagagatgattccacagttcatcagtgaagtagtacaaatagacattttcttgctctatcagtttgcacaaagcaaagaattatgtttattgtctggaatatgtattgtcctaaagcacacattttaatctcaattattcagatgtgtcttgttcaatatttttatttgagttatgtggatatttgtttaattttccatacctgcatagacgtgtattgttacataatttttgcttccttatttacctctaactcaaaggtttcttagtaaaaccctaattcagtactgaattgtataaatattcaaagaatttggatgtgagaaatatagattttctatcatttattaatatagtaatccttacttatgttgcaccttctgtataaattttctgaaattacagagaaaataaattccgtagtctaaaaaggtgattgggtcgtacaaacctgactcctaagaaaagcaattaatatacactattgcttttttttcagtgtaatccttgagttcttgaggcctgtgatatatcactaggatgtgatttgtgtgtgcaagtagacaccattttaagttcataaataagatatatagatgatatattctgtactgattaaatcacttgacagcctttgcatttgcttaagtaaacaaatttaaaattcaaattcattgtggaaatggtcattgatttttaggttaacaagtgattttctttgaatatcccaattataacttatttagacagagaacatggcattgggtccctgtctctttctctgtgtctcactatagcactctttctgttcatctctctggctctgtctctcagatgtgtatcttcttgatggaagtctcatctgctggacatgaatagcgtaggataccagaatattctgttgtacttcttgcttcttatgtgagttttacaggtcctattaatgttcttgccattggccagaaataccatagtgttagaatgataaatatgcttataagacaatgaaaagtagtctcataatcagttttgcattgtcttttggggagtttggctgtaagagaagagagatggaaagaacaaagactttagccatagactgataaaacacaaactcctataatacagaaagaatagactaaaaacaaaacaagaacaaggacatacatttatacttaggtgatataactacaaagatgagagtataagaagtaaaatttgggataaatgccatctttggggaatttgcagaaggattgctaggtgtggatgaggaaagcaatggtgcgataattcactacagatggcttggaggcaagtgcagatgagcaggtaacaggttacagagaggtgggagctgaaagagggcatctggacacaaaatggtgagtgcccttacctgtcatttgtatccccttgacaagtagaaagggaatttgattgcgtggccaagggcccatggtattttgtttgtctaaatgaggattaaacatggactaggctgaaaacctctctttcacatggtggaacacaacagcttgtggggcacagttgagtgaaaagatgaaatatttattctgctttaaagagttgtttggtcattcataatgtctatctaggtaaatatgcaccattggtttctcaatagttgatttcaaatgaaatattttaataactaattcaagaaacgtccttagagtgaatgctcatatatatttgggtttgatgtgtgcatttgagatggaaaagtaatagactgtcatggtcattcatgtcatttctttaaaaatacttttaatcagttccctgtctaggccaagttaaaggacactttgctctttttgtatgattaagcaggtataggcacaaccatgatgtgtttggagaaagctgtataatttgattattttaggcaaggaatgtggagctgtgacagtatttcagaaggcaaaaatgatcacaaagagatagaaagttaattctgcttatgaaagttgcttttttcctcactgtataaaattcattttgggtaaaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagaggtgtgtcattcatacatgttactacataatggggaggcaaacaaagcttttaattgttaacacttcttttctttgtatttcctctagtgtgggaggaagttatcttctaaccatttactttgatgtaaatcaacatttactatcccaacaatcttttctgtcttgttttttattgagtagaaaagagaaagataagaaagttgctgtcattctttaagcttcactgaataaacagttaacttagggactgtaatttctttggcagccctccagacatagcacagtgcagctaaaaggcaattcctttagatacttctgttaaatgtctcttgactaacagaaccatctacagcatgagcatctaattatccgtagagaattcagaaaaccctcttgtcttaattatgagtatatggaaggcttggttgaaatgcagatttgatatggactaatttaacttccgtgtgcaataataaaaatttgatattgaatacaatagatatacaaagtatgtatccaatagccataggaaatgtacactgactttacaaaggaagttaacaaatatattaatattgctaaactataatttaaaggtagttaactaacttttgatgtaaaatcaaacagtttaaacatagttttaaaattccttgaaaatacttaattttccctttgctgtagtgataaagagagccatactaaagttttcattgcctatccaatggcattaaaaagtgattatacttctttaaaactaaaaaaatctagatagctggaaaactttttttcatttctatacatgaataatgcattgcaatagataatgctaatacagaaatcgtagcataccacctgtcagaaattgacatagaggagtaaaatgtgccacatttctttacatagagaaaataaataaaaaggcaggaacttggaacaaaatcatgaagtcttcctttgtggggactaaatcttactatatatcatactaatttaccttatggtttctttttattatttattattattattatactttaagttctagggtgcattgcacaacgtgcatgtttgttacatatgtatacatgtgccatgttggtgtgctgcacccattaacttatcatttacattaggtatatctcctaatgcttcccctccccactacccccacatcacaacaggccccagtgtgtgatgttctccttcctgtgtccaatgtgttttctgcataagtccttttatgcagtaggggtcacagtcaccatttttaagtatatgaagcttgaactctggtactgtggaaaatgactatttggctgtcaaaaagagagaggtggaaaatggaattggttgggctgtggattaaggtcaggttctgcagcagagttacattggctgtgagagacgatgtccttcagaaacataagctaagccacctgcatcccacttcgctgtgcttggagcattctgacctggagctatggcagaggcagaatgggaagcagcttgcctgagcgaggctcacagcttctgagattcaggggtacttgaagacagggcagaagtgggcgctgagatgagtcatttttttttctcaaaagataatactcctgactaccctgaaagcatttctgcatcattgcatccataggtaatagaaacacactggtccctgcacatacctatcttgtcttcctttttccccatcttcaggggccaaaaaaccaatgttgcagacataagcattaatagaacaaatgtcctctattgcccatctgttttattgagtttcatagtggacccctttacacgtggctgagaagctgcttcttcgtcacatctgcatagctcctagtccctgttcctcctgaccaaactcatttatcctattatgagagcaatgcatattcattttttaaaatctagataataaagtagagtacacagaaaaataagaaagtgacccataaacctaacttccaggtgtaacctccttttacattttggtacatgagctttcagtccgtatttatttattaaaattcatttttatggctgccctatccctgtatttccttcttattaaagaaaaaaaatcaaatcatactgcacgtgctgatttgtaattttacagttttatttcatgatatatgttgtttatctttccatatttatggggcaaaaacctaatttattacttagtgattgctaggtagtccatatgtgtgtaccattactgcgctaattccccattgaacaatatttcggtcactagtaatttttcaaaaacataaatacaactatattttatatttctgaacatacacttgtgtgtactttttctttctgttgggtacattaattaaagtgagctataagtctgaataataacacagatataaaaagtacatattgcaaaatcgctacccagaaagttgtaccatttcgtactccccttcagggcaagaaagtacccattgtcccacacctttaccgagtctggatccaacaatattttccacctctgacgatctgacttctaaaataattgccaatcacgattattttgaagatctgccactgctacccacttagtagtggttgattgagtgataaacatttttcatctttatctgtcattatttctgtatgaaatttccttttgttctttccttttgtctatttcactttgggcatattaatcctttatatattcaattctatgatttatttatatgtttttgaaattgttctttgtcttttacagacatattaactacttgtttcagctttgtcagtcttttttttacagtgttttgtttccaaccaaaattttcaatttttatggaaattttcaatttccttttttagtaattgtgctttggggtcttgaataaaaagagtttagttcatattatacagttttattttgtacgtttaaatctttaatccaactggtacttattttgatgtaagaggtaagaaaaggatttaactttatgtctctatcaaatgattagctggttgccctaaagacagttactgataatccacacagagtaaacatgatgtacagctgggcatttccctctgcaaatctgcaaatgaccaagtttatgtctctcaatctgatctccaacattctctataatctgggctcatctgatctagcaaaccttacttcttagtcttttttattttttaacatgcacctcagggtccctatgcccatccctacccttctttgctcagtctttttttcttgactttctcttagttctacctccaatgtctcctagaacatttcctctaatccctatatatccaatccatccactgctaattactccaacactcattgatcctctttctccaaattcttagagcattcatgtcttagtttacaaaatatttgcacattgtttttagtgtttgttaatttttctttctaattagctttctatttgccaaatagattgcaagcttcttgggggaaaggattatatcttatataaattgttttagtgttatctttgaaggaaactaacataatactaatgacacattccaccaactcacataattatagaatagataataacttttgtttattaaggaatctctattatcaatattagatggtgtttttcctttttagaatatttttgtctgaatatatgtgtttttttcaaacacaaagtaaacagaaaataataagcgatatgtgaaatgctttctttcatggtttttcttgactggattcttataaaattcttcttcccacctagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtaagggctcttccaattcctgtttttctggagggggaggtggggcttgttaatgggtaaaaaaaaaaaaaaagcaattagaaagaataaataagacatactgttggatagcacaatagggtgactatagtcaataacttaattgtacatttttaaataatgtaaagagtataattggattgtttgtaacacaaaggataaatgcttggaggggatggataccccattctccatgatgtacttatttcacattgcatgcccgtatcaaaacatcccatgtaccccataaacatatgcatctactatgtacccacaaaaatttaaaaagtaatgaataaaaaataaaaatgcatatttccctgttttcaagatttctgattctcacataccctgtaaaagaaactgaatgtgtattctaaagcatcttatatttgcagtgctcctactggtaacttggaaaacctccagagaattcccaaagttggcaaagactagagatgagagggcacccactcttttaaagttagtctaattcctcacccaggagaaccattagctctagatagctactcagttcaactctgagactacaaaactagcagagctgttgacaatgaacaggatagttatcattagggcacctatattaatgtattacaaaacaggataatacagtgctcagggttattttgtgcattaactctttgataggctttaatgttattctgcaatgtagtctgtaattaaatatcaattagtagattcaaaaatctttgactgtaaatactgtggggcagatactgtctgttagggactgagtgacatctgggctactggtgtagtaggagccagtaggggacaggagacagccatgaactttgacttcatggagtttgcaatctaaatgcaaataaataaaatatgtaagtccaggatgtctaatagtgcaaagaaaaagaaagcagtcagaagtctatctgaaaaggtatcatttagcaaaaatggagttatagattttcagtccagttctatttgataacccataaggtagacacatacacatatacatcttgctaagcttgactgcctcattggtgcatgcagatggatagaaactcctctggtctcctgaaagtttgccagcaaagggagataaaagaactgtcccatttaattatgagtgtgcaacttcaaaggcttctccagactgactggggaaagcctgctgctaaatcttcccattgcagaagggtttccctcttctgataatctcttgtgctccagaggatttcctaaacattttgtgaacactattctcttgagggtatttttttctattattaattatacatgctcatgttcttcattatcattgctgtcaacacagtggtaataaaagagctcatgactagtgagtggcttctgtgttccaaagagatgatgagaatagtggggaagaggcctgttggagattttaattaggatgatgtggctcttcacagtggtggtgatgtagggctcatgaattgcaggaggctattggatcacagtgcatgtgggttttatcctaaaaaaaataggcttgcaggtaaagaaagatgagaggggcattccaagcagaaggaacagagggatagaatctgtgtataggaccagactcagtttgaaattaccagaatgcagaattaaggaagcatgtggtaaaaggtaaagttggttgagaaacaagaactggggggctttttaccttcctgcagacccaggttttattctaaaggcaatgaggagctaatgatggttttaggcaatagagtgctgtcatcaccagatttctagtctgagtgtctgggaaaatgttggtgccatttactgaaatagggaatatggaaggaagctgtcaagtttgtttctagacatctccagcatagagggcaaagggtaagccaaagtttatattttttcccagcctgttgaatatgtgagtcagggtcagggttaaaccaagagaatttcaagttgtaagcatagagttggtggttaaaactatgctggcattcaggaaatgccatttgacaatatcattttcttttttgagatggagtctccctctgttgcccaggctggagtgcagtggcatgatctcagctcactgcgagctccacctcccaggttcacaccattctcctgcctcagcctcccgagcagctggggctacaggtgcccaccaccacgcccggcttatttttttgtatttttagtagagaagggtttcactgtgttagccaggatggtctcaatctcctgaccttgtgatccgccagcctcggcctcccaaagtgctgggattacaggtgtgagccacctcccccggcggcaatgtcattttaagattgcttttgagataaacatgatttgacacaatttaaaataagaaaataagggaggcatataaaaggcagtattttaaaattgtaagtgtgtgacttgctgatatggagcccctttttcctatgggtattcactctcttgtgaaatccataattctgatgttgatcctgattttggactggggttgaaaaattcaaactaactacattatagcgataattcagggtcctgtgagccagtccatctcactgtgagggagtggggtcatggggtaaagatgggtgatcactcctgaactgacacttcaatcctcgtgtaagcttgtgtgcaattcccgcagcgtgtcatttagtcttggagtgcttactctaggctgagcaggtgaagtgtcattaaggaggctgcactggaatctaattttccacctcacctattcccctccaacccctcttccctgttttcctttttctcacattttcctttctttcataccctatgagattccacacagtgggtatggacaggtaggggtaggaagaggtgatggcacaattggctgtagtttgaacaagaaaacatcaatctattattgtgattttatgattcgctggttgaagtgaattgaacatggccagctttccacagcttggctcccacacttagaatgaggaattgaggaaagaggaagaaactcatatttacagagactctactctattggacccttgctgagttcttttataaacctcattccattttatgtacacactaactcagagagggaggcattattgtctatagtttagcagaagagaaaatacattcagagaaattaagtaacttgataaagttcacactgccataaaagtgtcatctgaaaacacatatagcctgactactcatgtaacttaatctccaggtgatgcaaatacaattctccagttttactttatttttctgaggaagaactgtcctctgggtactcagatttttttaaaataaaactaagcttctctgaacatcattacaatctggagcagacatcaacctctgcagtatttcatcattcttacagaatctgtagaattctatatactgtatggtattatgcttattagtctttaaatttttcctaattaacagtctaagttgcagtgtaagaagagtgccatatagttgattattgagtatattaatacctttgtgttatgagacagaagtaacccaatgacatcaatattctctagtctttcatgcaagactagaacataataaggctctgatgaaatgaagttttatttttagctcctattcttgccatcctgagagttttggtcttatttaagtccaagggaagtctctggacggattagtttaagttagctcttttaattgacattctcattttattcattcatttccattctctccatttatctgttcaataatgcatttaaatgtaaatattttatgcctaacacatcatgaatatagggaacacaaatatgttgaaacatggtccctgcacccaccaaataaatcaattttatttacttcttttaatcctgtctgttgttcatcatccacaaaatatgtgtgtttgtgtatgttcatttgcccatacaccaacatgactgttatactacacacatacacgcacccctcaaagacaatacggttgacacaatttgagtgtgactgaaatgatcagggcatgaatgggcatcctgacgtgtcccgactgtcctgtttgttacacccaatttactttctgattctaatataactgctttattcctaatggccgcttaccactcaggtctatttacccaaatcccataattggaaaaatacgctgcaatgtgaccttaaactttatcgttcagctttccctgcctaagaaaattatgaaaatatagggaaagttttggcttagagttacattagtttggaaaatggaatattttgatagaaccatattatgtggtgaaatttgtccctgtggattgtcaaagcattaagaaagaaactaaaggaaatgattaagtatatccagaccacattttcttgaaaggaaaaattaatatattgaatttaaaaaaaatagcaagtactacctagatctaagttattccccaaagcttttctctattgatggtcttcatgttactttgtaaacatgttaacagacgattcaaattcacaggcattttttgatcctttaaaaagaaagaagtatcctctaaagcagagaagtgtttgtctggaatagatgcaactgcacttgtgctgaaacacctgcacctgtttctggagtttggatagcataactccaaagaacacaatagttacaaataaacaagaaaaagtttagttaacaccctttcctataatggcctgagaaccttaataattcctgccttcccagcatggcctttggaccactcaatggctgctcttgctgcaaatcttccttttcgtatgggtattttgggctgcagtcatttttatggtaggtagattataccaacaccaagcactgtattcttccattgtgtgtgtgtgtgtgtgcatgtgtgtgtacatacagagagatctttagagagcatttctcttatttgaattcttctgatgttcgatatcaagacaaacagcaccatgccgaatctttcatctctatttcattgatcttctgcctacacagtttaaaggaatactggttagaagtaatgaaactaaaacctgcaggcttaacatacacataaatttgacaaaccagcatggaagcattgcatttcagatccatgtggcaaattgatctttttttagttctgtcatttgaaagataaagcaatttgagataaggcccagaaaagatagtggcacatcagatgaaggacacaagtctcctgatttcttcttttatgaccttttcactatttgtctattaaaaaaaaaaaaaacctgatgtaatgttatggcagtctaaagggttttcatgctaaatagataccattatctctaaactcttctatatagcaaaacccaacattttcatcttcttgactttatctctaccaaatgattccttctttggcataacttttaaaattggaattgagaaactggtaaattcacaagaaaagttgcaattttgttttataattttctgtcttatctgaaaagcccaatacctgcctgagaatctggtaccaacacctgatatttctaagtgatttttaaactctaccagttaaatatcacaaaggattttgtaggacatgtacagtttcacttaaagtggtatctctaatattctaaaatatattttgacagcacatgactaacttcttgaaatatgtagtatataatttttattactgaaaaagcaaaagttatgtttctgtttcaactctgtcaattaatctgtaataaacatttaaattaggcaataccattgtcgatactatttttattatggtaggctagaattatagaaagtttatccatgcacttttatgcttgcttcttctatgatatacagtaagatatcttgtttagaaaattctactttccccaaacaataaaaccagttctactctccccagacaataaaaccatcaaacactttctgtgccactattttgtcacttaaactggtgaccatacattcgctgactttcaggaacttcattctttatggatggcttatgtatgtcactcatatttaaatacctcttctttccttagcttgaacttgttcaattaatatcaaatcctggtggtaaagcatagaagacatatcagtggatgatttgaggaggaacattggccatcttgaactaaacaatgttctcccactttgatactttcctgtttagggctaaggtcttttatccttcagccaatcacagcaatgatacaatctcttaaattcatcccaatgtgcaagcaattggctgcaggtgtgttattgagaagattattgaggagtcatcacacacatgccaaagtaaggacacatatatattcttcccagctttgcttatagttggcaatgcctggaggtgaagcacgcatttagaagcatgatcctggagaatgttcatgatgttgcattaagtacacaggaaaagaggtgtgggagcttataggctgtattttccccctcatgtttgtagaagagcatcagaaatagcaatgggatataaaaataaagctgcaataatagaattatgttaggggaaaaaggttgagagaattaaaaactgagaaaaataaaatgataagaaaacagaacgtgcctatgggagaataaaggtgaaagaccgccaaagatttcttcctgcaggtctagagcatctgaacttaaaaaacgaaaaattattaaggcttccacagctaatctggcttttgttactaattggataggattccaactttaaaaatctcttttgaataacttctgcctttaggatttgttttattctgccacatgtttttaaagatgtcaacatgtgaatggatttcagataggaaaaaatggttgcttttaaacatggattccgactatgcaacttaagaacgttctcccttcagtcgtgtgtctccctttgtacctgcctttatccccaaggtttctattttattttccctccccagggagggaatcctcctgtggggcacgtcactgcttgtgaattcaggtgggccttagtggcagatgacattctcttgggcagttagggacttcctgggtcccgcatcggctagatgtattgttctaaccttcacagccattaaactttcaagagtggagaaactttttctccctcttcaatctggttttcaatgttattgttaaagtgtcaacaagcaatgttattgttccagtgtcaacaagtctctcgcaaatgtcagcatgttctgtactttgcccagtttcctcacaacagatctgtcgctgaaataaaaccacttgtctccaagaatttcaaagccattggctcctgtgaaacaacagaattgactgtactttaaatgtgaaatatttatgtgttaaaatcattatttatataggcatttccaatgtagatctgtttgcaatgtttgtccttaaccttacatgagggctggaaataaagaaagataggaacttctttgttttgttttttttgagttggaatttccctgtgtcacacaggctggcgtgcagtggcacagtctcggctcactgcaacctccgcctcctgggttcaagcaattctcctgcctagcctcccaagtagctgaaactacaggcatttgccaccatgcccagctaatttttgtatttttagtagagatggggtttcaccatgttggccaggctggtcttgaactcctgaactcaggttatctacctgccttggccttccaaagtgctgggattatgggcgtgagtcaccacgtccgatgggaacttcttaaactgagatgaatgaatggcaaaagccatagaacccaacaacctatgaaatataattgttaataagcataaaccgttacaaaaattcccatactgtaaagtctaatcatattcatatgtcatgtatgtttattaataataacaattttcttttcctttcaactgaggtctagaacagataattatggcaacaatttgtcaaatagactctgttacatagcagatgatcaacaaatgagcatctgaattgaattgaatttgggattaaatgagagatttaaattcagtgatccctaatgtctcattccactttgatttatgattttgtgattttttttttactaaaaattagttaaatggtgaaaagcttctacatatgtgtattgtccagtttcttcaaattcagaagatggaaccgcaaacctcaaggaatattagtaaaatggtctagtctttactggaggccaattttcatattggatgatatacattaatatcagatgctaaagacagcatgcattttcatccattagcatttctatgtacttttaaaaagtgtaattccacttttaaaattcttcatgcatttttgcagcaattatagaaatctactttgttctgtatctgcggtgatgagtagcttcatgtttattaggaattatggaaagctcagttgaaactatgctttcctctacttgcttataatgtgggaactgatgaatacaaaaaccagtagctcctttttatgtagcttttaaactatttaatgtacttccgaagaaatgtggattgataatatattttcttcctttttaaaatgaagaaactgaaactcagatgtggtcatttgaccagccccactctgtaggaagcagaatcaggatttgaacccattattttattgataatgtaggtcgatttttgctaaaccacaccgtttctcacaattctttgcaaactgtatattcatgtgttgaaaaatttaatatcttttctgacttctttggaatacactaggctaatcttcaaggattgtaaactccatgtaggttactggttttactctaagggtctccaggctaaacatgtagtatttgcttaaaaagtgcatgaaaataaagtgtggagactccataagataacattctgcttcggtgaagtaaccaaaacagaaattaagaaaacaattttatctgcggtcgtgtcaaaaataatatacttaggaataaaattaaccaaggatgtgaaagattattgcaccaaaaactgtaaaacattgatgagagaaattgaagacacaaataaatggaaagatatctcatgatcatggatcagaaaaatgaatattgtcaaaatattcacactacctaaggtgatctacagattcgttgcaattcctatcaaaagtcccatgactgacacccaactgattttcaacaaaagtgctaagaacacacattggaaaaaagataatattttcaataaatggtgctggagaaattggatatccatatgcagaagaatgagattaaatcactacttctcatgatatacaaaaatcaactgaaaatgcattaaagtcttaaatgtaaaacccaaagctacaaaattactagaagaaaacataggatagtactttactgtgggcaagaatttttaaaataagacctcaaaagcaaagcaacaaaaacaaatagataaatggaaggacatcaaactgacaagcttttgatcaacaaaggaagcaactaaaagaatgacaaatagacctacataatgggagaaaatagttgcaaactatatatctgacaaaggattaatattaagaatacatagggaacttaacagcaagaaaacaacccaagtaaaaataggcaaaatacattaataaatattgctcaaaagaagacattcagatgtccaacaggtatatgaagatatgatcaagatcactaattgtcagggaaatgcaaatcaactccacagtgagatacctcttcactccagttagaatcggttttattatagaattataataaaaaaagacaaaagaaaacaaatgttggcaagggaggtagagaagagaacactgacacactgtgggtgaaaatgtaaattagtatagtcactatggaaaactgtatggaggttcctccaaaaattaaaaatagagctgtgatatgcatataattcagtaatttcactactagatatatatccaaaagaagtgaaatcaatatgtcaaagatatatctgtacccctttattgcagcactatttacagtagtcaagatatggaatcaacccaagtggccattaacagatgaatggataaaaaattgtggtatatatacacaatggataattctgccataaaaagaaagaaatcctgtcatttgcaacaatatgaatggaactggaggtcatcatgttaggttaaataaggcacagaaagaccttatttcaaaacctaaaaaattggaatctaaaaataaaattgaaatcatagaagcagagagtttaaaatgtggttaccagagacgggaggaggaagatgggaggatagggaaaggttggtctgtggtccaagttacaatcagatagcaggaataagttcaacttctattatacagtaggttgaggacagttaacagtaagatatggcatattataattagaaaataattagataagcttttgaatgcccttaccacaaatgataaatgcataaggtgatcatcatgtgaaataccctaatttgatcataatgcaacctatatatgtatcaaaacatctgattctaccccataaatatgtacatataataatttttaacctctcctagcatttttaatagtaataacaaaaaaatcttaaaattcacatggaaccacaatataccccaaataactaaagcaatcttcagcaagaacaaagctgaaggcaccatagctcttgatttcaaattatattacaaaactatagtaattaaaacagtatggtactaacacaaaaacagacacatagaccagtggaacagaatagacagcatagaaataaacccatacatttatagccaattgactttaaacaaagatgacaagaacacacaatagggaaaagacagtttattcgataaatggtgttgggacaactggatgtccacatgcagaagaaagaaattagagtcttatctcatactgtatataaaaatcaactcaaaatgaattaaagacttatatgtaaaacctgaaattttaaaactactcgaagaaacgtaggagaaaagctccatgccattggtcttagcaatgatttttttttggatataacaccagaacacagacaacaaaaacaaaaataaatgagtgggactgcattgaactaaaacgtttctacagcagcaaaggaaacaacagaaatgaaaaggcaacttctggaatgagagaaaatatttgcaaaccatatatccaataaggggttaatattcaaaatatatgagttctagtccatttttgcattgctacaaagaaatacctgaggctgggtaatttataaagaaaataaatttattttgggccaggcacatggtggctcatgcctgtaatcccagcactttgggaggccgaggtgggcaaatcagttgaggaaaggagttgtagacaagtttgaccaacatggtaaaaccccgtctctactaaaaatacaaaaattagccgggcgtgttgacgcacacctgtagtcccaactactggggagggtaagacatgagaatcacttgaacctgggagttggagattgcagtgaaccgagattgtgccactgcactccagcctgggcaatagagtgagactgtgtctcaaaaaagtaaataaataactaaaaccaaaaaaccaaaaacaggtctattttgactcacatttctgcagtctgtacaggaagcatgccaccagcttctgttcctggtgaggtctcaggaagcttctgatcatggctgaaagtggaggcagagctagtgcatcacatggcgagagagaggaagacagagggaacaaaagaggttgggaggaggcgccacactcttttaaacaatcagatcttacgtgaactaccagagcaggaactccctcatcagcaaaaggacagcattaagccattcattagggatctgcccccatagtcaaaacacctcccaccaggccccatctctagttttggggattgcatttccacgtgagatttggagaggacaaacgttgaaactatatctaactcatacaactcaatagcaaaaaaaatcaaacaaccagattaaaaaaatgggcaaatgacctgaatagacatttttccaaagaagatatgcaaatggccagtgggtatatgaaaaaagtgcttaacatcactaatagggaaatgcaaatcaaaaccacaatgaaatatgacctcacaactgttaggatggctgttatcaaaaagtcaaaagatagatgttggcagggttgtggagaaaaggaaaacttccatgttgttggtgaggatgtaaattgatacagccattatggacgatactatggagtttccttaaaaaatcaaaaagagaattatatgatctaggaatttctggatttatgtacaaaggaaattaaatcactatcttgaagagctgtctgcactcccatggtcactgcagcattactcctaataaccaagatatgaaaacaacacaagtgtctgttgtaagatgaatgggtaaagaaaatgtgagatatatatctatatatgtaacatgatgttttgatatgcatatgcataatatgcatatatttacatatgtgtgtgtgtgtatatatatatctatatatacacaaatacccagtggaatagtattcgtcctttaagaaggaaatcctttcatttgccacaacatggatgaacctggaggacattctgctaagtaaaataagccagacatagacaaaaaaacactgcacgatctcactcatatgtggaatctaaaaacgttgaactcttagaaatagagtagaagggtggttacccagggccaaggggtaggagaaatggggagactttgcatacaaactttcaaagttataagatgaatacgttctggagatctaatgtacagcatggttactatagtttgtaatactgtctacttgcattgtatgaggagagtacatcttagatattcccactgcacatagacacacacacaaagttaactgtgtgaggtgatggatatgtttattatcttggttgtggtaatcatttcacaatgcatatgcatatctaaacatcatgttacatactttaagaatctacaattttttggtcacttatacctcaataaatcttggggaagaaaagagcgacctcttctgaattctagatttcatgctttttgtcagttcatggcccccagtttgaccgtggttgtgagaccttaataaatagcgatccattaaatggttaatttaaaaaaatcctgctctgaataatattccattctttggatataccacagtttatttatccatagaggaatcttagatgcatattaccaactgaaaaaaaaactgaaaggactacatatactgtatgactccaactatataacattaaggaaaaggcaaaattatggaggacagtgaaaagatcaggttgtcagggattggggaaaggtgtgggagagggacggatgactaggcagatcacagagggttttcagggcagtgaaattactgtgtatgagtagtgaattcatgtcactatatgtttactcacactcatacaatgtacactaagagtggaccctaatgtcaactattcactttgggtaatagtgatgtgtcaatgtacgctcatcagttacagcaagtgtacttctctggtgggaattgttgataatggagaaggctatgcacgtgagggagaaggaggtatatggaatatctccgcatctctctcagttttgctgtgcacctaaaactgctctaaaaagaaaacagtcttaaaagaatatgtactctctctgatattgtttgttagcgtgctctataaatgttaattatgtctactgggctgttaatgtcaacttttctatatccatactgattttaatttcactaattgcattaattactgagaaaggagcgtttatatattaaaaagtagtctaaaaagcaaaaaaaaaaaaaaaaaaaatcctgcttcaaaaatacagttagtccttccctgtgactcccctccatgcaaattaattgccaaatccaccaaatactcctttccgttttttctttttttgttgttttttttgtttttttgttttttttgagacggagtctccctctgtcgctcaggctggagtgcagtggcatgaacctggcttgctgcaatgtctgcccccctgggttcaagtgactctcctgcctcagccccctaagtagctgggattacaggtgcacgccaccatgcctggctaattttcatatttttagtagagaccggggtttcaccatgttcgtcaggctggtctcaaactcctgacctcgtgatcttccctcctcgccctcccaaagtgctgggattatagacatgagccacagcgcccggcccaaatactcctttaaggccccagcaaaccaatacaatcacatgcacctggaatttgacagcttgaagtttatagccttactaaactgtttatcttatctgttgcttttctctacccctcaagatcaattcatataagtcagttatttaagaatttgagaaaaatgtgcgtttgccttaatatgttatattatgttcatcaagatcctgactcatttgtgacatttgctgttagaatgaaaactaattccaacttcattatctttatgtacatttttattttttgccactctcactgtgaaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaagtgaggtctctcagggcttcccacggcctctccatcacaattcaaatgaattcaatgcacacacatctttttgtttgtttgtttgttttttgttttctgctttttggtttttttgttttttatttttttattttattttttattattatattttaagttttagtgtacatgtgcgcaatgtgcaggtttgttacatatgtatacatgtgccatgatgatgtgctgcatgcattaactggtcatttagcattaggtatatctcctaatgctatccctccccgctgcccccaccacacaacagtccccagtgtgtgatgttccccttcctgtgaccatgtgttctcattgttcaattcccacctatgagtgagaatatgccgtgtttggttttttgtccttgcaatagtttgctgagaatgatggtttccagtttcatccatgtccctacaaaggacatgaactcatccttttttatggctgcacagtattccatgctgtatatgtgccatatttccttaatccagtctatcattgttggacatttgagttggttccaagtctttgctattgtgaatagtgccgcaataaacatacgtgtgcatgtgtctttatagcagcatgatttataatcccctgggtatatgcccagtaatgggatggctgagtcaaatggtatttctagttctagatccctgaggaattgtcacaccgacttccacaaaggttgaactagtttacagtcccaccaacagtgtaaaagtgttcctatttctccatatcatctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttctcagatgagtaggttgcaaaaattttctcccattctgtaggttgcctgttcactctgatggtggtttcttttgctgtgcagaagctctttagtttaattagatcccatttgtcaattttgacttttgttgccattgcttttggtgttttagacatgaagtccttgcccatgcctatgtcctgaatggtattgcctaggttttcttctagggtttttatggttttaggtctgacatgtaagtctttaatccatcttgaattaatttttgtataaggtgtaaggaagggatccagtttcagctttctacatatggctagccagttttcccagcaccatttattaaatagggaatcctttccccatttcttctttttgtcaggtttgtcaaagatcaaatagttgtagatatgcggcattatttctgagggctctgttctgttccattgatctatatctctgttttggtaccagtaccatgctgttttggttactgtagccttgtagtatagtttgaagtcaggttgcgtgatgcctccagctttgttcttttggcttaggattgacttggcaatgtgggctcttttttggttccatatgaactttaaagtagttttttccaattctgtgaagaaagtcattggtagattgatggcgatggcattgaatctgtaaagtaccttgggcagtatggccattttcacgatattgattcttcctatccatgagcatggaatgttctttcatttgtttgtatgctcttttatttcattgagcagtggtttgtagttctccttgaagaggtccttcacatcccttgtaagttggattgctaggtattttattctctttgaagcaattgtgaatgggagttcactcatgatttggctctctgtttgtctgttgttggtgtataagaatgcttgtgatttttgcacattgattttgtatcctgagactttgctgaagttgcctatcagcttaaggagattttgggctgagacaatggggttttctagatatacaatcatgtcatctgcaaacagggacaatttgacttcctcttttcctaattgaatgccgtttattcccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatacatcccatcaatacctaatttattgagagtttttagcatgaagggttgttgaattttgtcaaaggccttttctgcatgtattgagataatcatgtgatttttgtctttggttctgtttatatgctggattacagttattgatttgcatatgttgtaccagccttgcatcccagggatgaagcccacttgatcatagtggataagctttttgatgtgttgctggtttcggtttgccagtatttgattgaggatttttgcattgatgttcatcagggatattggtctaaaattctctttttttgttgtgtctctgccaggctttggtatcaggatgatgctgacctcataaaatgagttagggaggattccctctttttctattgattggaatagtttcagaaggaatggtaccagctcctccttgtacctctggtagaattcggctgtgaatccatctagtcgtggactgtgtttggttggtaagctattattgcctcaatttcagagcctgttattggtctattcagagattcaacttcttcctggtttagtcttgggagagtgtatgtgttgaggaaatttatccatttcttctagattttctagtttatttgcgtagaggtgtttatagtattctctgatggtagtttgtatttctgtgggattggtggtgatatcccctttgtcattttttattgagtctatttgattcttctctcttttcttctttattagtcttgctaccggtctatcaattttgttgaacttttcaaaaaaccagctcctggattcattgattttttgaagggttttttgtgtctctatttccttcagttctgctctgatcttagttatttcctgctttctgctagcttttgagtgtgtttgctcttgcttctctagttcttttaattgtgatgttaggttgtcaattttagatctttcctgctttctcttgtgggcatttagtgctataaatttccctctacacactgctttgaatgtgtcccagagattctggtatgttgtgtctttgttctcattggtttcaaagaacatctttatttcttccttcatttcgttatgtacccagtattcattcaggagcaggttgttctgtttccatgtagttgagtggttttgagtgagtttcttaatcctgagttctagtttgattgcactgtggtctgagagacagtttgatataatttctgttcttttacatttgctgaggagtgctttacttccaagtatgtggtcaattttggaataggtgtggtctggaatgcacacacatcttaatttaaaaaacagctgagatccctgaatgaggggctattagtctttttagaactaataataaatccaatttccatgaatgaaagtacatggagaaatatgattctctttctctctttatatatatcttttgcacacagacactctcactcactgtcaggctactttagccttaaggtatgttcaatttcagttcagttcagttcaatgttacattaaaaaacacagtttagacgtttgcttaaagttttctgaatgagaccatctaattgtccactgacatttatgaaacccagtaacattattttgaggacagtgttggcttttgaaaattcattgtataaacaaatagctatgaataagcttttgtcatttgagaaggaaggcatgtagcctcaggtgtgttcttggtatcagatcagtacaaattggagaaggacaaattcatctagaagaacacgtgttccattcctcttgatttatcaaaataagaaatgcaatttcacttcccacatgagaataacaaagttaatatgaaatatgcttttgaagaagtcgtaattgacattattaccaattttgttcaagaaaggaaacaaagactttcttcacttgaacattagatcagaaatttaattttatgttgcgtttttcttttttaaaaaatatatgttaatagagatataattcacataccacaaaattcacataccactcagtattttgatatattaacataattatgcagccatcaccactgtccagttccaaaaaaaaagtttatcatcataaaataccctgttaccctatagcagccactccccattctcttgtcccagaacccctggaaaccaccaatctactttgtctctatggacttgtctattctgagtattccatacaaatggaatcataaaatatgtgatcttctcgcatctggcttttttcacttagcataagtgtttgcaaggtttatcaaagttgtagcatatgtcagtccttcattgctttttatggctgaataatatcctgttgtatggatacaccaccgttatttaacccttcatcagttaatgggcatttggacataggatttctactttttggtcgttatgaataatgctgctacaaacattcctgtgcgactttttgggtggacatgtcttttaatttctttggggtctgtatctgtgagtggaattgctgggtcatagagtgactctgttttaccttttgaggtagcacaggaccgtcttcaaaatgacaataccattttacattccaccagcagcgtgtggagtttccagtttgtccacatccttgccatttcttggtattgtctgtctttttgattctttagagtattctttataaagaaaactccataaagtgtctcaggttgtttgcagcacagatattttctcatatccattattttcccctaagggttgtaagtagaagagtggaggagtaggatatgggtataataatctttttaatgtcaaaagtatttttgactagccctgtatttcaccagtaaccccagacaggaaccattgttctatctgcattggaatattgtcattatagtgctgcataagccatcatgcttttaaagtaacaaagattgaaattcatatccctcagactgcttagttaccaacacttgtaatctacagcaaaaaataattttacattattattttacatttacacaaagctttatctgttgggcccagacatgtaaaaaaaatgaccataggaaggctaaccactgtctcttttttaaaaaaaatgtgtgtgtattttcaaaaatgtattataatcctagggacaattccatttcaaattaaaaaccttgggaagtaaagaaaatgacttcatctcaaaaatagatttttgatcttgaggatactttttcagttacatttaagttagagaactttaggtacagtgatttttactgttatcttaaagtggtaaacaaagcaaagggtgatctgatatcttaaaacattatttaaagggtttacatttggtaaaattatttaaactccaaatggttatgttgctagtagaagtaaacagaacagaaaccaatagggatatgcacttatattttaaaacaaagaaatgaacaaaatgtatacttttaacaaatgcttttatattttgaagttaaaaatgtcaaaccatataatagaaagataagaaaagcatacaaaatagctctcaaacagagaaaatcactgtaagtatatacttatagcaatggtttttcatttgtctctaaattttttaatatgtagaacaagtaaaatgaaattattggggacttaatatattgatcttttataaactccactaggtttttcctcaaacatgcatgtttcctgtctttctggagattcactaacttatttagctaccattttttaagcaatagagtatgtttaaactttattttattaaaaaggtgttgagtaaatgtatagaattatgatttttaaaattgtttataattcatttcagcctcttgaagtactttaaaactaaataagcttcatcagtttccttacatgagcaaagtaattttgcagggaatcatgacagtatgtaagatttttgaaaacgaaaaccaagaatttatgacagccagttgagtgcctttggtcaaggtcacggaccctttctttctcatagtgctacatctgcaaacacattggtactggatgttttgaagcaaatgaccagtatgaaaacttgtaaagagttcgttttgcaatttatgaatgaaaactgcagctgtggttacatgagttaggaaagcaattataagacccatcagtttctcaatcctgacagccgccatcacctcaccagctggaaaaaaaaatcctagaagaatatactgaagtttgtcagggaccaggtgaaggcaatatatatatatatatatatatatatatatatatatatatatacacacacacccacatatatatgtgcatatatgtgtgtatatatacgcatgtatatatgtgtacatgtgtatatgtatatatacatatatgcgtacatgtgtatatgtatatatacatatatgcgtatatgtgtatatgtatatatacatatacgcatatatgtgtatatgtgtatatgtgtatatacatatatgcgtatatgtgtatatgtgtatatatgtatatgtgtaaatatacatgtgtatatgtgtatatatacatatgtgtgtgtatatgcgtatatatgcacatatagacataggcatgtgtgtatatgcgtatatatacacatatagacataggcatgtgtgtatatgcgtatatatacacatatagacataggcatgtgtgtatatgcgtatatatacacatatataggcatgtatatatgcatatgcgtatatatatacacatatctagacatgtatgtgtgcatatgcgtatatatacacatatatgggcatgtatgtgtgtatatgcgtatatatacacatatatagacatatgtatatgcgtatatatacacatatatagacatatgtatatgcgtatatatacacatatatagacatgtatatgcgtatatatacacatcatagacatatgtatatgcgtatatatacacgtatttagacatatgtatatgcgtatatatacacgtatttagacacgtacgtgtgtatatgcgtatatatatacacgtatgtagacatgtatgtgtgtatgcgtatgcacgtatgtagacatgtatgtgtttatgcgtatacacgtatgtagacttatgtatgtgcgtatatgcgtgtacacgtatgtagacatatgtatgtgcgtatatgtgtgtacacgtgtgtaggcatatgtatgtgcgtatatgtgtgtactcgtgtgtagacatgtatgtgcatatgtgtatatatacgcatatacatatgtatgtgtgtatatgtgtatatatacacatatatagacatgtatgcgtgcatgtgtatatgtacacatatatagacatatgtatgcgtgtatgtgtatatatacacatatacacatatatatgcatatatgtgtatatatatgtgtatatatacacatatatatgtatatatgttatatagcatatatatgatataaggctatccttgtatatatatgtgatatatatatatgctatatatatatatatgctctctctctctctatatatatatatagccttcacgtggtccctgatatacttcagtatattctattaggatttttatatatatatatatatagccttatatcatatatatatgatatatgtatcagaaattaagttaaatttctaatttcttatttctgctggtggtgactaagtgtgatcattatgtcttgaaggtagaataacttagatgatgtcttacattctgtatcctgtgattccttgatttctataccatattggctgtagatatattttcatgtaactagatgtagctcatatagccattatagatataaagacattcgtcctaatttcggttcctgggagtaaaggtgggaaaacactttctctagtctcctagtgttgtgctcaaaaactataatggcttatggtaggctaaacgttagttttacattcttcctgattaaagaatacatcattattattatcgatgttctcctgagcatcagtttgactttggtttaaaaaaaatgtgagtaaagttaatttgcatcacatctgagcagaagctataagaagcagtgaaaaatctgccattgtctcaggcaggaggatttgcagtgctggagatcgtctctgacccattagcttggctctctgaatgaggatgggcaggagaaacctctattaatccaccaaggttctatgatgtgaatgagaaagaaacacctgttgttttaaacaagtgagattttggagggaggtgttcttgcaggagaatccctgactgataatcggttccccatataaaatgtagggaatgtggttaagccaagataaacaaacacagcaaaaatcatgtttacataatttatattttgtattatatacataatttataaatgccataatttatattcttgtagcaggattcatgtacaaatctcttagtattgattcttggatatggaatacataggtctaaaaaaaccatgcatatattttataaatgatgtgtttatgctcttctgtcaacagcatttatgtgcactttgtcaacaggtaaaatgataagaacattgaatacatttttaaaaatttcctaaaaacacaatgaggtaggaagacgtataattattattctttttacagaagaagaaattagatatctgaacagtttgccattttacataattgcaatggtgcaagtttaaaaaaaattaatacatgttctctgactccaaggttgttgttttggataacttacaggttcttgttacatgccaatttattggacaatatatattaaacatatttcctgttacaaatataattctgcagaataattgaaatggctgcataatattccattatatagttgtagcaaaataattcaatcaatcctctttttattagatatctatatgttcttttattcaagttctaaatgccataatttatattcttgcagcaggattcatgtacaaatctcttagtattaattcttggatatggaatacataggtttaaatgaaaaaaaataagttaaatattttgaagaaaaaagtccaatttataatctctaaaataaattatacaggtgtgctctcctgccgggggcttaagaaaagtcttcttcccccaccactagtgacaatttaaattatcagttagctcttctcaatgtatattgctgttggtgttacaaacttttgccatttatcaaacttctttcattgacttctataatcatcaaaacgaatgatttatctgcaggcattattattcagaggcttgtgttttcagtatttgccttctttgatcatcgtttgtccttgtgtctaagtcatcctttcatttgatactgcaatcccatgtgcttttcttatctgtcctgtttgccctttggttttcttttatcagacttgttctatgcggtattgcatatgttttagttccttaaacacataaccatacacccccataagggaaggtgtgaaatgggggaagaatgatagatggaggctaattatttaatattgtaacttctagaaaatagaaaccatgtcctcatttttatcaattagcatgctttaattaatgaattaagaattgtttcaattcccttacctaggaacatactttcaaagaatagtagcatgccaaattctcaccatctggatatttttcaatgaagtcacaatttatctttcctttttattgggaaagcccatctttaatttcctgttttatttttcagagaagttttcatgatacatgctttctttcctttttttttttctttttgacctgtgtgttttttactctatgtaattttggacagctgaatcattacctttcttattcatgtttacagagagtttatttatttggaacaaagagaaagtttaaaaatttggaagttctccaaacattttcagttaagcagcataccatatacagtgattatgattatattttaaaatcctttgtggcttaactaaccatcttatcataagtttgctgctgcaggaaatgtgctgagtgtttaggtaacaagggaacccccaatgtgttcttccagtagtactttgagaaagcaagtgggattcagatttaccctattctgtgctttctgctagattgattcattatttctgccagtgctagaggaccctggaatagtcatgaactgagttatgccatttgaaacctagtttttataaactatagccaaagatgataaataaatgaccctgcaaaattaacttatttactatttcttatccaagaggaatggtcctgcttttagtgtgcatcaaatagggagaaatataaatgaattggtgagttttttcagaaggaaaggcctggactttgtcatgttatggacattaaatgacaagaataagcctgcataccaccagggagtcttccatgcacctttgatcatgctttgaactgacaatgcccactattatgggttgtatatgctctattaccatgcaatagcccataatagtaatattatatgtagaaatagaagagcctgtttatcatttgctttctttatactcattatgatatcttaaactgtatatgcatcatacatttcagaacatgtcgggaatgtaattgttatttattatgaggttattaaggatagtactgatatgagaagactgagatggagggagaattaaatagggtgcttctggtatcctttatctatctttatgatgcacttggatttctgtgttgggacattgtgtattctcatagagatagccaaaggtgcaggtgctcagaatagtcatctacttgaaggtcctagttaaatccagtattaaatctctcagtcatatgatgaagcagcatttactaagctaatgacataatctgcatatgtgaaaagaaattattaaagggaatggaaaagagccttgttaaatagaagagacgatctcattcaggttgatttttcagagattcccctttgcagtaggtatttatgttccttatttctcctcttgtgtttgatcttgcctttcatcttgctattgttatattcaacagaacagagagaaaagaagaatccagaagctgaatttaatacttttgtttatttttaagagatggtagaaaataattcagtggaaaataataaacataatatattttaattaactgaggtttttctaactaatagtccagaaaactgtattactaccaagtaagagagagtatttttttcctgttctaaataaacaatctttatctatggcaacagaacagtttgtatcaaagataggaattgatccaaataaatagacaagtttcattacattttgcattatttttatgttgtaagttgaaaaccagtgaaattctttggctaagataacttcctagtaaagactgcaaccagtattgtcaaaatgtatttgaaatgaaaatagaaaattggacttgaatttaattccaatttctccaggcaagcttaaaataaatgtgacagttatgaaaattttgttactatgattatatatttatttctattaaaatactaaaattatagtgcagattgtagtggagagctttagcagttatttacctgatttcattcaatataaacaggcaaaccagatacttttatgggaaacaatttgctctggttatcagccataatcttcatagaatcagcctcaacagatgttctttctaatagaaaaccaatgaggcacagtgttatccctttgtgtagcctgtagagtcacatagctgatcagaacctgcgatgcccctcttaggatacacaaaacttaatagggctggtcattgtgctatagttgcaaaacgaatgcagatactctacactcacagcatacagacaacatgtacatcatattttcataaacgatgttgcttatcataatcaatctaatatttattgatcttaccaccatgtatctctgggctaagctagtggtcagaaaactagggttaggcctacattctctttttgtaaataaagttttattagatcattgccatgctcatttgtttacgtatagctactttcttgctgtaatggcaaagttgagtagtggccacagagagcacagggcccacaaagcctgaaatatttctcatgcagccccttacagaaaaaacctgctacccctgagctaagcatttgtgataattgtgacaaatatgtcgggagaagggattgagtgtcttgagaatcagaggaagatgacatttgctcaatttgtgtgcaaatatggcttcatgaaatgagtgaacctagtgggtatctgcagagatgagtagtagcattaggcagataataatttagaacaaaaataaaaggacatcccaggtaggaggaagagcagggacagaaactctgagttatgatgggaataatgtgtaaagaacaggaagcatactcacttgtgatgatttagaaaaaataagaaaatggtgggagacagcctggggggaaatatgtctctccctcccacctaacttcttcttgtgtgattgacaggtttcagacagaaaaatccacttctttgcagagctctctatgtcataattgtcttatgaggttaattgttagtaaaatgatgtcatagaaatgccaagttaacgttgcttcatgcccatccattgggtcattgctaaaatgccaagttttatttaactgaatttagcgagattcaagtttttccatgaacaagacaaatactttaacatcctttcatgtgcccttctgcacctcgtatcatgtttacttaactactgacagaagatgagaaaacaagcacaaatccaaaattgttttattcgaaggcatttatatcagcaaagtattaaaatgacaactgtcagcagtcagatttgtattttgagaatgagattactattatctagatattgggtatgtatatagatgcctacatgtttaaaatgggaaagggtcacgttgcacagttagttgaacagtaagctactgggatagaggtgggcagaccctgagttagtctgggttcagtcactagccagctgtgtgacccagcaagtcatacactgaactggcagcagaacccttctcggtgaccttgaacttagctccataagcttgcattgcctccctttaacctctctttgcaataagtgaatttgacactgtgttctgactcatccggacccctagattttatatctactcaaatggacaccatgcctgtcatttctgacataccttcatagcagactttgtgtctggttttgcaaagctaactagacagactaagatctgactaactacgtctcatgagaatcatgtgactaacccatcgttctttcagactctgctttctaccaagagtctgcttgggattcaaactaatatattcttcagttatggcattctttcctttggaatataacaatttaagatggatgagattttggttctccataaatatttatttttcatgtgttgcctactatttggataaaggcaaaaaggcaagattctttggcttcctatttaagtttataaataattttggcctctttgatgctcaaaatattcatgccatgtggatgttggtaaataataccaaatggcctggcatggtacagttgtaagctgcttaagatttggatggtctctagggtgaaacagcaaatattttgaggtcatgtataaagtcctttataaagatgtgaactcttttgccaagatttctttgcagagccctgtattgtataatagttaaccaaaggaagttaaaaggaatgtgaaaaacataagaaaatatggagtatgtagtgcctggtaaagtctctcctactgcttcctttaatttgctggaagtctgggtatggttaatgatactgttgaattatagttgcaatggtgagagagaattgtaaaactcaccctcttgagtgtagcttaatgtaattataaaaaaaaaggtggtagcaaaatccaagtgacataatttatgcttgagtctagatatattctggataactctacatagagaggaaaacccagagggattgcagtttttaggttaggcttcttagtaaataagattttggatgtgttaggaggcctggagtcttgtgaccacacaagggtatgacagggtgagcacagggcgacactattcacccctgctcatctattcatcagtgatactctcctcttcactggcaaggtccctggaaacactattaacaggcatcagtttcttgttcgggtagaaagacacacatgctgccaacaccgtgccttccctcagcgtccgtagcttatcaaaacagccaggctccaactgtgagggcgtgtgctctgagggggcagggatggaagagatggccacgtggctgcatgacaccctcatagagctgatgtctcacaccacttattattaatgtgactttgtagagttttgtatttttaaaaaaactttttggacccttaactttgttatctataaaaatggcattagaacaattgctgtttactctgaaatgttgttgtgagagacccttgaaacagtatatatgaaacttctttgttaactttaatatacaattttacgggcttacaaggttttaagtagatggcataaaaatgacctccagggcatacgatttaatagagaaaacaaggtcaacgttcattcattcattcattcattcacccagtcaacatatatttaccagggtcctcctgtgttcccagaaccactctcagtgctgagaaaaaatagacaaggcaacggatgtcatagagtttgggaaaataagttaaaccagaaaacaaataatttcagatactcctatgagaagggaaatcaagagaatataagagagtggccaagatgaagtctgggggctgctgtaagtacggagggcagggaccctctcccaggaagtcatatttggccagattggagtattgaaagtgggccacatgacaactcagggaagatggcagaggaaacaggaaaacaatttcagactcaagggataaagttttctggaaggagatgtaagtcaggtgggcttcatcctttaaaaaaatcatggaggagatgagggcacttggagagcttgcagaagtatttttaaaataccagtgctgagttcccacccgacttgatttgtctgcaatatggcctgggcgtccgggattttaaaagctccctgggtgactctgctgagcagccacatgaagactcaccactctgcagggttgtataacaggcacggtcctgcagcaggaggatggacactttagtttttgccctacttcccactgagcaaacagggctttagggagtgcttaaaagttgcacaaaacttattgctctgtggtgtcctttcccaaagctttgttgaatagggataggagggaaaggaatgagtcagggacaagaggggtgggtgggtcgggtaggggtgtagagagaaatacagagaggagatcttgaacaatgaaccaccttaggcacgtttgaataccggcagcatacaggacaatgattatttgttctatatgaaagataattggctgaatagatagaattgtcaaagagtccagaaaaggggctttgtcagaaatgcattttgggttttcgccatagataatttctgctttgaaaaataatatggaggaatgtatttagccactctttttcctagaatagccatggtgatatttaataataaaatattatttagttctgttaccacaacagtactaattgttttccatgttgtcttttttcccatgcatattttcttatgtgttgaggagaggcattcctcaggattatattttccttgttaatgaaactaagaattttgtggatgagtctgtgtaggtgcagtttgagcacattttccattattaaatcaaagaactgaccagcgaatccatatcagctccctacaatctgttcccagcccagccttcctgcttggtccgctgctaagctggctccttgtctgctttgtccccaggtttttgtttgggctttcgcagctacggtgagaggcgacacttctgagaagtgaggcgcatgctcaggggagcaatgagccaaggcgagtttagcagtaaaaccattgcatgttgtccagagagaggctcctcaggaccaatgctgggagatagcccagagagagttaggctgtcctcagatgctccccagaaacccttcatttgcatagtgcttcttttgaagagcccgattttgaaacaccacttctgtcttagctgcaggtgaccccttgtgatccacattggaggtataccccaaccctgccctcaggttagattcctagggctgcaaaaacaaatgaccacatatttgatggctgaaaacaacagaaatttattcccacagctctggagatcagaaatttgaaattgaaaaatgtcaggatccctcccaaggatctaggagagaatccttccttgctgtttctaacttgtggcttttggcgttccttggcttgtgactgcatcactccctgctctgcctctctcttcacatggctatcttacctgcctctctgtgtgtccaagctcccttctcctttctcccataagcacaatagtcttcggacttagggcccaccctaaatccaggatgattcagctctagtctttaattatatctgcaaagaccctatttccaaatgaggtgacaccctggggtcctaggtggacatgaattttgaggaacactattcaactgattataccctcttaggggaaatcaagcccgcttctaccagagatatttattcagaaaataaatgtcttatccaccatatactactttatttgctgatttgtgcacattactttggcctgaatgtttgtgcccttcttaaaaattacatgttgaaacctagccccaaagttgatgatattagaaggtggggtctttgggaggtgattaggtcatgagggtggagtcctcatgaaagggaatggtgctcttacaaaagagaccccagagtgtggtagtacatgcctgtagtcccagctactcaggaggctaaggtgggaggatttcttgagcccaagagtttgaagctgcagtgagccatgatggcaccactgcaattcagccgggaagacagagaccatgtctctaaaagtaattataataataataaaataataaataaataacaaaagagaccccagaaagctagcttgacaattccaccatgtgaggacacagtgagaaggtgccatctatgtgtaggaagcaggctctcgctagacactgcatcttccggtggcttgatcttggacttcccagactccagagctgcaaagcatagatatctgttgtttatgagctactcatctatggtatattttatagcagctcaaatggactaagacaagtatcaaagttcaattagatacagcgtaaaaaagaaagagaaaaacataaatcattgcagtagaatgtagtaaatgctctgacggagatatttgaggtgctctctaccagcaaaattaagagggtgagggaggtcttgaatggtcagaagtttgctcctggagaaatggggaagaatatgtccaagacaggaaatcccatcacgaagcacagaaagatgaaaggatatgataagttcaggtaattgtttcatccagcttatgtatatccaaggtaggatgggagtctttatttgtaagtagatctccagtgtgaatatgaagtattttggcttaaattctgggggtataaatctgtttcataaaactttccttctgtggtataagttgctcagaactctgagatcggctttctgccttcatagctagttttctttctttttctttttataattgtttattttttttaaatggagtctcactgttgcccaggctggagtgcagtggcgctatctcagctcactccagcctccgcctcccaggttgaagcgattctcctgcctcagtctcctaagtagctaggattacaggcatgcaccaccatgcccggctaatttttgtatttttagtagagatggggtttcaccacattggccaggctgttctcaaactcctgacttcaagcgatctacccacctcgacctcccaaagtgctgggattacaggtgtgagccgctgcaggcagccgatagctagttttctgagaggtactctctgatgtgcttccttggccagaataatctgcattgtaatgagggagttggggaatcccatatccagggactcttagcctggaattcatgcaaccccagaggatggttaggtatcagacaatgagaacaccttaaaatggcacaaatatattgtgtttaccttttaatatttttgtgcagaaggagtccatagcttctttggctagattataaaagggctccataatatcaacaaaggtggcagtgatttagacatctctgcataaaatcaaacaaagacttttagctgtcacaatatattattttgagctacatatgctttaactaggtactgtattgtttactaagtaaattagtaaattattcaaaaggtagtcaaacatagaagtaccttgtgatatccagttttatttatagtttttgattctgcttttaaaaaattggaataaaaaggtagaccaagccccaaattattttactataagtcataagaatttgtcactgaagtttcttttaaggataattggtaacaagcagaagttcaagcagagaaaagaattcctctcctgttttactctcagaagacagtgatctttgttctataattccttaggttttagtgtgtatccatgagaaggatctctattctgattaatgtggaagcactggatgctcatatgagtacaacctggcatcctagaaataataggaatacagaaacaagaagagaaataattttaatttctatgctaatcaagtttcatttgaaagtcttttaagcagactcatctcattatataaaaatacagtcttttattaaaactatagaaatttaataaaaaatataattgatgttttgcatttcctacatgactctaacctaatatttagccagtttatagactggctaaatcaaccttcagccgtattattactgttttaactttggctagtgaatatccatatgaatcttgtgaatgtgtgggatatggctaaattgtcaaagacaatttcagtgtggcagagcacccagaacctgaggagacagtagtgaagaagtattaatggatcatgaagcagtagtaacagtggtttgttgatattgaatgatccagggcctacctcctgggcttagaacaatttttttcactatatattcatgtacttaatcattcactcaatgtgattagttacattggcaatataaggtaactagagaatcttcctagtattcactttagtgaaataatttgggttgctgctatttacctcttacatatgctgcttatagattctggttgaatccacggactttgtttctatgctattaactagctacatggggggaaattatgtttagtgagaatatttgctattatttgttcaacataggcaatagattaggaaagtgttaaagaagacatggttgatgcctactatagatcaaagacttagcaacaaaaagctatggtgttgctggtaccagatcacactttgcagcaatctccagtttgggacatataaagagttgttcttcgttttctatgtcctgaaagaattctagcttcctttattacgttttaaaatcctttgtcattagttatagtgctgagcatataagaaaactatacagcatctattttaattaaaagaccttagatgaaagtggcagaatcccaattcaaacaaccagaaacaaataaatgatttatgtgctcacaaaccaaaaaggacaggggtacagatgacctttgggaagaatggtaaagggacttagacaacctcccacagactctctcactctttcactttctgtatcacacctacacccgtgtacatacgcatgcacatgggttgacgcaacagcctccaacacacacgtttctgcttttatcagccctttaatctgaatcttgtctactgcagatggatttttctccatacaggaggaacatggattttagcatcgtctaaggttatagttttactatgctctgaccaagaaagattaaaggcttttccttagcagtttaagggagaaaaaaaatattcagggggaaaactcagattgactttgcttggatgaaatggtcaggtttgaaccaatcactgatgatagagggatggtagcgttctaaatttgggtcaccactgggggcaggtgggaattggggcaacgagatgtgagactgtaagactttaaggagtccttctgagcagaccacagttttcactagatacaactgcattcaggttgatattgatcttgagtatcattgattacgtgtacagccttcttaatgtaacaaagatgatacatagcttattttcagacttataaccaaatgacagcacaacaggacaaaataattcattgatgattgtggtaggtagaatactgcccccatcaaagacacccctgtaatcccttgaatctgtgaatatgttagattacatggcaaaagggacttatgattgctaatcaaaagattatactagatcatctgggtgtgcccaatacaatcacaagggcccttacaagtggacacgggaaagaaagagtcagaatcaagtgattcaacatgagaaggactcaacctaccactactgcctttgaagatggagaaaggggaccaagagccaaagaatgcagcctgtctctaaaagcttgaaaaggccaggaaagagatcctaaagcctccagaaggaatgtagtcttgacgacaccttgatttgagcccagccaaaccattttagacttctgatctccagaactgtaagacaataaatgtgtattgtttttaggcataaagtttgtggtaatttgttattgtaggaccaggaaatgaatacagtgatctttggacatattctttggcatagtcaacagaatatacatcagaagctgtttctgaattatgtattcccatgtattttgaaaagcttttttacaaaaaatctgaaaaagaattatgtataaaagattatttcctttactgagagtatctcaactataggcataaacatagattagttgagatatgattttcttcttggcttttttcttgctttgtcttaaaatgaaaccagtcctcttataactttttccaaagcacaactttatagcttactcgttgcacctatttgaagtcttacaatttattccatgttgtaatataatcttggtatattgtttttaatgattacacattaacatattttaaccaagcataatatgcattatattccgtcgtttaatcaatttttctatttaaatggcccatgaacataattacaatattttaatattatggcctaaattgttttactatttttacattgtaattctacattgcaatttgggatgcatgtctttgtctaacatagataagtagattcacattttgcagggtttacattttgggagtcctttttaataaaatgaattcaaaatcaaaagtacaaagttagttaaggtgaatactaacttaggatgaaaaggcaatcagcacaaattacatttttatatcagacagataccataaacctcacaaatctagaatatgatgtaattataattttacacatctgttgtaagtggctctgtatatttcaaaacttgttcattctcaacttcttaaatgtgggctgagcattataggatgcatacaattttattatttgatctctcgtcttaaattgtcatgacccaagagggctacagcagtatttctagaaggcatttctataccctgaaaagccacagaagtgatggtaccccactaatagcaaaatgaatgtgtcctcaacccaccttctctttggctgaatctcagaagtacctggagtctttccagagccactggacatgagaggaaatgtggatgagtcaaagttagaatagaaggagagtcagtcatcttacttcactcaaaatttcttattttggaaaaatttaaaacacgtatgtcatctattgtcatggtccttctcagtgccagagactcccaccagtgaggaaatctaaagaatagttgctgttagttccatggtaaatgtgcctgtctctttgatgattgatactgaacaactgcacctggggctgtacccaaagtggagaacagtgagtttctgtgtcgtgactgtcattgaccttccacctttcctctccaaaagaataagaagcgaatcaattgtgaagatggagcaggtgctgtgattcagcctttctttatatcaccagacaaggtgaagccttcctgggtttatcatggtctcccaaaggactgttgacacctttgtacctacgcagctttctgctgcttgatgctaatatcatacacgttcttctgaaatattaacaggaaaatatctgtttgaataaatagctttgtacaagtgtatgtctccatcccaggcatccttccactccctgggtgtgtatggaattagaaacatgtaccacttcatcagctttcaaacacattttttaaaatctggaagtgtatagcctggggcctcagtgtttctatttctgtttatttgtcatacagagtgttgcttctcacctgaaccccttgcagacattccagcaaaatgaaaacatgaccttgagccttagtttcacagtccatgaaaagctcaacttttattatagaaattcagggttacagcccttcttttttttctcccacttaaaaagggataaagaaactaacccacccagattgctgctaagcctaacatgagctttgcatagccattgaaaaaggttcccacactctagaatttttattccaccttttaaaatgctcttgtccatctcttctgaagactttggagacaggagatttttcagtcttaatgcattgaaatgaagataatacaaaaagaaagctttttcaaaatttttagtctcaaaaagtcttctcttgggaaaaggcagacctttatcttagtcaaaagggaatgagactgttggcaatgacaaattaaagtttgaggggataattgaaataaggaaatggaaaagtatggctgattatccccaaagcctggatcagacaaggaaataagccagaggcagcatagatttgagtgaagatgtgcaccctcaggtcaagagctgaggctggttgggagcaaagaaaaataatagaaagaaagaaatgggaggaaatgttttaatacatttaagatagtggaatataaataagcaggcaggggtttctatttctatttattgtgtttcctttgcctgcacagagtgttgattgacttcacctttctccgtatccagaaatccatctatgtgattaaacttttgttcttaaacaaggcttctaatattagatggaagatttaatgaataatagtagttaacattaagtgagtacttatagagttctaggcactgttctaaatgtttgacttatgtcatttaataatctcatcaacctcatgatgatggtagtatcatgattatccctacacagctagtaataacaccagcgtctctgtctatataaatttaatcattcctatttccatcaataccaattcagtctaggttcttgcttttgcccttctctctgtctagaataaccactgacaccttgtaagcctgaaaaaaatgcaacctcacatgtagctgtgatcacattttcctccatattccagctaaaccggtgcgcacttttagttttgtatttgccgtttactataattatttgttggtgttggtctctctgactccatgagtagtgttgattttctttgtatttctaaaacctagaatctagcaaacatttgactgaataaagaataatgattgactgtgaaacaaatgactacatgagcgcacagatggatccagtgtttttttcttttaaataaatgatcatgtaccagtaattacagaactggttctaaacatggattcttatgtagttagagatccatgaatagaaaatctttatttaatttaatacgaggcctctagcctagtattcagttagttctaggttccccagcactgatctggaagggaaaagaaaattgaatctgaaatgaggctgggatgtgtgtgtggggtatgtatgtgtgtgtgtgtgtgtgtgtgtgtgtgttttcctgtagttgtgacttaatatcaaagacaattgcagataatatgagaacttttcattatttatgcttgttttctctaattgagattagattatattttgcagataaacaatttgaattcgttaataacgtgatttttgaaaatcactgacgcttgttaatgttaactaggataaatattattctctatttaaattgtgtgttttgatctttccctttaaaaataatttactacaaattttaaaatattaaatattaatatgataatgcaatccgaggtttataatttagcttgatcccatgacagagtaagctaatgttaactatataatcaacaacttgtaaaaaatgttcagagattacctcttaaggcccacagtaataaaactatctacacttttctctaaaagtcataaaaatgtttgtgaaataaaatcaagtttcatatctttgtgtactgaaattagtttcttattcctacccaattatctaacatacaattgtcattttgttatgagatacatacacttctcattacacatggagaagcattatgtcattatttttataaaaggctgataaatacagttgttccttcatgtatggctcccatacagattcctggtaagatgattctataaaattatataactcaaatctcctgttgactttcatctgaggacaggcagtgggttcaccgtgagtcactgtagttcaaagatgtaaagaaatctgttgtaatcacacttaaccttcgcagagcacaaatttaaagggagactcatgatttaaaagtggacaattaacaaatgacctttctccttcacattaggtgagatcatcagggcagtgtggtaagtagtctgactgtagaatattttaaaggaatgaaagtttttttgggtataccttctggccttctgggcctgtttttggccttctggccctgttttaaatcccatttttaaaaaccctattgcttaaaacagctaaaagaacaaattttgtaagcattccattagactggctaaacatctccccccacccagtttacaatgtatacaatctcttatattcatgtggcttagtgatttgtacaggatgacctaaagccaccaggattcctggagatattcttagatgtttactaggttgctttggagagtgagaagaaatctgggcttgttgagctttacctaccctacctactgctttctctgggcaaattcacttacatatgttttatttagcatggatctgttaatactttcatttggaatgaaatgtttctgccggtttctttctgttcttgtgcaaatgtgaaaactattgctttagcgaaagcaaacaccgttacttcctgaatcacagctccctccaaaccactcctctccagataaacatttatgttttatgccccaataactacacttccttttattttccctgctctgagccttgaagtgttcacctgaaagcattttaaaatagtctgtaattccaaaggaaatgaagtaattgtccatggaagggaggtgaggactcaggatacagattgacctggggttgctcatgaattgagaccaaaagaaaaacagaggtagaataaaatgaaagggagaagagctcagtgaacatctgtgctttctctttgccgagtcctgacacagcgctcactacccctctgcattttatccctgtcaccatttggagaatcaggcaggaaggcccagcatcagggatttcctctcccttcaaattctggtccctgcaaccagctggagccacccacagattccctttgttgatgagtgcttccggaaggtgaaggagaacctccccatcagggggctgcaatgttccaaactgcagcatcattcatgacgtggctaacatttaccttcatttttgtagggggtggagaaaggtatttttttatagtaataaaatacaatctgtgaattctgccatataccaaattaaaagaggttttgcggtacagctttccatggagacaaggaacaggtaattattcagagataatgcttctgaaacagaacattgtcagtatataatggttccctgccggtagataaatgcagaggcaaagacagcatatttattttttaaagcaagagacattcagtgatgcaattgcaactcttgaaattacctttcctgttttaccagatgaaaggttgtagatttaatcatcatgcctgatggagcactggtgtcacaaagtgacagaaataagcccagtgacagcagccctgctgtgtacagattgacttagtaaacactcttggcacagactttagccgttgaggaacttcttagttataaatgggtggattctccatatagctgctcaaattctaaattcattatattcctgccagttaagccttcgtatgtctttgctttgccaatgaaaactcagccggccaggaacaaatcatatacagacttaatttgaattcaagggatgatattgcttcttctgtaggttaagggttgcagtggtagctcgatagttgtgtaactacactgcactgcaagggctcatcaggtcccactcagtattttatttctaataatagtaatggctaattttttttttttgagatgaagtttcactcttgttgcccaggctggagtacaattgcacgatctaggctcaccgcaacctctgtctcctgggttcaagcgattctcctgctttagcctcctgagtagctgggaatacaggagcctgccatcatgcccagctaattttttgtatttttagtagagacggggtttcatcacgttggccaggcttgtctttaactcctgacctcaggtgatccacccacctcggcctcccaaagttctgggattacaggcgtgagccaccgcacccggccagtaatggctaattttattgagcatttaatgatgcgttagacactgttctaaagactgcacatgtatttttcatcaaccctataatgtatttttaaaatgcggtagatttctcttttacccagggagaaaggagaacttaagggaatggcttggatctgatcacatggctaataaatggtagaacttcgactcattgagttgatgggcctcttaaccattgtacctttgctattcaaagtgtggtttgtagactaacggtatcagcatcaaattgtatttcagatacaacttcagacccagttaatcagaatttgcattctaaagagatcccaggtgatttgtagtcttcatagacagtgtctacaaacttttctggaatgcttttgctattttaaaatgaagatcactaccacccatggatttttatagcctttctcatcatctttgatctattaagcactttgaaaattacactacaatttaatggcacagaaaagaatgagttttgtggacattttaattttagaaaaatgtcattgtaagtgaataacaattttctccgaaataagcagcttaccttagaagttagcttgggactgattgatgtgagtccccgagagatagcccttttgctgaatcagacagatctttcatctatctctaaaaagtaccatctactccaggaaacctggcagtttctactacctttatctgcattgctttgcttgtgacagtcctttgcatatatgatggcctttttcagtgctttctaaagctatttttaatacaaatgaaggatttgaatttaaattaaaatccagctgcacacattattattaaagataatttcgttgtggagaaaatctaatcagtagatatttttattgatgttaatgtgccaattctcagacaataggagtacatctttttttataaagaaatcattttaaaattgatcctaatttcagaaaccttaaaatatgaaaacaacattttagagttaagggtttagctaattaaatgttttccaaatttaatcttagtgtttcttcaatagggagacactggtatatcttaaaaagagccctggactaggaggcagaagatctgagtgaaatcctgattcagacacttataggctgtatgactttgcgtaggtcatttaaccttttggagactccttcatcttgtctgcaaataaagataaaacacgagaattaaataaggattgaaacttgcggttttctgtttcactcatttctgtaacaggtttcatgttttactttcattttcactgcttctcaaagtgtagtctgagttataagattcctctttcatgtaatttttttttatatttcttacaagtttttttggaattatgaccacagaccatagcttgtagaaaacatgtgatatttcaatgctttttgtaatacactttattttttagtgcacttttaagttcacagtaatactgaacagaaagtacagggagatcccatatactccctgccctcacccatgcatggcctcccctgtcatcatcccccaccccaccacagtaggtctattggttacaagtcaggaacctacatttacacagcactatcccccaaagtaattattataatttaccttaggattaactcttggtattgtattttctatgtgtttggtaaattttataatgacacgtacccaccatgacagtaacatatagagtagtttcactgccctacaaatcccctgtgctccacctgttcacccctctctccctacaacccctggcaagcacggatctttttactgtcaccatagttttgcattttccagagtgtcatacagtgtgtaggcttttcagattggtttctttcacttacgaatatgcacttaagttttttaagtgtgttttgatggcttgagagctcacttctttttattgctgagtaatactgccttgtctgaatgtaccactgtttatttaaccattcacctactgaaggacgtcttggttgcttccaagtttcggcaattataatgtagctgctgtaaacgttggtttgcaggttttcatgtggacattaagttttcagttcctttgggtaaataacaaggagtgtgattgctggatcatatagtatgtttagttcagtaagaaactgctgaactgtcttccaaagaggctgtagcattttgcattcccaccagcaatgaatgaaagtctgtgttttctccacatccttgccagtgttgggtgttttcagtgttctggatttgagccattctaacaagcgtatagtggtatttcatcgttttaatttgcatttgcctgatgacaatatataatatgaaacatctttttatgtacttgtttgccatctgtatgttttctttaataaggcatctgttaagatctttgggccatttttaaattgtttttctcttattgttgagttttaggagttatttgtatattttaagtaacagaactttatcagatatgtcttttgcaaatattttctccttgtctatgacttatctttttgttctcttgatatttcttttcttttctttttctttttctttttttttttttaagacaaagtctcgctctgtcacccaggctggagtgcagtggcatgatctcagctcactgcaacctctgcctcctgggttcaagcaattctcctgcctcagcctcccgagtagctgggactacaggcgtgcaccaccatacccagctaattttttttttttttgtatttttagtagagactgtgtttcaccatgttgtccaggatggtcttgatctcttgacctcgtgatccacccaccttggcctcccaaagtgctgggattacaggcgtgagccaccacacccagccctctcttgatatttcaatgctttttacatgatctagtatatgatggatatctctatttttcataaatgttctgtggatagtttagagaaggttgattagagtaagaggcaaagttgacatattaaataaattatccttattaattattttgttctgagttatataatactgcttagactttctcataatagtaatcaacttctcatctgtttctaacagtttttatgtcatatatattgataatgagtgatattgaccaaaaattcatgacttcacatattccttaacattcaaattatagaaaaagaaaatcatatgacctttttgttttgtttagttgttttgtgttaaattctgctgagtctgaaatttaggctaccatgccgtttttctatatgcttgataaatctttgacaaccctttacattttattcttcttcattcctttgagtcagatttgtcactttggggcagcatacactttgatttatgattttgttaattttttacctaatctacaaatctttgctgtaagagagtagggattaaaatatttgagtttactatcataattgacatatttgattttattcctgccaacttattttatcctttcttcataccatttttaattttgtgtcttctttcaattattttataaaatacactgcatacagtttaatgcccaatcctttgaaaataaatatatatttttatttatcctaatggttaccttatattattttaaaaacattgtcagtattcattttatatcaaggtctcaaatttaatggtgtcatttgttcttcatctatttaaaatgaaagatatagcattttttcaattttcctcccatctttactcactggaaattattagtataaactttgctttttataactaggtaaataaaattttaactattttatagtgcttctgttttaatcattaattttgatatttccattgagttgtataaccgtatttatagtggtccttaaatccgactactataggaattgattaacgtaatatagacagccccattttccaattctcccatattttgagcccatttatttatttattcatttattttttgaaatagagtcttgttctgtcacccaggctggagtgcagtgacacaacctcggctcactgcaacctctgcatccaaggttcaagcaattctcctgcctcagcctcctgagtagctgggattacaggtgcctgccaccacgcccggctcattttttgtatttttagtagagacggggtttcatcatgttggccaggctggtcttgaactcctgaccttgtgatccacccacattggcctcccaaagtgctgggattacaagcttgagccaccgcgcctggccttatttatttttttgttaaaatttcaaagtaaattttgaaagaattttatttggacaatttgttttctaaaaccttgaatacctaagattactttttctattgccctaaccatgaacacagtttacctttgttatttaaaataagtattgtcattcaatatttattttgaaaataaaataaatgacaaatcattcaatattttgaatgacaatattttctttctctctaaatgctccatttttgctgttttaattgtaagaaatctgatcctttgtaggtggtctacatgtatttctcacttgtatatttaaattctttcatgatgtgaatctcttaattgatctacccacagagcatggtaagttgtttctaacttcacattgagacctggttttaggtacaaaatgtatacttcaatggtttcttcaacgtcacatctggtactgttgcacttgatttttcttagagaagacccataactcctagattggatagttctacatctatcatcatcttccagtgattttcccttattcatttcctatgcatttttgaaatacttttcagtttgtattccaaatcattgttagatctcccctggtaagtgctgatctgcattgttttcaatggcaaatttaattttacaagtgtacttttattttctttgttgttatctctttcttacctgctcccttgtaatcttagttgcctctctgtctctgtatggcatttttgttattgtttaattggagctatatcttttactgcaatcagtaaagataaagacttcttttagtgtttctgctaaaataattttgaagcatgtgttctgaattcgacttgtcgctttgctggttctgtagctctatcttatgctccaactgatcagacatatgttgatcactctgtcctcttcttggagatgttcagcacttgttggttagttaaagactctgatatatcctgcagtaagaaaagtctttaactctgtccaaccaatatttcctgaaattaattgatcctggaacttttctccccatgaaacaccttacagagctactgtttcatgaaatcatatttgatcgcaaatggttaaaaatatgtcgtcttatagttagtaaatatcttggggaattctttcactgctatgattatacactaatattcatcttcaccttaaggataatttatttgattttctatttaattgcagtttctttacaaatgaaaagaaattgtgatgcagtttcccagtgatttttttttttgcaatgtaaaaatgatttgtagatgttaagtctatatctcatagttctttaaatgaggaggaaaggcatttaatgagtttgtatagacacattttcagatacccacacagagaaactgcagaagagaagtgcaaacacatttacactgtcctactaccatagatgatgttgaaattttgcaagggattactaaaagatgtcaaatgagctaactataggatgtgaagtcatgtttttgcctacatttgctaattgaagaactgtgtgtgagagaggttattgtaaagtgtcaatgactcattttttgtgtatcatgaaaattttgctccattattttatagctacatagaatatgaaaagatatttacacaaaagtatctgaaaaatgaaagtcaagagggtctccacagctacagctagttgccaaggcaagttaatgagtaaaggaaacattttaaacaaatggtactagaacaataatataaatgtttgaaaaagaatgaatggacctcttccacacagtatatacaaccgaatgtaaaagtctaaactagaatctagaagaaaataggaaacaatttgttttgaccttgggttgatgaagatttatatacggtacacaaaaaaaagcaaaaactataaaaattgattgaatttcttataattaaaacaataaacttggcttatcaaaacacactcttaggagaatgaaaaagaaagtcacacatggataaaatattctctctctctctctctctctatatatatatatatctgacaataagctatacctaaaatatataaaccacttttattactaaataatacaaaggtaaacaacccaactacataggaaaaggactttatcagatgttacaaaagaaggtatatgcttggctagtaatcacttggaaaggtgctcaatatcatcatcagggaaatataaattaaaaccccaatgagttatccctgcacaaccactagaatggagaaaattaaagagcctgaaaagcaccaatatgttggttaggctgtaaagcccagaactctcatacattgctgttgggagtataaaatggaacacctgctttggagaaagtgcacacctactctgtgacctagcaatgtcacataggtgttaacccaagagaaatgtctgcaaacaatatgtattggtaagtgaaccaccacttaccaattattccattcataaaatggaatattactcaataataaagaggaataaattactgataaagacaacaatatggatttatttatatagcttgtattttatctccattcatcaaaaatctctacttaatttgggtgaaagatacacattttctttctttacctgagtttttcttgaaagagactatcaggtttacaagtttagaagtaagaatgttagtcttctaaaacatcacttcagtagaggagaacttttgagtcacagactaagtctagccttcagtttaatttcacctgatgatattgctttgatcagataatgattgtgaatggcaaagcagaggttctcaaaccttaatgtgcatggggatccgctggagtttcagatttagctggactggaatgaagcctgagatttctcatttctcccaagttcccaggtgatgctggcactgctggtccaggatagatgagtgctctggataatgaactttctgttggaattggaagggctgaaaagaatgtattttcacaatttgtatttcaaagagtacatggatatcagagcgtggtgaagcctgccctttcaggcatatcacagttgggaccaccgtctgagttcattttaagccattttaggcacctccataatgaatgtatctacttttgccccaaattgaccgttttcctttctacttgacctgttgacctgaggagaagcaatagtgaaatgatgaactagattaagaagggtatgcatattgttttgtatcttctaattgacctggcgttgacaatttcaaaaagtgtatgagttcttaagccatctcgttgatttactgaaataggttgaatgctgtggtggcttcatgactgtgcccagttcttccatccatgcatgttgccctgtgacttctattgctgtgaaactcatgtgagttgtcagccaaaaaaaccaagtggaatgtgagtctgacagttctgagcagaagctttgagagcctcccgtggcttctcagcctttttgctttttcccttctgcagtaagaatggcacgtcacagatagtgactgatctttcggccaaagtaagaaaaatacgtgaagagttgcagctgacatgtaacctgagcaagaaataaataattgttgtatctcagtgagactttggggttattattgtggcaaaatctagaaaaaatccacaaatagtctatatctcatacctggtgtcaggtattgggataggctgattatgtattttatttgtattagtcatcacaataatggttacataatttttctcaaatcataggggagaaaataaggtttacagagagttgacatcactaattctgggaaaagatttatttcaaatgtactgtggtgtgatgatgcataaaattatgaaatatgactaagattttgtacaaatataatgagaaaagttatcaatagtactagtttaaccttttaattataatattctaatcaatgggcagaattaatgcaattatagacaatagcagaaactccttttcactagaattggctttctcattcaaattcaatcgaatatatttttaagaactgaaagcaaaatgttccagttaaaaatttctactctgcaaaacttggagtacaatttaattagctttcttggagtaaatgaactgagattttgatctttgaaagtggaagatgatagactccaatggggagatgaccttagcctagttaagaaatgtttagtcaagtaagtcaacatgataatgtaacagatcattggtattttggttgctaatgaggcagaaaatgaaagcttcataggagacataataaaggccttgatatccaagttttgtgcttaggaggctggttttaatgacgagattaagtttagggatatgcaaagtaagatacttttccagtgagatgggaaagatttcaataaagatgttatataaagaaagttttgagaatccactgggctagtcatttgggactagctttcttaaacatttcattcatttattccttaattacgtttttacagtggacctactcagctaagagtgccaggtgtgtgtcatatgcactgaataggaaattatcctgttctcacagatgtcttacatttcagtgggggatataaacaagaaacaaaggaattcctttttaaaatcagaagtgcaatgaagaaaatgataaaagaagagtgtggctatttgcaaggggcagggatagtatttgcaagaggaaggggtgaatgaaaagggagctgataaggaaccaatgttttatctaagacccgaatgaactaaagaagcatagatatactttcaatataagcaaaaggtgtgtgtgtgtgtgtgtgtgtgtgtgtgtatttctagttttataggcaattatgctcaatttcaattcgaatttcctttttttttagctttatgtgcatatcttaactgtagcagctatgctgggaacatgttaaattgtatattatatagtcaaaagaaaatgagaatgtacaattatctgggaaggtttcgtatcattcatacagacttttagaaaaaaaaattggttccctaaattatctgtgttgcctcagcaaataagagtctctcaagcttttgtggcacaaaatatcctatggagcaaaagatttagtcactgagttatttccacccctggcctaccttcaaaaaagaatgtcataccgaaggaaataaaacacatgttaaatatctgcataataaacgaaataaaagaaccgaaaataacatctatttcaatagaatgaataagaatataatctctttgaaataaactccaatttagtcataaacaaataactcatgctagtcatagatattattacatgccatgtagttgtgtgaggtttaaaaaatcagtctcaaagcttattaaaggaagtacaattgtattatttgctcgtagagtcaagaaatatatgaaatgtggccatatttcaatgagtgctattgttcaaatacttgctgattcccatggtaaagacagaagatacattcttaatctgtatgcactcaggtactatagattaaatgtgcagctctttgtgtattagaattcactccagtaactaatgtagacccaaaccatataggaggtagtaattatatatgcataaagaagggcagattaagtcatttcaaacactttaaagaatatctgggctaattttctactctcatatggaactgaataaaatccagatcaaaattgcatccaccatttatatttaccataacttaattgtggcataattcaatcagtatctaaagaaaactgagaggaaacaattactgtttacctaaccaagttatgtctgttttaaatgacttaatttccaattaactattaaaaattaaagaacataaaaattatacaaattaattatttactcagtgatgagaacttttttatcccaacaggctgagaccatatttaatacttttccttgtattttattcttccatgcaatacacttttgagttttcagaatatgttcctcttttcagtttgtccctatatgttggtcaacagattcctaatggcaattcagaatagaagagtgtttaactctagaaatttgattttgggtaccaacagcctactgcagacactttcaggaagaaaaactactttctaattggccagtgtcaaggatccaagagtcacctattcctttaatactcaaacatatatccacttagtgggaaagttaccttaatttatcatttaatcataatcattttcaatctgaacaaatcagaaacttatgacatgtttaatcaagggctaacaggaggaattggcactctggatcaatataaaatctccatatttgtttagaagcctattcaaacatgtatagactataggcttgttaatatgttacttatatttcttcagtattttttaatgaacagaactattgaaaaattaattggaaccttcttattgactttcgttggagacaccaagttctactcctaggttagcagaggattaatagcattgaactacttaaaaatagctgcatcttgtgctttgcagaagtgggaaggagaagctaaagaaaataattattcctcacactgtgtaatacactggtcctggtgattttcaatattgaaatacgttctatcatctctaaagtttctaatattgatcctgctgtatcttattctgaatatattatttcatattatttatttggatgccaaagactcagtctactgctttgataaattttgttctagctcatcacatcaaattttttgtgaaggaatttaattaaattaattttacatgttatatcaaaatatcacatccacttaattctgaaagcaactctttactggggctgaagtttaaaattgactacatctagaaaattctatgggtattcattagactatttttatagttataaagtgttcatgtgcgtatcaccaaaaataacaaaatgggaagatacatcaaagttatgtagaacaagtttgctaatgttccatatgtgtaggcactttcaatgacttggaggtgatgatattttcaaataaaataatttaaaagcatacctcaattcaatgtttgttatatacccaaagaaatttgtgtatgtatgtaaccatacttgaaatgtcaagtatggtttgaagttaaatcggtgctggggacaacaaagtcaaaatgattggaacagtattttttttttttttttttttgagacagagtctcactctgtcacccaggctagagtgcagtggtgcgatctgggctcactgcaaccaccgcctcctgggttcaagccattctcctgcctcagcctcccgagtagctgggactacaggcacgtgccaccacacctggctgaatttttgtatttttagtagagatggggtttcattgtgttagtcagaaaggtctcgatctcctgatctcctgattcacccgccttggcctcccaaagtgctgggattacaggcgtgagccaccatgcaccatggaacaataattttaagaacattaattgttgacatcttggctgccatcacaccaacagaaatactaccatcactctaagccaactctctcttttacctttggtttacatgggcataccatatctggctacagagaaattctccaggagtctgcagtacactttcacattgtccagcaatgctaacattcaatcttagaggtcatttagcagctcatgactgagttgattttgtgcagtaaggcatagatctataatgaaaaacaaatcttcatttacttctgttgccccatttaatgattatgaagagtaaactcttataaagtaaagtaatactctacttgaaaggaatattcctgttacactataaaatatattaccagatattaatttgatggtagaacaaaggaaggatctgctataaaatatatcaagtaaggttttacatgtcattatacacaactgcagagttttttgagaggctctaatgaaagggtacttctcatgctttggaagctcaagtcttcctcctcaaagagagtcaatgacattattttacagaggattttgtagaaatgaaaggtaattaatgccatataaaagcaaaaacattacatctgtaattgctacatagcatgtgcatgacaagttgctggtgcccataagggacagcacttgaaggtcaaaggaaagagcatacccttccacctctcagtttgatttgagtattaaatgagctagcacacagcttggcacatgttaggctttcagtatttaccttctttcttaaaaaataaaaaaaaaaaactatttgtattagcccgttttcatgctgctgataaggatatacctgcaactgggcaatgtacaaaagaaagaggtttaatggagtcacagttccacatggctggagaggcctcacaatcatggtggaaggtgaaaggcacatctcacatggcgggagacaagagagaatgagaatcaagcgaaagggatttccctttataaaaccatcagatctcataagatttattcactaccatgagagcaatatgggggaaaccacccccatgattcaattatctcccactgggtccctcccacaacacatgggaattatgggagctacaattcaagatgagatttgggtgggaacacagccaaaccatatcactattattcagagtaattatgatcaaatgcaacagtgagattgaaaatattatttaatattgcattttgagtacaaataaattttggcttttaatcgtgaacagtcataatgttgaatgttttacttaactgtacttattattaattttttgaaatggtaaaaagtaacaactaacaaactaagaaaaaagagaaaggaaatgaacagtgttataggcaagtagatgctgtggcttacaagcatatggttttctctcagaaacgccccagtcctgtctcctatctcatctctaggagcccacatctacacatcaacctttcctacctgaagtcaagacctaaaatagctgtttacatttggaagatagtattcagagtattcgctttaaatatcttatctagaaattacaaaaaaattcagacttctcatagattttctataccatattttctactcgtggccaatatttccctgagacaaagttttcttttgttctgaaattcatgggataaaataattgcttgaataatcaatttttggaaagactgataatgttgctcaagaattgaagatacacatatctaatcatcatttggaattgggtgagtcatctccaagttatttcatatgaaataaaatcaaatccattatttaaattacagctcacagatatttctgaaattacaattccttcaaatatatataagaagaagttaaatatttacttttaagatttattctaaaacaaaatagtttactacattgaatagactcagatttcaatttgggtctttaggtataagtaggacctgtcttccttacttttaatttattttagcatggctttattattctgcattacacaccgtcttgtgtgtttccaattacaaaccatgtttcattgggttctctcagcattttagttttgtttttgaaatatttggtggttgcttctcctctaaaatgctttaatgcaatttcggttaaacttcagatcatccaattatcagaatagcactatatagacaacacatgaagaagtgagtcattcacccatttcctgtcttttgtttctttactgattgaagggttcaataaattccttcagctcataatgaccatgaaagttaaatactatttttatccattcagctgggttttaaatacagcatgtggacccatcattctgtcatgggcagaagctctggaaattcttgataacttataatcttccctgcccatattcacaagtgaaaatgattatacttacaagaaagaactttacacactaatttttgaatcaactttcagaaagacaagaagtccatgaaaatcagtgtacactattgcttttgagaaaaaaattatctgagtataaagcattcaggatttaagggttcaacttattacttgtttatcacaagttaaagttcttgtttatcacaagtggaataaaatcaattattcatgataacactttggcttactcaatgtaaattttcttggattaaagttaaattttaaaataaggcagtctgtttgacagaaaatgaaacttttactttaggagaagaatacaatgtcccagaccactcaatttagattacaccaggcactctcttgatttatcccatacccttgtatattctacctgggtacattttttactacctgaaatctcaccgtatatttttttacttctagaagtctattttaccttttaggataaaattacagaagaacgcacacttttcttatttagctttgtggtctttaaatttttttaatttgcatttattttattttaaaaccttcaacttccattttggattcagggggtacatgtgcaggtttgttacatgggtacactgtgtgatgtcaaggtttggggtaggaattatcccatcacccaggcaaagagcatggtacctaataggtagtttttcagcttttgtccccctccctctctccctttctagtagtccccactgtctattgttcccatttttatgcccatgagtacccgatgtttagctcccacttataaatgaaaacctgagagcagtacattagcatgtcaagtactccagtgtcctaataaatagctgatgactaacgttgaaggaatgaaaaatatccatcattacttatttagtattagtgtacattttactaccatggcacttatgactaaaggttttgaaatctgcactgcagaacttcatgggtctttttttatgcctatgttctgagtgtaattattccttagttgtttcatgtgtatatatgagttatttttctcaattaggatgcaaacatgctgatggcaggaacttacaatagcttcatcttttgagttctatcatggctgacatagattagcagcagagtgtcaatgtgtgcagtgagggaatgatgagtcaatgtctgagtgcaacagtaggtgtcaagtaatggttgttaaataaatgcattactttaataatctgccagtcagtttatgaataaggtgaagaaataaacatatatttctttttatttttttgcatattttaaattatttcctcttggtctatatagaaaaggagttaaaatgtgtgctttctaaagtctctctgattttttgattgtctatttatgtcattgtggtttttattctcaattttggggtgtactccttcataacttgtgtttatgtgtctttcttttttattttattttattttatttatttttattttttcttttttttctttttttattatgctttaagttttagggtacatgtgcacaatgtgcaggtttgttacatatgtatacatgtgccatgttggtgtgctgcacccattaactcctcatttaacattcggtatatctcctaatgctatcccttccccctcccccgaccccacagcagtccccagagtgtgatgttccccttcctgtgtccatgtgttctcattgttcaattcccacctatgagtgagaatatgcggtggttggttttttgttcttgcgatagtttactgagaatgatgatttccaatttcatccatgtccctacaaaggacatgaactcatccttttttatggctacatagtattccatggagtatatgtgccacattttcttaatccagtctgtcattgttggacatttgggttggttccaagtctttgctattgtgaagagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacttgttgtttcctgactttttaatgattgccattctaactggtgtgagatggtatctcattgtggttttgatttacatttctctgatggccagtgatggtgagcattttttcatgtgctttttggctgcataaatgtcttcttttgagaagtgtctgctcatgtccttcgcccacttgttgatggggttgtttgtttttttcttgtaaatttgtttgagttcattgtagattctggatattagccctttgtcaggtgagtaggttgcaaaaattttctcccattttgtaggttgcctgttcactctgatgttagtgtcttttgctgtgcagaagctctgtagtttaattagatgccatttgtcagttttggcttttgttgccattgcttttggtgttttagacatgaagtccttgcccatgcctatgtcctgaatggtaatgcctaggttttcttccagggtttttatggttttaggtctaacgtttaagtctttaatccatcttgaattaatttttgtataaggtgtaaggaagggatccagtttcagctttctacatatggctggccagttttcccagcaccatttattaaatgtggaatcctttccccattgcttatttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgtgggctcttttttggttccatatgaactttaaagtagttttttccaattctgtgaagaaagtcattggtagcttgatggggatggcattggatctataaattaccttgggcagtatggccattttcatgatattgattcttcctacccatgagcatggaatgttcttccatttgtttgtatcctcttttatttccttgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgggctgagacaatggggttttctagatatacagtcatgtcatctgcaaacagggacaaagaggaaggctttatgtgtctttctccattgcattagtatgttggaataaagtccactgtgatcacagaacacagtttgtggaaaataaagtctaggacttcattttctcatatgtaatctttagtcaccagtgagaatgagctgctttcattccctcaaatttctaatacagggtacaggggagcaatttgagaaccagctggatccactgtaggggctgggagagtagcttgatctcttcacttctctatcccctcacctgagttcttataaataagtcttagaaataagttcttataaataagtgacttatttataagttttgtgttcagcagttctggttttgcaatgagaagtgctacaacttctcaatgaataccaagctctttctcttctttctggggttgtaaactggcggtcctccagagtggcccacacaacgttagctccatttcaaacttagagccaacatccagatttctggaaactctttgaaaagtggaagatccggcaactttggcccagatccctggctggccgtgtcacctcggggcatagtagctgctgtctttgaaggatgcatgcttggccctccctgttgctcccttacctgaaccttagtggaagcttccagttaccctcatacttgtcgagtacagtctaatggagaataaaacactgactctgcaccttcaataaaaactactttggtcactagatatgtgagtttgttctttctccaccagaatataaaacagtggagttttatgtataaagtagagggagatggtcaggctcaattttatccttttcattgcatttggaatctgagtgatattcatggaaaggacaacaaggagttcaaatattagaagtggtgtctaatgtccacttcagataatggtgagatcaaatgattgcgatgcctatggacactgatgtcgccttggagatattaagtaggatatcctcagatttataactactctatactcacagtgagattacagcaggaaaatgaagttcatcaaattttcattgaaaaaagtaaacaaaagctgccaaataaagatttaaattcctctttagggattcagcaaatacttgaaaagcaaagtcatccttatatttacatttatattttgttcaaaatgcgctgtaaccattttgaacaaaatgtaactacgcctctgaatttgtctaagaaaaatccagtaactcttttttagatgagtaatatttactcatttatgtgaataagcaattgacaaataaaggaataaattagatattgtggagtacctaatgaaaatattagaatgtataaggcatggatttctaattcatgtaataccttaagaactagattcttggagagaaaatattgtcagtttcagataaaaggattttagatagaagatgaatgtcatcaaaataagcagcaatggaaaatagagaccagataagtaaattggagaattgcattactcaggaataatttttgactcaataacagacacaccccctcccaatcaaatggcagtttaaacaaattttgagggaggtcttattttgaggaagtgtaaaggtaggcaggttagggctggtgtgaccactgtgtaacatgaccaagtctctcatcagagaccaaggcttgctttggcttgtggtctgtaagatggaaccacacttgcactcatgctctaagatatctgcagggaccctagagtcatccctgcgtctcaggaaggaagaaagtaaaatgccaagggaaaacaaaacgacattgcttgttctttaagtaaagaacttgacacctttaaagccaccttttcaggagcccactcagtggcttctgtttctttttcatacaattatatttcattgactttgattgcattcgacaggatatagctatgcctatctgtgaatgagcctgggaatagagcttcgtatttgggcacattataaacctgaaaaaaaaaatttgtctctaagaaacaagggggtcattatattgtataggcaactagcattctcattgctttttctctcattcggggaaattaagtataatcaataccttgaggcatagtttgcaggttctatgcaaaagccttctctggggtgagccaggtaagcagccagggagtgagacagggaatctgaatacgggctctaagaagtgaagatgaaaagctcagggatgggcatagcatgaggttcatgccccgcaactgcctcacgcaggagggacacgtgggtaaggagactgagtttaggtaagtgtgttttataaattctcatttctcatattttgtgttctgggataatttattttttgttttttggaaattaagtggggaaaaatcctagtatttagcttttgatatttgaattttttgttttctccaactgaacttctcttgcatctgacttcagaaacagtctccagttttgctggaggagcaatataatgctgttctctgcctaatgaaagcagttaataatgattaatgccaaagagtgagtgctcagagggaggaacagagctgctggacagtatccacctttgattgatgtgtttccattggcttttacccttcattgtttctttgcatctgcaatggcgtgaactgcaagcaccattttgaggacagtatgcttcttgttgtagtctctcacatattccaccactccactgagtttccctaagaataaaactcttttacagtaatgggtgtttccttttgagagccaccaggtgtaattattttaccttgttgtatttcagttaaaaaaaaatcattcttaatgtgaaaaagcctaaaaaatatatgaagattgcaaattacataaacgaatggtcaaagaaccttaagaaataacttacccaaaggttaaaaaaaagtaattaaaatgtatatataaaagttccattaatttggaaatatgaaacttttttacttataaattggaaggatgtttttagtgacattcagggttgataagaattcaccgtggagtaactggccagtgtgaataaagagccttaaacatctatacccctttcccaagtagttttattttacagagtccacctcagtaaatgctacaaaatgcaaaggtttatatatatgtattaatacaatctttgaaatttaatttctaatattggaaaaaagaaagcaacctaaaaatctaataagagaattaaatggttaaatagaatgctgaaccacactaaaacaaaacaaaacaaaaaggaaaaaacttttcaaaggacattgaaagacatgagatgttactgatgtcatatgtaaaataagtaagattcaaagatgcaagagaggttcagttggagaaagaaattcaaatatcaaaagctaaatcctggagttttataacatatattgtatataatccgttaacaagaaataatagaaattaaatgggccaaaaatctaaaagtaatggaccctgagtggtacaattatgtattactcttgttttcttctctttttttattttcccattttagacagtgaatctatatttgttcagtcattaaaatgtgttaaatatcttagttagcatgatgtttgttattcactgaaatatatgaagtcaatttctaggacagatgagaacaaaaatgccacataatcatgagaataaatttttagacttctgtttaccacaattatagaaattaattaacctcaagcaagtaattcagtagtaatagaaatagttatccaaattaatatttttcattttcaaaaccatctatgatgagaaaatatttgtctataattcatttataatacaagatttttattgaaaaattttattgttaacacattttaaaaattaatatgtggttcagtttctttttatgatgaaatagttttagcagaccaatgctactgacaaagtcaacaagaaaagctgtataaaataccaacaaaaaaaaatatatttgaaggaatgggaatgccgttaaggcagccagtgcttgagaaacccagatctcatagggaaaagaagctgatttgggtgtgcaattcttccctctcaggccatttgctgaattttaccctgtgcagggaaagagggtgagaagttcagcagataacttggatagaagaagagaagatgtcagaactttctgggttcttacagggttggaagaaaatatagaaggttgagacttttaaagccaccagcccttttgggtcacgaccttggagacaaaggaggtgcgaaaaagggagccagctattccaccctggtttttttctccaaagcatttgccaattcaagaacagtgaaagattagagaataagaagccaagaagaaagtgactaacaaattgattagaactgggtgggagcgctggtgtgcttggaaaacaaatactgaatttcaacatccatgaagaagcatggacctcatgttcttacagaagcgtatggaagtattggtgaatcagagagatcaaacctagcaaagactgccacctccctggcatcagctcagtcgctgattggacttgtgagatctacccctaattttgatgactgccagacaataggataaattatttcaggagaattattacaccgttcagagcttctacagtgtcctacattcaataaaaatatgtccaaacaaacaaaacaaataagcagacaacaacaaactaggactgttaggaaatacagatgatagaaagagaaaggtgagacagatattggaattatcaaatatgtgtgatatatgtttaagagaggacaagatatagaattcaaaagatatttagaatcagtaaaagaatgcagtaactaagatcgagaactcaagtagtgcgtttaacacagattgggcataacagaagagagaattagtcaaaacaaataagagatagacatttaatgatgaaatatttaaagctttctcccagtgatcgaggacaaggcaaggatgcctgatagcaccacttgtattcatcattgttttggtgaacttagtccatatataaaggcaagaaaattataaaaagacataacaaatggaagggaagaaataaactgttattgttcaccaatgacataaagtaatttctggaaaaccattaaaattattaaataaagttcatagaaaataagaatataagaaaaaattagttgtacaactatcctagcaacaatgttagacatgaaagagtatattctgcataattccaattacaaaaatttcaaaaattgatctacagtaatagaagctaggttagtggtggagttggtgggggacagaagaggaaatctgggggtgttagtaatattattttctttcacttgagtgttaaattgatctgttcactttatgacaattcattgagtcatgaattcatgatttgtgcatttctctgtatatgcatgataagtgatactaagattgacatactaggaatatgagacatctacataagattttaaagagtgataagagccataattaaaattatgattaacacacttttattcttaataaagaggagtatgcatatgaatcaagaaattggtaattttagttttagagtcttgttggcttttaaacatctgttcacttttgtggttcacagatattcaatttttattgaaatttaaatgtgaaaacacatctgtttctctgattcatatttttatggtcaactctgaaatgagacagttgtgaactgagaaattattcaaaacacaagggatgtgtcttcctattatttgtgaggaggaagtacaataaagtcctgaaatcagcaacttgcattggtggcttgtttacataaggaatatattaaatatttccttttctactgtggatttctgtctttctcaattagactataaggtcaatgtaagaagggttcctaaataaatgattaaagaaattaaagtgtgaatagcagagctacattttgaattagagatttttaaaaatattgtcaaggtaagggacctgcggatgatatttctcatggaaatctatacttgtttagatattttttttccagtccaatgaggtaatgtctgatcgcctagatgcttctgtcacaaccttagcaaggatcatgatttctcaattgtattgctcaagagcctttggctgctcttactgaccagcctattactcatcttgtacactttgatttatgtattcaccacactaccttcaaggtaatctggccaaaattttattttctaatttttcagcttaaagtttattaagactttaggacacgtctagattcctttcctctaccataccctcttagtttcacttcaaacctcagtgaaagtgtgacctttttcaagaagctctcagggctggaaccagatatctgtgatctagttacatttcccacattcttaccaccttgagttataacatgtaggattatttgtctgctctgcccaataaagtgtaagacacctgagaaggatttagagtaagaataaaagcaagagagagagagactgagagagataattagcgtttttttctgaaaatgcattgtcctcttaatgctcatggtactgttgggtctcagctttctcatcagattctaaaatgctcaaaaactttttgattaaagtaaatgtaattgttgccctgcaccgtggtcttatattttctcagatatatactaacagcattagaagctgtactttactttctttcttttaggaagaatattaagttagtttgtgtttaaatgaactaattgttttgcaaatgtgtttataaggagatgatatacatttttttttcttgtaccttatggtaaatacttgaatgtttgtattatatattttcccagtatcttcctttgacagtaatttttatatcatgacccttatttcatgttgaaaagcataaatacattcatggtaattgaaaatattaattacttttctttagcatttgtccaaaataaaaagtaagtatcaccagtgatttaaaatgcaaattttgagaaatacaaaaattggatcaagttctggctccccatctgctggccaggtgacttcttttttttctttttttttttttttagtcaacttttaatttctagggtacatgtgcgggatatgcaggtttgttacataggtaaacatgtgccatggtggtttgctgtacagatccgcccatcacctaggtattaagccaagcacccattagcttttcttcctgatgatattcctcctcccatgtcccccttttgacagaccccagtgtgtgttctgctcccccacagcccactgatatgtccatgtgttctcattgttaagctcctacttataagtgagaacgtgcagtgtttggttttctgttcctgtggtagtttgctgaggattatggattccagctccatccatgtccctgcaaaggacatgatctttttcctttttatggctgcatagtatttcatggtgtatgtgtaccacattttctttagtctatcattgatgggcatttgggttgattgcacgtctttgctattgtgaatagtgctacagtgaacatatccatgcatttatctttatagtagaaggaattatattcctttaggtatatacccagtaatgaaattgctgggtcaaagggtatttatgcttctagatctttgaggaatctccacactgtcttccacaatggttgaactaatttacactcccaccaacagcgtaaaagcattcctttttgtctgcaacctctccagcatctgttgtttcttgactttttaataaaggctattctgactggtacgagatggtatctcattgtagttttgatttacgtttctctaatgatcagtgatgttgacctctaatgatcagtgatgttgaccttttttcgtatatttgttggtcgcatgaatgtcttattttgagaagtttctgttcatgtcctttgcccactttttaatggggttgtttgtttttttcttataaatttgtttaagttccttgtagactctggatattagacctttgtcagatggatagaaggcaaaaattttttcccattctgtaggttgtgtgttcactctgataatagtttcttttgctgtccagatgctctttagtgtaattagatcttattagtcaatttttgcttttgttgcaattgcttttgacgttttcatcatgaaatttttgcccgggtctatgtcctaaatggtattacctagattttcttctagggtttttatagttttgggttttacattgaagtctttaatccatcctgagttaatttttatataagatgtaaggaaggggtccagtttccattttctgcgtatggctagccaattctcccagcaccactcattaagtaaggagttctttccccattgcttgttttcgtcaggtttgttgaagatcagatggttatagatgtgcagtcttatttctgagttctctattctgttgcattggtctatgtgtctgttttgtaccagtaccatgctgttttggttaccatgtgactttttaaaaaaaattatttatttatttatttatttttagagacaggatctcactctgtagttcaggctacactttatcttagccaaaagaccaagaagtcatgtcgcccaggctagagtgcagtggtgcattcatggctcactgcagcctcaaactcatggactcaagagatcctcctgcctcagcctccagaggatctgggcctgcaggtgcatgccaccacacctagttaattttttttacattttttcagcaacagggtggccatgtgaccttatgtaagttacctaaaccctgtaagtctatgtgcctcatctgaaaaactgataaaaacagaaccctctttatagggtcatggtggagaagaatcaaacagtggacaaggaatatttagtataatgccaggaaactagttgactggtcatagtcacacagatgcttcagggcaggcctatttcttgcatacctgtgatttcaggacattttcagaagtcccagacctagaacccataggtggagaatccaaattttttgtctgaggacaatgaaggtgtcagtgaatatctactcccttacaagagctttgttacaattgttcaaacctatcaacttctagatggggaagactggaagaaggttcaagaagtgtttcctcagaaacacccaaaatgcacgagaaggaaatagacgcaccaaagttacctcaatatagtgatcatcacagaataagaaacttgagcggccgggtgtggtggctcgtgcctgtaatcccagcactttgggaggccgaggcgggcagatcactggaggtcgagagtttgagaccagcctgaccaacatggagaaaccctgtctctactaaaaatacaaaattagccaggcatggtggtacatgcctgtaatccagctactcgggaggctgaagcaggagaattgctcgaacccgggaggtggaggttgcagtgagccgagatcacgccaccgcactccagcctgggcaacaagagtgaaactgagaaagaaacaaagaaagaaaaagaaggaaggaaggaaggaaacaagggggagggggaggaggaggaggagaaacaaagaagagaagaagaggaggaggaggaggaggggaggaaaggagaaaggaaggaaggaaggagaaatttgtgccattgactaactgaggccagtatcatggtggaaaagcctgttactagtgttgaggtgaagaagcttgaccatataagagatacttctgaatttattcaggtgaatattgggatatcactgattttatcagattcattatatttaagagtaagaaggaagaaaagtggaattctgggatcatgaagagttcagaataaatgggaaaaggaaatgcagcactaaaaacatgaccaaaatcaatcaacaaaagtcagtcaacaaatatatgttaggtacatatgtgaattacattggtgttcaaaatagaatctttgactttaagtgcatacattttaattagtaagaagagggctccaaaaacatgtaaataggcagcaagacaatacatgcttttggcaagtgctattatgaactatgaccacacagtaagaaatgaatatgggtggtagagaaggcttctttttttttgagacagagtctcactctgtcgccaggctggagtgcagtggcacaatctcggctcactgcaacctctgcctcctgggtttaagtgattctcctgcctcagactcccgagtagctgggactacaggtgcgcaccaccatgcccagctactttttttgttttttgtttttttttttttgtatttttagtagagacagggtttcaccatgttggccaggatggtctcgatctcttgacttcgtgatctgcccacctccgcctcctaaagtgctgggattacaggcatgagccactgtgcctggcctgagaaggcttcttagatgacttatgtgttgagaaataaatgacaagacagtgaacaaaatttggggggaattctttacaagcggaagtaacaacaaataaaaaatgccaagtttgccgatttcaggaacgaaaaggatcactgtgttcagatgatcataactgaggccgaggaacagagaaagatgagttcagatcttgttctgaaaacagaccatgcagggccctgaagtccaagtttggattttattccaaattaatgaaggcccttggaagatttttagaaggggaaggtgacatacttttctttcctttgagagatcactgtggctgctatgtggtggatgcctccagggacccgaaggtggggacaaaggccaactaagaaacacaacaggagttcaggtagaagatgatggtggcttagactgggagcggtggaaatggtatcataatttccatttgacatccattttaccaaaggtttgagatttggaatatgagtgaaagggaggaatcaaggtcatttttggtctgagttactgtctgaagagtcatgccattaacagagaaacagaaggcattgaggagctgactcgacggtggcatgggcaaatcagtggttctccttcggtcatgttacatttgaggtgcttatgatataaagtgagaagttcaatacagacgtctgaaagtaaaaagagaagtctgtgttagacatgtagatgtcatgtcttcagaatgcagatcggtgtaaagctctgggcctggatgcaaccacccagggagaaagtctacttatgggaaaggctggggacaaagcaacatttccaggtctgggaggagagacctggaaaccaagaagaaagggtcaaagcagtgctgaggaacaggcagatttcagttagagcaaaaagataaaagcaatgttcagagaagaaggtgtatgggtatagatgaccttggtgatgacagattaaatttcacagacattaggaaaggagtgcagaggagaaggggccacgaggaatagatcagaatagtgacgcatttccttttggtggcgtgcaatctggagacagatttctgaagatgactgaggtgaaagtgatgcaaggaatgatgcacttgcttaaaagcaaagtgtgccatgaaggcggggatcttggcaaagaggagaattaattcatcaaagcaccctgcccttgaaatctcaccacactgctagattgaaactagattgatggcacagaatgggtgttttgttttatcttatctctctattttcttatgtgggaggagtggacatattgcaaaaagcagttgccagacatgcacatttaaatgtactgaaacgcaaggtgatagacaagaaaaatttagtcaaatttatgcattaataatttatcttcagaaaatgcaaatccctgttgtagttattttcctatttctacaaatgtaattaaagcattgataacacaggggaaccacagcatcggaattgagaacaacctggtgtgaaagaaaagaagtgttgaaaattttaagtttccctctcctatgctttctattatttctgtgtgtaaacccaattttcacttcccctttctatgaagctaatgctagatcttatctcttgacatttaaaacatccactcttcctgccaacattcatttgcttctccattgttaaatcggatagtcacaactctgatgtgctgtgttgtagtacctgagctgatcgtatggaggcagatcttatgacgctggccattgccacaagtgataattggcaatgcccaaagagatgctatgaaagccttaatattgttgacgaaaagagtcaaactctgtgaaatatttgaagagatttattctgagccaaatatgagtcgccatggcccatgacacagcctcaggagaccctgagaacatgtgtcgaaggtacagcttggttttatctattttaggatggcgtgagacatcaatcaaatacatttaagaaatacattgatttggttcagaaaggtggcacaactcaaaacgaggtgggggaggggggcttcctcgctaaaggtaaatttaaacgttttctgattgacaattggttgagtttgtctgaagacctgggatatatagaaaggaaatgttcagattaagataagagactgtggagaccaaggttcttttgaagttttatagtggctgcccttagagacaaaagatgtcaaaggtttcccattcagatctttaaaaggtgctagacttttagttaatctcttcaggattgggagaacctggaagaaaaagatctagctgttagtagagattctttactgatgcagttttccccccacaaaggacagctttgcaggtccatttcaacatatggcagggaaacatgttttgggctaaaatattttgattttcttccttgttttgtaatgttatgcctgagtcagagtggaaagtaagccacaatatatagggttaaataaaatccatctgatgagaatttatggtttgtagggcatgactttctagacaacttaggaacttgggcaagataaaaaaaatcagagcttagtccttaatatccagagaatatgatgcattttcataaaaaagtaaggatcacccacttaacactctaccctttcaaaatccactcatattgtaatttgtttgtaataggtgacaatatttttctttcatttatagataactaatcttcacctttatcaaacatgtctttcaagagtatgtaatacatcgattgcagctccaagtctacatcatctgtttttgcatccttcttatttacttatttttctttttgtcaataaaatacatcttaaatatatagtcaggctcctctttagctcaaatagtgttgttttgtttaattagactgtgttcccagtattgcttctatttttttttctttttttctttttttttttaattatactttaagttttagggtacatgtgcacattgtgcaggttagttacatatgtatacatgtgccatgctggtgcgctgcacccactaactcgtcagtattgcttctatagaaggctagcccaaatgcagagaggaaaatggcttgacttggccttaaatataatgaagcttgtacagtgtgcattgtgttttaagtttgaatatgaatgtaactgctacatgtattgtattaaattaatgaacttttattatgcttagcccagtgtatcctcagtttttaattcaagttgcacaaaaatttattattttgcttcttgataaaatgatttattaatattttattcaacctcattgttttaagcttttctgaaacatattccctctttaatcaatgatgatatgctagctttaggtaaacggtctgatgttaacacatatacagagagtataaaattccacttgactcctcaagtgcccatcaaacattttttttaaaactcttttgatacatcttagtcccattctgcattttatatgggtcccattctttgattttcatttgttttattacatttgagtctctttacaaattagctaaatatgcccaaactctaatggtgttgttgtagattttttaaagttacaaaatattttgagattggttttctacttgttgaaactggacttcatattgcagggtaatattcccccatggggccatcagtattcataaatctatttgatttacatgttgaacactacatgttccgtaaaatacctagaatgctgcacatgtggatgaatattaatgattgtctctacaaataataaagcaaagaacaaatgacctctctttaataatctagtgttacagcagtcctgaaagaagtgggcagagcaagggtccccagccctcacagctcttcttatcctttgggtagcacacaagagaaagaagtgcatttgagagagttcatgagcaattttaaaagacttctgtaggaagatagatgcttttatccaaaaaatggtctacttactgatttaagtgattacatctgcattctctcttcactaggaaagaatggccaattaatcaaacttaaagtaaattcatctacatttgaaattctgtcaggtataattcaaatgtgtactttggctggtaccaaatatgtatgctccttttaagaaacaatgccatattttgggataaagttcaactgcaatttaagtcatgaaaaaggctactgggagaatgaccttaattaaaataaatcattttcaaattgttcctaactaaaatatttgttataattttagatgaaattatattgcattgtttactcatatctggaaaaataggtgtagttaaaatactagaagaaaatcagttgaaacattaacagtatttgttcctaaagctatgtttaataaggaattttctgccttctacttatgtgttttaaaaaaattaaagtgatcgtgtattgctttaatattatgtgtgttgctttgataatactttttaaatcagttaaattataatctaaaataaaaggtgattttagtgcatatacatgcatgtgtatgcatgtatatgcatatgtgtcttatatacttatattaaaattttgaactggcaattagggaagtggttttttaaactgggataatacattttaaaaatatgtagtggatgggaatctcaggtaatggcataaaagtgctaatgacctgcacaagcattgaatgaaagatgcaaatgagcagcttaatggaaaaaatatgaggaacttggtgctaaatcattcacagtcaacctgtttctgggctggggtttcctaagcagcggagcacctccctcactaccgtctattgaaagtcagcttttaaacaataatagtaataaataataaaaaataataaaaatatacatatatcaaactttgacaccatggtgtacattttagataaatcaatatttgttagactacagcactaacaagtttctatcttaaacattatagtgacccctaatcaggccttagagtggtgattgaattttttttttttttttttttttttgaggcggaatctcgctctgttgcccaggctggagagctggagtgcagtggggcgatctcagctcctcagctcactgcaacctctgcctcccatgttcaagggattcccctgcctcagcctccagagtctacttaaaacacataaatagaaggcagaaaattccttattaaacatagctttaagaacaaatactgttaatatttcaattgattttcttctagtattttaactacacctatttttccagatatgagtaaacaatgagatataatttcatctataattataacaaatattttagttaggaacaatttgaaaatgatttattttaattaagatcattctcccagtagcctttctcaagacttaaattgtggttgaacttcatcccaaaatatagtattatttcttaaaaggagcaagtatatttggtaccagccgaagtatacatttgaattattcctgctgacagaatttcaaatgtagattaatttactttaagcttgattaattggccattctttcctgtagctgggactacaggcatgtgccaccgcacctggctaattttttgtattttgagtagaggtggggtttcaccgtgttagccaagatggtcttgatctcctgacctcgtgatccacccacctcagcctcccaaagtgctgggattacaggtgtgagccaccgcacaggtcctggtgaggtaatttttaagtaactatgtatctgttcatatgtaagtatatgtgtgtaggagtgcagatgccagtgtgtttggacctctggggaaggagagggtaagcaagagatatgatgcaactcagcctcagatgagctcaatcactcacagaattaattaaggtaattgaccctcattcacttctgggttcctcaataacagcactactaacattttggaccaaataattatttgctgtggagactgttcttctgtgcattgtagggtgtttaggagcctccttgacctccaccctatagatgccagtagcactgtaaccaccagacaggttcttcctgcccgctgaacaaagttaattcatggagaccatagcattgcagtaaagaaatagtttaataaagttgaggccggccacaccacgtgggagacagttgtaactcaaatcaattttcttgaaggctcagaggttaggggttttttcaaagatagtttggtggataggggcccagggagtggggagtgctgattggttgggtcagagatgaaatcatagggagttgaagctgttctcttgctctaagccagttcctgggtgggagccacaggactcaggactggttggcaaatgctggtggggccatccagttttcagaaatgcaaaatcctgaaaagacatctcaaaaggctagtctcaggttctacaatagcaatgatatctgcaggagaaattggagaagttgcaaatcttacgacctctggaataatgggtgttaattatgtaactatgtttgcatcttagcagaattcaggtccctctcatcttcctaacctggtggccttttattagttttacaagggcagtttacttttggggaagggctattatcatttaaactataaactaaatttctccctaagttaaccttgcccatgcccaaaaatgtgcgaagacagccacccttgaggctagaagcaagatggactcaaccatgtcagatttctcttactttcataattttgcaaagacagtttcaagacctctctattgttatatctaaaaatgcctccaaacattgtcaaatgtctggcattttgtgagcaggtggttgggatgggtaggaggttgtctgggattgagaaacacaaaacactgctctaaatttgttaccaaggggtgaatcattttgcggggaatatttcatccagatgctctatagtcttttccatacaactgttgacattcaattaaagaaatatgaaacaggactaaggaaacaacaacagacagtagtagcagatgcataaatgaccagttattaggaattaacggatatacatatttaaataactataacaaacatagtaaaaaaaaaaaaatggcaaggtgggtaattggacaatatccagtctaaagtacagataactcaaagaatattgtttttcctgactttggttcatggtggtttgcttccttgtgtgtgtattttttggtcttcagtttcgagcttatcctaaactccggaatatcttgaaacctaagttcaggacacgtttttcaataagttttgtccatttttgagatgaatattactgttcttgcacctcttcagtcctcatttcatgacacctactccccggcttactcaggtagtcttgggtctatcttttccacctttatggcctgaagtaccaatgtaggaatttacccacagagctcctttcatgtgagcttatggtttattcctcttgcttcagcttatagctcttgttttcgggtttcctgaaggatattacttcctataagtccagtaataaaacaaacaattgatatttggtataatagattatttggtctttgcattgctggaagctaaagcccatatactgtgtgcttcattgtaatatatctttcatcatgctatttcagaatgtgacaattactaaaagctgacatttgagatcatatcaccacctaatattttttttcaaaagtaaaagtaaagtggaagataaacgagaaacttagaaaagactaggtttagaaagtttattaattatacttctgaaaaagcaattgtcattttctaaacggataaaaatgaactgcaaattaaaattcccagtggaattaatgcagtgactcattacataatacatcatgggcaagtaatccatcctttgtactctcaggcaatcggatgtatttaagccaaagataattcaagacaaaagtaatcagggttcctccaacatcgctttttatgtgacatagagcttatcattgtttaaagcatcgaactgcttaggcattctttgttctcttttattgccttcatttcattgtctgaatagcttttgtagtatgatgttaactatcactgtttggactgattgaatagtttatttattttgataaccatcaggtgaaagcaaaagtcatttcatggcaatttcctgttacttcaatgagacactgctttccaaaaatggcaagaatgttcttgacaattagcatttacacgtgattttaaaattttactttgtttttattcttccatatgagctcttttgattttattgaagctttgaatgagtgagacataagcacagtttaagttgtatgatgggagctaaagtaagtttaatttcaatttcaagcaaatactatttattctacattttctatagtcagggagacatgagggcttgcatgaaggacctgcatgtcaaattcctctattttctgacttttttccattaccaatatagacataatcacatacatttggttgttcttacttttccaacagcctccctccctttctctttactgtaattggaagcatatttccatctcttcctctgtctccatccctcccactttgatattcttattaaagtggaatatttcctcttatctggtagaatgtgaggaaaatagggcaccctaatttatttgatcaccgttcagtttttctcggtaactaagtttgtccctgaaagtttctggtctcacttatggttacattgttaattatcttggaatagtgaaaaagatagtcaatatttttttttcatatgtcttcccacagtgtctgaactatttccatgattttttgactattcgcttttgtctttgtagaaaatattcattaggatataatttacaaatctaattttcatagttctggatcacttattgccccagtaaattccattatttggaactgtacctctatacttaactactagtgaatggcagaaggtgtttctctatcctagcttctttagggaaagaaagattatttgaagggaaccacaagcagctttgtttctatctgtgatggaagataacaattttaatatttaaatagatgttgaataaatgagtatgatttttatatgtacattacatagtaataatagtaaatgtctttgggaaaaaatgcaaataataccatgatagatgctatcagagtctaatagattatataacttgactgcacatatttgaaacatttaagtagaaaacaggactggtagttacaactggtgtagctttatgaatctctaattctattacatctgagacactttagagatcgcttgatctagtctctttgtgcagaaaacaaggaactgaatctttgagaagcaaaagtggcttatccaggctacataattaaaactgtcatcaaaatgggcctcccagctgccatcacagtgcttggcccataccaaccattgattcttactttcctatcaggcctgggcatattccagtctgtccaccatttcttgtgcatatccttacaataaacatgaaatttatattttataatccaaattgaggtaatgttccatttgactgtcatacaaggtttcccaatcaaaagcagatgagatagtggttgaggccaaggcatcctgggtattagttatgtatttaaattctctaattaattgtctccaggaaggaaacaaatgtgtacactttggaatttgtctgtattactactaatgtaaaataaacattgcactaaaacttggatgatgattgaaaaaacaatttaaaaaccatgaaagaacaccacaaaatatttttcttacttgaactacattaatgttcaaggtggcctaagggaaagagagagaggaagtgctgttttaaaatgttctctctctctcttgagaaacagcagatttattgtcataataatctcaaaatgcttttgaggaggtcagcagatataaagtacatgcagattgagtgtaatcattatatgaaaaattaaccacatgaacaatgaaatggtactgtggtagcagccctttgtcaaattaatgttctgaagagtgttatttgtgaaatacaaaggctctgaaaataagtggactggactaacttcgcagttttatgtgctacatttgtaactggattccagaaaaaattattaggagaaggagaatttagagcttaacattctgttcacctaatataaagttacagagtgtcagatcagatagcatcatccaattagtcaatttacattgacataatatatatgggacttccataatgaacaatagtcaaaatgtattattttgggaaatcttgaatcaaattatttacaggtatcctgagagatctctattataataattgtaaaaggcagcaatagctttctgaaaaatatttatatattgtttcttttttaaatattgtttaattatacttattttttatttatgtctataatgtaaggtaagggttaaaaatactgtttaaatgcagttgggatatataattgatccaggatcaatttattgaaaaataaacttttttcactgcactgtaacattagcccaccataaatcaagtgaccttatgtgtatgaacctgtttgtggtgtttctattctgtttcatttgcctatttgtctgatcttgtactagcaatccattcttgtttgtttggttggtttttgtgagatgaaatctcactctgttgcccaggctggagtgcaatggcatcatctcagctcactgcaacctctgctttccaggttaaagtgattctcctgcttcagcctccccagtagctgggattacaggcacccaccaccacactcagctgatttttgtatttttagtagagatgatgtttcgccatattggtcaggctgattttgaactcctgacttcaggtgatctgcctgccttggcctcccaaagtgctgagattacaggcatgagccacctcacccagccaatacattcttaaatactatagctttacagtatgttttaaaatctgatattgacatctgtccaccaattttttttttctcagcaaggctttggctatttgtatgcctttgcatttgtgtataaattttagaataaacttgtgaattttcttaacatgaaaactgttgggattttgatgtggatgcattaaatctataaatcaattgacagaattgacagcattgatgttctaatctatagccttcctttttatttgtatattttttaattcacttaataatttgtagttttctataaagaggtcttgacatatttcatgaatattcctattttctgttttttatatgttattataaatgacataattttaaaaatttatattttaaatgtttgtttctactatataaaaatataactatttttaaaattattaaccacttgtatctagggaccttgctaaattaatttattaattgtatgtagcttcttttatattttctacctatataatcatgtcatatgtgaataatgactgtagcatttcttcctttctgtactgtttgtatttctttttcttgctttggggcaattagctatggcttctgtgtaatgttggttaggtgtagtgatagtgagcattcttgtcgtgctcccaatcttggagaaaatgctttgtgaaagctatcagaatcaaaatggaatcacttttgtcaaacccttacaaaaaaaagtggggaatatgaagggagggttcttatgcacaattgcctaataacaagaactatcataagagactgccaaaaccgcagcgttgcacaaagaccaccacagtcttacacacacaaaaatatatatacttatgtgaggatctgcccagcaactgcctgcctaaccttggacggacactggctttgttattgatccttgtagccagggataattatctcaaaataacttatataacctcctcattttaccttcaaaaacccttgtcttttgttttcctcccctgaaggtgtctgtagtttactatgctatgttattccatgctgtactgcccactgccagataaacttattatctttggagaatgtctgtctttctgcccattattaagactgacataatctggtatcaagaaatgggacagaagtaagctcacctggaacagccgggcagcccctggaatcaagtgcagtaccaactgaatgaaccctttgtactctctgcttccaggagtcaccttttctgccctggtgattctcctcttaaattcttggactgcctccttttagtgagttcttttgacttgacttgggaccgcactggtttatccggttgcctcaagtagaagatattgcatccctcttggaactgtgagcctgtcttctctggcaagttctttttaatagaaggacaagtatctttccagagagttcttggatttctgcagaacttacattatttgtgaggcatgtttttttttttctcgtgaattcacttttgattttttcttcatgtttgatttaatgttttgtttgatctgtaccactggcttaaaatttttgtgagtacagaattttgttttatttttgtttggttacatgtgtctaatgatttagcaattttatgtttttctccctcttgtttatgaacatcttttgaaagcaaaaataggcattttaaacagtggatgtgggatggcaaattgaaagtcactagagcagtcaccaccatctttgtggcaccttaataataagagcctcagagaaaaagtctcccatgtcaagatcaactgttacggacaggcaaggtcaccttcaggaacccagtcggttccaagaaaaattctatacaatgaaggaaacttggtcacaggtcaaagaattagggcacaagccatctgccaagtatgaaataaaggaatcttgtgccacgtacacttgtgaaagcaaaacgatttgtccaaatccttaaaattccttgacagggcttataggattatctgtcgctctccagagattaataagaaactgaatgacattccaaaattctaagacatgccaaacccttagactgctatacattcaaaatttatggtccattctcatgaacatttttttaaactgatgggaaaattacaccaagaataatgtatggccattatggagattgttttggccttccaagcttgtttttctcagaaatgaattagaaaagtgcaactagagggctaacatatagtcttttaagtttcctatttttctattttatctctgcctatttgaatatactgacgtttttgcttgcattggaagagaaactctctgctgcaattgttcttgaaactaaaataggtcaaagtctgcttggagattatttttctcatggcatttcaatgaaacataaacagcaaggaattaatccttaatctaatttaacactgagaaaaaaaaaaaggaaaagaaagtaaaagggacttattaaaacaaagttgctagagaaactgctttacccaaaatttgatgcacagccttcataatattacccatcaggacaaatgaaaatcttaagtttagccatgtgaacatttcccattgtgtcagaaactgaatttagattcaattgtccttttataaaccattgagtttatattactattttactgtctcatgactaaaatttttaaatgaaagctataagatctttgtgtgtatatgtgtttatgtgtgtttagacacatatgcatgtgttatgttgtatgttgtatatacataatacaatctggcatagttggccagaaatcctttaaggaattcttttcaagttggcttagagataagatatgcaaatgacacttaaaagtgtaaaaaaaaaaaaaacccaaatgccttttagctcatgggattcatatgaatctttgataaataaattggttttaaatttgttggtaaaataaaaatttgtttcagaattgttagcttacattttgttgcctgggtttgctggttagacaggattacattgatctctgttagatgttttacagtcataaaactataaattcagcttaggccaggtgcagttgctcatgcctgtaatcctagcactttgggaggccaaggtgggtggatcacctgaggtcaagagttcgagaccagcctgaccaacatggtgaaaacctgtctctactaaaaatacaaaaattagccaagcatggtggtggcctcctataatcccagctacttgggaggctgtgtcaggagaatcactggaagccagggggcagaggttgcagtgagctgagatcatgccacttcactctagcctgggtgaaagagtgaaactccatctcaaaaaataggtaaaataaaataaaatatattcagcttaatagcaaaatagattttgtttgtgtagctctttaaaaaagatgactaatattgttggtttaagaaaaacagctgtattttctgagttactggcaaaatacccatatatttcaggttcctacttgggtgatgaacacctgatattcacaggcttcaaaaatagttaacagagaatcaacttgaaatgagaactagcttgtctaatatctcagttttcatgaataatctggtataattgtttaaaataaataggtgaatataaatggtataaatgtgtataaatgaacttttcatgtaatttcagatgttaaaattatgttattttgaattaagtaatattcataaactggattatttccaaataagataaaataataaacattaatttctgatcagaggttcatgtttatttaattttggcttcttaaattttacaggaaaacacaatatatttggatctattaaaaattatatcatgtttcacattaaaaatttgttctatgaggaagcacacattcctagaagttgtaagatgtatattcataagctgttgctatatgacaaatagttcaaaatgcttacctcctaggctttaactagaaattaaagctacaaagagttaaaccttttaattaatatatgtaattctatatgtaagttgtacaaggaagtaagatacctttttcgttaaaaaaaaaagtataagcatgggaaatatttaaattttggtaggaaggaagaataattttgtctaagggttatttcaaagtattaaaagaaataacaacaaagcaaaaagaagccaataattaggggagtgagagggatgcaaagaaggttatgaggaagtgtttttaggtaaagaagttaaaagcagaaagtgaataatatgaaaaataatattgtgtggtcagaatgataaagggaaataagaaaaataaatgtttgtgctaaggtagaatttaaaaagaagaaaatataggagaaaactgaaagcttaatcaagtcgtaaaaggtctgaggagaatgcaaaggtttgtaaagtataatcttatgaaaggaatttgtgtgcaatcaagttggcttaagttagaagagaattgtttacaattctttctaaaattgaacattactatactgatacaaaaccagaatctagtcctctgtgtttaaagcaacacagttttcttggattattgatctgctctcagtgaaatttgcagaaagtttttatttttaattgtaaaacttgtttcttttaattttcaatcattttctgaactgcatcttttgcccaatttacagttttcatttattttttcccaattccagattaaaattgctatgttcttcttttaaaataccaatttaatttcacaaattggagtttcctcttgaagcttttcagattcatgtctcagaagttcaacttttcattgcatctcactgcacataatttgcaggtcatacatcattgcctctagctcttcctccttctcttcctgcagaggtacatcttttcatattgttaaagttgtgactctctccattgactttttagtcagctcctactgcctttttttccccctccagttgttactctgccactgtggtctgatgctggaaaatgtcttgaaggcccagaagagcaatgtcttcctccaggataacttgatctgttctcttggcttttcttgatgtgtctgaattgttccatgtaatgaggcaattttgcatgcttttactttttttaagagccacatattaccctgctcaaggtactagttttcttgtttacttctatgatatgaagtgcactcataacctcgggcagacaattccagtgtcttagagaattctggtatcttttcattgggttcaacttccaggttatttaaatggacttccataagcagacaacaatcacactgcaggaggttcgtgtttgtgtgtttcttaaaccttttgatgatgggcctaagaaacaaaaattttgtgttttatcaagataattccctatgctttatgttgtcttactaggtttttcattagtgagggaaactgagctttgaaagagttaaagttttcttacatccttgtaattttctgtatttatttttgacattttctgtcactctagttaagtgaataattattatttcatgatgacatgtgattctgttttaattaaatgttttaaaccttttgacatctttggcaggcttccccagtatcaaagttctaaattaagtctttttgacttcaaattaactttgggaatttctagtcaggaaattctgaaggatgtgtctctcatcttatgaaagagttattaaacgaattaggcttatttaatatgttgggttgtctggtaagcattgtctaataatagagtgatgccaaatctttttcaagttatatttatatgaatatgttattgatatgaatgttccaaagattatgtaaaatttatagaagtctgatggctctggttggatgctgtcaaccataattctggttgttatcttaaaatgttacatgcgatagaaataaccgaatttcttcatcaattttgtcattattataatgaaccctgcagagttcaaattcatcagatttttaaaccatagttattctaaatctttgtcatctactgttacagttttgtttcttctctaaacacatgtgcattcagatgcctagaaaagactccagtaattactcttgcttacaggtttctgataacactaaactcagtaggccaagcgaaaatttccagaactctgataaagaaactgatacattcatgaaactgctaacaaaaatcaagcagaacaaaaattaattacatgaagtgaaataactaacaaagatgatgttttatgacttttatttgaaacattgttgtttctttacttaaaacgtttcagttgcagatttaaggaaactttccctcttaagctaattataatttacagctatttgacaaaagtatacctttgttttttttttgtttttttttgtttttttttgagacggagtctcgctctgtcgcccgggctggagtgcagtggcgcgatctcggctcactgcaagctccgcctcccgggttcacgccattctcctgcctcagcctcccgagtagctgggactacaggcgcccgccaccacgcccggctaattttttgtatttttagtagaggcggggtttcaccgtgttagccaggatggtctcgatctcctgacctcatgatccgcccacctctgcctcccaaagtgctgggattacaggcgtgagccaccgcgcccggccaaaagtatacctttgtaaactaaagtggaaaaatttactttttatccctatttgatcctatcaaaattcagaaactacatgagtattcttatgttttttaatggcagtatatatgtttgtgtaagttcaataagaatctgctttctttataacagaatagaactggaaatattggctatattacaaaggttttgactgagatgtgatatttaagttatttataggtactacagacaaaacctgaagcctgccttggtttgactttttagtctcaagagatatttaagggtccaatctgagattactatatgtttaatcactattcttgctacatttatgtaaataattcagtcacatttgacaaaattaaacttattttacaaacaaattaatcttattctcattatctttagtaaagattgggatgactgtagagagaaaaattatgtttctaaagaaaaactctaatatacttgttagatgttggccctgtgcatagtttcttagtttttattatctatctgtagactagactggatcttgaattcttctgatataggagttaagaagaaattacttaggcagatagtgagaatatgggagtcctcagtaaggttttccttttaatgaaaagcagcccccaaatcattttcttttcttacgaagagcagcctattgctggcagttgtgccaataggaagaaactacctgggaataggcaggctcaaaatggcagctccatcctctctttgccagccacacgtacagtaaggagcagacaagatggttctggccaagtggaaagtccatttgcataataagattagggtggggcgaccagccttcccacacacaatgtaaatgtcacacctgatccaatcaatctgtgggccctacataaatcagacagtgccttctcaagcttgcctgtagaatccagtgcactctgccaccagcaggtctttccttttcagatacctctctctggcaagagacagacagagacggctgctctcctctcccctttcttctgcttattaaactttccgctccttaacccattccatgtgtgcgtgtccatgttgttaatcttctcagcacaaaatgaccaaccccaggtatttaccccagacaatgatgccacttcacttgtaggttcctccaatccacttttctctcatgaaattagtgagaacaaaaccacccttttctaaacccgcgtagaatgaagctagacaatttgatgtaaatttcaagggacaagacttgtgcctgatgtttgagccacacggcaagttcaccaaactgtcgaatgctgtaaccagagaccttcaaaccacaaaccagggtgagaagttgacaatttcatgctgggaaaaattcttcccaagacattgaaataagattccttatcataatgagactcttgcccctcttaatttttccttgcttgtgcctacctttttcacttggcaggataatggtatagttaaaatttcacaatcaatagcttctgcaggaagctgtaaaaaatgttgcatctgtcatgcccatcctaaatatttacatgccctgacagataagcccttagcctgcccaatgggtaacttcaacagcatctctagtacaactgttgctcattctgtgttttaattcaacccagctataagatacgaaatgatagaattgctctagattctctattggttaaataaggagatatttgtgctattgccaataatacatgctgtacctggataaacccctttgggcaagttgtgatgcaaatactcaagaaaataggccacatagttacaacaggacttacctaattccccatggtcatttggctgattcagtcagttgctttcaagcctaggttcttggctcaatattattacataaactagaattttcctattactattaattttactttgtatttttctttataaactttgtacttattgcttgtcaaatttcagcagaagtacaactcctgagagaataatgctggctcagagttttgagatgataacccttgtctatgaaactgatgaagttggacttaacaacgaacactccccacagaactcctgatgctcaaatgtggctaaagggtttcatactgactcctaatcagcaatcacttccctctgacatgggatcagagttacccagaacaagttcatcctggcactgatggatgatgaaaatctaaccacagaatgattagtcagcaatggttttagagacgtattttgatcaaaaggggcaaatgtgaaagttgtctgaatcaaaatgaagtcacttgtgtcagacactgacataatgaagccaggaaaggccatgaagaaagcattttcatacacaattgcctgataataagactttgacaaaactacaatcatatacaaagccattgcaacctaatacacacacacatacacacactcgcgtgcatgcacacgcttctgtgaggatatctgcttgtctaaccttggactaatgtcagacttgtttttgatccttgcaactaagaatagctgtttcaaaataactcatgtaaccctcctcactttacctttaaaaacccttgtcttcttttgccaccctgagtacttccatagtttactatgacatgttctgcattgctgtgcgtgttcctgagtaaacttactatctttggagaacctctctctgttctgttatttaagatgaaacctttcaatattatacttctaaatatgatgtttgatataaatttagtttagattaccttcatcaaaataaggaagttactttctatttctttcttatgaatgattttaaatattgtctaatatagagtatatatgttgagataatttttttttctgtcaaaggtactatttattttgattttaaaatgataaagcaaccctctattccttgactaaatctacttatataaatttttttgtatatttctgggttcaaagttcatgagattgatttgtaacctccttttcctaatgtctttatgttatttctgtatccatgctattctagtatcataatatttacattctagatttagtttaacttcatcttatttttatggaattttttcacttagatttaccctatatttgctttttgtttttctttatttgcttcttgacttcagtgtttctctttctctttttgatcttttatctaatatgtgaagaaattttttctttaacatttcttctgataggctcctctggtcacaacttctgttagtatctgtttgtctggaaaagttctgatttttgccttcaaatgaaaggatatttttgctatgcacagaattctaatttgacaatttttttcagaatttttaaaatgccatttcatcatcatctggtttggccatttgttttggtaattcagttatcagtcttgttgctttttcctttgaaagtaatgcatctttttatcttttactactgtaaaaatttttccctttttctttgtcttgactttgtcatgactgtgttatgtctctgtggatttctttttatttattctctttatgttccatgtctcagatctgtagtttgaattagtttggcatttgtgttagtttgcaaagactgtcaaaaaaattattaaagactgaatggcttaaacgacagaattttaattctcacagtcctggaagctagaaatccaagacaaagatttaagtaaggttgatttcttccaagggcgtctttccttgtcttgtacatagccttccctttgtgtcttcacatgatctcttctctttaatgtgtgtgttcaaatctcctcttctagtaaggtcaccaagattagggtcaccttaatgatctcctttaacattaattaccactttaaagaatctatcttcaaatataatcatactctgaggtactggtaattaggacttcaacatataaatttaggggtgggatatttcatccaataatagccgtgtaaatgtcttatccattatttcttcaaatgtcctttctgcctcattctatcttttctccttctgagaacccaattagatgcatgagatacaatttcaagtccaatgtatctcttatgctcctttccccaattctttttcttccctatctaatctgggtattttctactatcctatcttccagtttgctaatctttccttctgtgtctagtctaccatcgaatatccttattcaatttttaattttactgtatttttaaattcagaatttccactttatttgttttttacagataattgtctagtgagtttctccacacagtaatattttttgaacattttaaaagtaatagatattttagtcaatgactgatgatttaagtttgttacctgcatcattttttaatctctttctattgtctgtttttttctcttttatttttagtgaatctgtcctgtctcttgacatacctgtttttgttttgttttgcatttttgttgttgttgttggttttggtgtgtttaaacattgtttatcaaaatcggtagaattttgtaaatgatatgatcttccttgagggacagtttactttttttctggcagatatatagatatagatataaatatagatatagatatatatccaattaggaattgagataatatctaaagtgaaaatctgtggtgtttatggaatgtttatcaatacctccttcttgaaggttgctgtgttccaattactgtatttgcagcaagatcaaaaagccaaaagttctgcctagtttattcatattttagatattgttttctgcttggcatttcaacctcttgccccaaatagtttcggaagtgacaaatacatcaaagagattatttggatagaaggtagaagtcactttccaatggtcctcttttctctagtatcttggccacttaaatcctggttgcctttgggtttacttaatactgtttattggatttttggtaatctaaaaattatttcttacaacagagacaaaaattccaataggactttaaagtggaaaaggagtcggttgaagaataatgtcagtataagatattcgtataagatattatttaaattaccattaaattaaataagcatagtagcattactggctgggcacactgtctcacacctgtaatcccagcactttgggatgctgaggtgggtggatcagtcgaggccaggagttgggtggcgaaactccatctctgctaaaaatataaaaattagctgggcgtggtggcacatgcctgtaatcctagctacttgggatgctgaggcacgagaattgcttaaacctgggaggtggaggttgcaatgggctgagatcacaccactgcactccagcctgggcgacagagcgagactctctttctaaatatataaatacataaataattagcactacttaatagagaaaccataagttatctgaaacatattgtcggcagagggggaaaaagaagaaagcagaaattcattttagaatgagaaacatattaggtgtgaaaaaactatataccactgtcatatacaaaaatataatatgtgtaggtctatttgtgaaaggcttttactctttaggttatatagttcttgaatttttaaagctgttcagacactgtaccacaacctcatatcacagtggtacccagaaaatccaaatagtagtacttgtgtaaatagatttctatttcagcctctttaaaggcagttatgtagatactcttaattttgaatttttggaaatagggaggatcattatttcctaaaattatagcacttataagtggtagatagggaattctctcgtaggtctcagactccagagcacaaacgaccaacctttatgaaatatgaacttcctggcttcacttccatctgggaggagaaatgtattcccccttatgctaatccattccattcaggacaatgctcatgggtagaatcctatttattatagtatgttaaactctacttctctgtaactcttacttattaatcctgcctatgatgaatgtgctgtaaaatggcaaagtcaaagcaaatttactacatccttaaactttaagcttattatgtttctggcatttggggctatacagttcccaggttctgcatatgtttgacacggcttcatagataaaaatggcttacatcccgaatatgatgctaaaaactgttttccaaaattggatataaaatgtgtgagtaggtgtatacatgattattgatacgaccttatttttgaaaataccatttaactacataaattatatatagttttacttatgtatttttaaattataaactatttttatttgaaataatttcaaacttagaagacttaagaatagtacaaagagcttttttgcataaactatttgaggataagttgctcacatgaatttgcatcatcccaaattcgcatgtacatacattctcacatatgtgtaaactcgtatgtatgcaatattctttctaatgtctgcgacttggggaagtttattttggtagagtcaaaaacaaagactaataaaaagataagctagaagaaactgttgttttatggtgaatttttcttaattttaaaagataagcctatttgtgaaggaaagtatattatgtatttttctattgattttgttgttcaatttgtaaaatatatttgctaattatcccagatttgggaagaaaacagtttaattagcacttctgaaatgtgtattaaggaagtgacagattcactgagactttttttttttttttgagatggagtctcattctgtcacctaggctggagtgcagtggcacgatctcggctcactgcaacctctgcctcctgggttcatgcagttctcctgcctcagcctcctcagtagctgggactacaggtgctcaccaccacacccagctaattttttgtatttttagtagagactgggtttcaccatgttggccaggctagtcttgaactcctgacctcaggtgatccactgctttggcctcccaaagtgctgggattagaggcatgagccactgtgcccggcccactttttaatgttttaaagcgttagtaccaagaagttcaaagtgactagagcctgattctaccctactcctttctcctccccaaataaactcatcttcaagaaacactttttttaatttttttttttatttttttgagttggagtctcactgttgcccaggctagagtgcagtggtgtgatctgcaacctccgactccctggatcaagcgattctcctgcctcagcctcccaagtagctaggattacagacatgtgccaccacgcccaggtaattttttgtatttttagtagacatgcggtttcaccatgttggccaggatggtctccatctcctgacctcgtgatctgccctcctcagcctcccaaagtgctgggattacaggcgtgagccaccgcgcctggccgagaaacactttctatagaaacatttatctgattatatcaacgacaacactttctttcactggtgcatgacgttgattgcctgtgtgtgtccttcagcatttatctcataaagtaattttatggtgaattacagttgagtgtgtttgtttacaatctggaatgaaatcattaaagtcaatgtcaaagatcagccagtatttcataggacttatgtattcagaaatccataactgtgtttcgaaagcagggcactgcctgatgaccaatcaatgggttttgccagctagaaaaaaggagatttttactctaatttacatgggctgcttcatggtggactacactggttaagaacttcagctctacatttcctacctcagtcattcactgactttttaaacttggacctgtcactcagtttcagaattacttttgtatatgagtatgatattactacctaatttatagcgtttttgttagaaaaaggtgaatcttgaatagtttttggtgttgttgtagaagccatctcaaggttcaaataatgagataatctgttagaatcctaaatgacctcctctgtgatgttttgctctatggtttggaaaacctttagagatgagtgtggcctggcgcttctcttcccattttcaattttagacactctaagacagagaagagaaaattatattagtacagaatttgcttaaatgtcttagttcctcacatagtccatgactgattactttaatccttgtgtactaagaaaacacaaatagaagaatcgacatttatctgtattttaaagttatgagcaactttttcttggctaacgattgatctgtaatgtcaacgtggcttgcattatatgaagttttactggctgttttgaaatggaaggtgagggtgcctcttcactttcaaatgtctgaaggaagattactgtattcgcacaaaaatatttgtacttagctgaaatggcacagaatattatagttctcaagtgtttaattccttctcatagaaattgcaagggaacttaggatgcatttggcaggcgctttctctagtgcaatcaggttgctatggcaaacctattattttaggcgaagaaggactatgttagtaaagtgctaatctattttctgttttatgtgagcctctaattactccccaactattgagcacatactgcaagtgtggtttttatcattttaaaaagtgaaaaaaaaaataaggtcatggagagtgtgcctactgttaccacaccagcaggtgcatttgatgatacagtgctctcctgaaatcatctcattctgggtcgggaatacactttttttttttttcatagaaaagtacaatgaaaaaggaagtgaacaaattgtatgtgagtaattgaactccaagcctcccagctgtgttttacttattaaaatatgataataatatctaatatttgttgaacacatactatgtgccaagccctgtactgtgtagtttgtacacattataacattcagcccttacaatcatcctgtgctatgggtattatttttactcccattatgcagccacaataaatgaggtttaacttattcttccaaggaatcacatttagttgtgtatgcaccaagattaaaatccagacctattaaaagttagagcccacatttttaattgtacctgtgccacaaagtgtatttcccttttagacacttaaacaaacacattaagactcaaccccacattatctttgccagaacctttctctaaccctgcaggccctgtgtgcacgtgcattttaccttaatttcccctgctagtaaaagtgttaaaacatccttctttcttttgtatctcaatatctagcatgatacttaccccacagttgatagtcaaaatgtgtctggggaatgatcaaagtaatgcagacatttaagattgtgagccctgctaaacctattcttcagcaagaacatgtgtgttctctatgtggggtagttagaaggaagttagtattcttcagcggaacactttaaatgtgaccatatagggaagaaacgtatgtgtatgtgtgtgcgtgtgcctgtgtgcatatgtgtgtgcgtgttgcatattcagtcatggtttctgaaggtgattacaatttttaacactagcagttcaagtccaggcatctaccctgtggcttctgagtttacagattttcaccctttcacaaatgtgcaaaaatgttactggtggtcatgcagaagagatgtacttggtcctgaataaataatgactttcctgaattagttatctgaggactctcttgattgtcaatccatgaggttagtgggcgactgtgtctgtcttgttcgtcttcttgtctccccatccaagatctagaaacttagtccctgctggtttgaaacctgtgtcatgtggaagtgagaccttaaagcgagaaaatcaaagaaagtgagggaaggagatgtcaaagtctaaggcttgagatattggttgtggttgagattatgaaaaaagaggaatccaagaagaaaagaaaaacctggaagaaagagggaaggagtgaaggtggtgtgtgtctgtgtgtgtgtgggtgtgcgcatgtgcgcatgtgtgtatatgtgtgtgtgtgttgggagagaatagtcagaggggaaagggagggagtagaggatcaagaagaggcagagaaggagagaaaagaggaagaggaatatagcttgaaaaacaaatgtcaaacttcacaatttcacaatctttaccttataccagttttagaaaattaacctctaccagaagttgacaactttccataaggcagtgcttccagatatgagtcatccatgaatgtttaactattaaaaaataagacagacaatagttaaataaaagattgtggaacaagagatgacctttccatttcttctcttaccctctgattatttctactgtaactacactccagcaattaatcaggatgtgaaccaatgaaactactaaagttttaatctatttgtaataatgcaaatgaggcaatctgtattttataaaggtcacaagctactctttttcattttgtcttatactttagatatactgacttaccctataagtaaaagaaaagttcgactttgtctttctagtattaaaataatagtattttgtttatataaatcttgcagtatcttatggataacattccaaaaaaactgtgaatgagagtttcttccaggctatatcaagtaaaatttagtaacaaagatttcagaaatgtcaagtatttcaatgaacacggtaactttcctaaaagtgtaattatttcaagtttgcagttaatttccatcatatttactaaaagacaaaagtaatttcatgttcacaatgatcaatatatattacttctattgtgaataacccatttttgccctcagttcatttttcttttgctcatttattattagttatttttattttaacttatacacatagtaatgttttcttagtgtctatattgtttgtacaaatattttgtccttgtttattgtttatattttagtcttaggttattcattgctctatagaaattgaatattgaatattttatggtcaaatttattaatattgtcctttatatttctgatttggtgtcatatttagaatagttttctcacccaagtgttatgaaaactctcacctatattcttgtctagttttatgacttaaacttttacatttgaatgttgaaacccctggaaacgtatttagttgtaaggagtgaagtaaaggaaatgaatatttttgaaacatggctcaccaattttatcaaacatattttttgaataatccattatgcccagaaaagtatataacataaatttatagcattatgaatcatataaagtaatcacatgcccagattcagaaatagaagaatgccagaatcctaaaagctccattctcacttctctgaaatcagcataccctctccctaaaaagataacctttattctcatgttcatgtaatcacctctatacctgtctttaaagttttccgcctagatatatattcccaaacagtgtgatagttagacgtgacttttttggaattaatccaacagcatgcattgttttatgactgagttctcgcactctacattatgttcttgagactcaggcattacgttgaatgtatttgcgattctttcttttaattgctatagtgtttcatttaagaatatagctgatatgtaagtattccgtaattgatgaacatttggggcatttctcctttgaagttgctaagaataatgttgctatgattattctggaacatttcctggttcacatgtgtatgcttttttctctagggaacttacccaagaattaaattgctgattcttagattatgcatgccaacttcactagataatgccaaacggtccccagaatattctaccaatttatattctcaccctctgcaaaagacttatctgtatttccaaaccattgccaatgcttattagggtcagtttttaaatctttgctaatctgattgggttggggcagaatctttttgtggttttagtctgcatttcccatgtgaataagaggaggagtatcttttcatatatttactggccatacaatcccatttgctgaagtgcccattcagatctcctgcccatgtctttaatggattgtatgtatttgttgttgttgttgttagagttctttaaatagtttggatatgagacagttgtcagatatgtgtgtcactgatatcatctctcattctgtggctcaccttttcactctcttattttctaatgtactagagctcctaattataattcaaatggttaatattttcttttttagttacttactccagcaccatttatgtgaaaagtcatctttcctttgttgcttttcagtgtcaccttgtcctaatccagtatttgtatatgcaaggaattgtttttggattctctattctattctacttggtctccacttccaccaaaatccaacttttatgattactgtgcctttaaaataagccctgatatctatttcaaaaggtatttctacctccttcttgttcataagtattttcgttattggtgctttccatttctgtataaatgtcataattggcttttaagctttaaaaaatcctgataagattttggttgtaattacatcgaatctatagatcaattaggggatatttggtattttaacaatattgaataataagcatacagtatttcttcacatttaaatctcaaagctttcatttgtctatgctgcatatacatatgtgatttatttttgtatatatgtttgctatagggcaactaatatactctcttaataatccatattatttgttagtagtttttgcattgtctacatgcacagttttcggttaagtaatttttgtttccttctttcaattctttatgtcatctttttatccttaccatattctaccgacaaagacatctagtgcaatgttggatagaactaaaagataaatttatctttctcttattcctaatccaaatagaaggttttaaaatgtttaccattagcaccaaccaattattattattaagtgcatgcatatcctttaacattttttctctcttcctctttcttcctttttcactagtaaaacactttatttactatagttagaggacattttatttggttgaataatataaaattgatgacgtctgactatttttgacttataaaaagagtcattttacattgttcagcttacctgttatgacatttctccacttattttccatagatacacacagactctgtttttaaagtatttctgaatattaccatacttgttatttcagacaaatttgagaatcatttcatcaacttgaaaacattcagtgagtttgattggtacaatattgatttattaattcaggaaaaatcagacacttcttaataagaaagtatgtccttttaaaaattataagtcttctcctatggccttcactatgactttatatgcaaagttgtataagttcatttattttacgttgctgatatttttgtacatgaaacaattttccattatattaggttgggttagtgttggcacataaaaattttttcatttctgtatgttaattttgtcacaagataccttgccaaaatgttttattcctttaaatgcatttgtaatttttaaaatcttgggcataaagacagaccatctgctaataatgatcttggctctttattatattgtttgtctaatttttattaaattgcacttaaactataacaatggttgttataaacatctcccatctctaacttagatcactccctgttaaccataatgttggatttcttttgaaaagattattatatatacctgttggcattagtatttaagcaattttctagaatagtgtcttctcaggggatgactctaggccagtgatatatttgagagtgttcatcatgtaagacagttgtttaatccatgggatagcaggaaattttggaaaatatagaggaaagaaggttcagggctgagccatggggcaatccaagatttagatatttgtataaagatgagaatccagtaatatagcctaagaagaattcgtaatccaataatagctaatagaagaaagtatttcccaaaagggcagggtcaactctcaaaagcttctgagaggttatataagatggtacagagaattggccactgggttggggtcattggagacattgctgaagaagtacttgtcacatagcagtatcttgaggtaattggattgggttgagatgagactggagttaagagaacagcagcaaacttctttttgggaagtttactttaaattgtactttgctgctatgcttttgcaacacaaggtgttttctatcttttactcatctatgttttgcccggttcctatgttactcctcccggcaaccaccaccaccactgctttcccctattagaatgaagcagttctaactaagcctccttttcctcctccttattctcctgcttctccttttagctgcctttgaggtttagtctctcatatatggcaaccatataaagagaaaaaaataatgtgatgtatttttcatggattatgctgagataatttttgaaggcagttcactgttagtgggagaaggtgctgtggtctataggtgaggtctggaaggacttcagacaaatattcaagtgctgactaatttataaacccagagcagaggttttacttccagaattatttttacatataatatattcaatctaatagcattaaaatgctatccaagaatacacatagcattctaaaattttaagcttccgttttaatgaatactttaaagattttgagctagtcatatagaagattgggtttaaggttagaatgagataatgtggattatgttgagataatttttggaggcagttcattactagtgggcgagggtgctgtggtctgtaggtgaagtctggaagggcttcagacgaatattcaagtggcaactattttataaacccagagcagagttttatttccagaattagttttacatataaaatattcaatacacaaaatgctattcaaaaatgcatataacattctaaaattttaagcttcctttttaatgaatactttaaatattttgagatagttatatagaaaattgggcttaaggttagaatgagataatgttctagtaaattttagctgtctatatattctattaaacaattattacatatattgtgaccttttagttttatactagtagcatttttttattatgaagttagtaatgctggtcaaaatgtttagggtttaattttggtgatataatcattcctccacattttttggtagtcaatatgcagtaaaatgaggtaaatgctatagaatagcagactttagagacatatatatcttttatttaacagtgtactcccatatctaatcgtgtatttcatacgaaacagattcttaaatatttgttgaattttatataaaatattttggagtaagtgaatcaaggttttcacattttcatgtagttcttatgagaaaaaaatgtactctaaggtgaaaatagacactttatctgaatcttatatcttaatgattgtgggaaaatataaatttaaagagatttaaattaagagtttttattaaaatgattacctgcacatagttgggctttttgcttatatcttgacttataatttgtctatattttacacaagttcagagtctgaacttgtttgaatttttaagtaaaatctattttgatcggaacttctaaaaatctgccttagttcattattcttctttgatagcttataatgagctttaaaatataattcataaaaaatgcagttctttatgaaatgatatcattggaatgattttatatgtgcctaaagattatctactttattaaaacttaataagagtaggcagactcaatgtagagtaaatttcagataagttttggttggatgatattgatgatgttggctgaattaatttcttctcacacagttatttctatgctcctttctgtctgtttctgaattgtcttcttgcaaattacttgctttatttttatttctttgggtatctctttttttagattttcttttaaatatgtcgtataaagtagcacagtgctagaaaggcagatttccattttccttctttctcatgtatgagaatattaatttggtattgatttcagaagccacagttgtatctccataacagtaaaacaatcactgaaataataataataatattatttagtaaacaaaagaaaaagattggactcaatttcttatctgaaatcaagtcaataaacctgtatgtcagcatccttctactacattaagggagaacttagttggctgctaccaagatacaaatctcaccgttagtctggaccgtagtgattttatcatttaacaattgggttgaggcacttgcttatctagtttaaactttgcattcagtattctactaggtatagacaaagggctgtgggatcagaaaggtgacaattcttccaggtaaccaacctgggatggcaaggaaggtttcagaggagattagatttgggctggctatagaacaccgagtaggactttacagagaaaatggtggtgtgcaccacggagggaagaaatagggaacataaagtctctgaacatgagtgctctataattgctggatatatacttgaaaaggttaagttggaccatgtgtggaaaactctgttgaagaatctagtctttgctttgaaggttacatggggccatcagagggatttgtgcaaaggaattacacaatcatatgtatgtttttaaaaagcagattatgtggattttcacagaagacccaagaagaagagtaggtttgtgaatacagatgatgaatttgtcgtgggacatatttaattgatctgaccatggaaaacacaaatgaaggtattcaggcaattggaaatgaatatctattctgggagagatataccatttcaaattcaagttctaccattaatgctcatgtattgtgtgaatatttctatagtatttatatatgattactgtttaatgcacgtgttcaataaatattgattcaaaacattatgattgccgggcatagtggctcacacctgtgatcccagcactttgggaggccaaggcgggtggattgcttgaggccaggagttcaaaaccagcctggccgacaggtgtaatcctgtctctactaaaaatagaaaaaaaaaatcatctgggtgtggtggcgcatgcttgcaatccgagctactctggaggctgaggcaagagaattgcttgaacccaggagacagaggttgcagtgacccaagattgcaacactgcactgccagcactcaagcctggggacagagcaagactctgcctaaaaaaaaaaaaaaaaaaaaaaattatgaggacacataagaagcatacttaattttattgtatttgtgaaattgtgtgagtaggaggatgccaatgtcacagatttggtgaagttttccttggaccttgaagaatgattggaaatttacctgataggtatatgataatgactgaaacaaaattggtagtgatttgtggtagtggctaaatagaagttgtgaagtgaggcagcaaaataataaacttacaaaaattagccaggcacgtgcctgtagtcccaactgctcaggaggctgaggcaggagaattgcttgaacccaggaggcggaggttgcagtgagccgagatcatgccactgcactccaacctgagtgacagagcaagactctgtctctaaaaaaaaacccaaaaaaatatggaatgcatgaagaatttactcttttttacctctctgtctgcaataaattagcctttcctaatgcattatattttaattgttaactttttaaaaaatgttgtggatatatagtaggtgtatatgtttgtgggagacatgagatgttttgatataggacacaatgtgaaataagcacaccatggaaaatgggttattcatcctctcaagaatttatccttttgagttacaaataattcagttacactttttcacttattttaaaatatacaattaagttattattgactgtagtcatcctattgtgctaccaaacagtacgtcttattctatttttggtgcccatcctaatacgttatttttgatttttatcagaagccactgtatcttataaactgtattagggttacatgcaaaaggttaattcatctcatagttgccttagtattagtcattttaaaactccaatagatacatggtgaaaaaagaattggaaattggttactatattctctgatattttaaaaagatatgtgaattgttatttatcaggaaagaaaatgtgccgacgccagaatattaacactttattgtctaactttacacaaaaatatgggacagaaattatccacaatgaaaacaacggaatgttgaaatctgaacacatatgccagtgtttagttcatcttttctgaagaggcacagaagccaatgaggcacattcaggaaaattacttaaaatgtgaattacttaaaattacttaaaatgtgaataaatttgtcaccatgaatacatataccctgaaacgtagaaactggttctatgtaactggaatgcattgcccctcaggaataatgcaactgatgatcatggcttcccacatctgtgtgtgaaggaacagttcaccatatccagaccacactgctgatggtactacagtttgcctctttctccccacagcctgcattattggaatcatttgcacatccacccatgaaaaagattagagcatttatgcacattgaaaggtgactggagttcagaaaatctaggttctaaaaccaacactactaatagatagagagctggccttgggcaaatcatttagccccagcatgcttgagtttcctcatctattaaataaattgaaggaagtcatggatccttctgacattttaccaaaaaaaatgtgtattggtatatttttccagggatagatctgtgttctgccagttatggttcttgattacaaacaacaaaaccaacttcattaaaagggataaaaaaatattttattagaaggctttaggctcagaatgcaactttgaacaattagctcctgcagcaacctggggaagcaaggcactgccaagaaccagttcctgctgccatcacttctgaatgtcagccactgcaggctgagcttcaaggctcccagaattgctatgctgttgcatttgccacactgcccacagacgttgtgcctttgctttcaccctcaagaataaaagccctgaccaagggtgtctgatgtgtgcctgttctagctgccagggtataggaagagggaatatcgttgaaggagggacccctgcctcctgctgaacctgggactacctccaagtagagattagttgaaggtcagccagcacaacactgtattgccatgtctttcaccagattctcaaagggatcgtgaccccatcatgtcagctagaaaatattatgaatcattgcattagattatctttaattacagctctgaaattatatgatcctaaatactaatttttctttcccccatcatccaccaactcagaatttctttaacaagatacaagttcagcaacagagtgactaacaacattgcaaggtcagccctgaagcatcttgtgattatttcagtgggtgtgtaattatgatggttgggctaatgacagggagtaacagatgtctcggagcactgtcacccaagcaaatttctggcaaaccagtagtgattcctcaaacaaaagaaatttactttctcatatagccttccggtgctgcattagatgtacattaagatacaatgtggtttaatggttagttgtgcaaactttgaggttaatgagaatggatgtaaattttgaatctatttcttcctagctggttcaccattggaaagttacttggcctcaatatgtctcggcttcctgtttagtaaaatgattgtaatgattctagtcaatgtgtggtgttggaaaatgaaatgatgtcatgcagggaatgatagtgtttgacacatagttaccactcaataaatcatgatgaaagtcagcataatgggactagttaaggggttcccaaacgatgaaccaaattcattgcaaaaatatttataattttaaattttaagacgaggataataaagatatttaggttatgctctttgacataggttctatgctaaaatgagttctatgaactataaaattgactacaaatagtcactaaaatagcacattgaaatattacctatgaccactttttttttctcatggagcagatagacccaagattaaaacattttaaaatggccacatcatactaaattatgtcagtatatataatgtattatgttatgttcaaggaatcatcaggataagttgtatatgaaatagccagagagttttataatggatttattcaaaaatgaatgaaacaaaaattagagaatagcaaatgtgaatgacttctgagacagcaactgccacttccactccagaccaccacggaatttcttcttgaacttcagcttaccttagggaggttggaaatgtgtatttgtgtaactattatcaggcacagactggaactattctaggagatttgggtttaatagtgtgctcgcctccttgaaagccttagtgattccgggactctcctcataagtgtgcactttctttatactttccaggtaaatgtgaatgtggcaaatgcacctgctatcctccaggagatcgccgggtgtatggcaagacttgtgagtgtgatgatcgccgctgtgaagacctcgatggtgtggtctgtggaggtagtaacctttctcatagctgtatgctacctgcatgcaacttgctttacctgcctttgttattctactgactcttgctttttcaattgctgttaaaaataagataaacagaaagcaatataccattgaacctaaaagcaatatacaattaggtttgtaatgacttttatttccctgaactctttatttagcaggtatgtgaaagtacgcagtacactatcaataaaagatcattgaatctaagtactaagatactttatgatcgtgaaaggttttggggcaagtcagcattttaacatgattttcattactttatttataaacactggtaggagaaagtataatatcacccacaaacttgaaaaaatggagtaagattactcttagaaatcacaagaggtatacgctcagattctatgatgcctctcatacccaaacaagagctcactggcattaataaactgtccagagaatgagtgaggcagatagaaggtagtgagcagaggtaacccacaaaaatgagagtcccaggagtagagtgctgatccgagcacctccatggctgggaatgtgggtcaacattattcttgcattgcattcttgaaaaagttcatatcgctgaggctgatgcatgtgaattacagatctttccacgtttccagtataaatgaagtgatgtggacatggaattacattacaagaaaataattatatccctttattgggggaaagaaacagaatgtgtgtcttttctaacttttattttaagttcagggatgcataggtaggcttgttacatatgtcttattggagggtggagggtgggttgagggagaggatcaggaaaaataactaatgggtagtagagtgtgtgtcttaatggaaggctgaggcaccatccatccatcctatctgtctgtctgtctatctatctatctatctatctatctatctatctatctatcatctattatctgtgtatctattatctatctatatcaatcatccatatgcctgttctctctctaaccaacgataagacatttgaaacctgacaaaaaaatactttcttctttcctttctctgtgagttgaggggaaaagcccttttaacctgttaatgactgaggttagacttttttgaatttttgcagtcagaccttggtgatgacctggagcagtaggatataaaaaactcccacatgcttagcgtcccaataatggaacaccaggcataaattcgtaaaacatctgctgtgctgggcagtttatcttatgccattgtcatggcagccaccctaagagattgtttctactattttttctttcataaatggaaaatagagtgaggttggagaagttaacatcccataactaaaatgtggcagacccagaatttcagctctgatatttagttcacagatcgttccttatgtcagtcacagttttccctagagtgacaccaacgtgttttaacaatatgtcaatattattcttaggttaaatcctctgttcactggtattagttaaccagaaatacctatgtaggttttactctttttgtttgttaaggacatgacatatattaactcatttatttatcatagcaatatgtatgtatgtatatatacgtattcatgtataaaaagcttgcctggccccttgaaagtgccatctacatgtctctgctcttgttaccattgttacttttcttttcttttcttttcttttttttctttttgagacagagtctcactctgtcacccaggctggagtgcagtggtagaagcagagctcactgaaacctcaaactcctaggctcaagcaatcctctggccttaacttactgagtatctgggactacaggcacataccaccacagctggctatttattttttgtggagatttgggggtctcactaagtggcccagattgatcttgaactcctgggctcaagggattctcctgccttggcctcccaaagagctggaattacaggtgtgagccactgagcctggccagaaatggcttttgtatgttttttctgtctatttgttgctttggagtaatctcagtctcttccactttcatatttaggtcaatgtctcttgaaatgattgatcagcaatcagtcatccttggctttagattcttttcaatttctaataaaagattttcatatgggaattcctccaaattacgcatggtttaaactgaagtaattattttttcattaactaaacaaatattcattgagtgtctactatttgccagcactagacattcagtggtgaacatagagcatttgctctcctggagcttatggttgagcgtgaagggaggacattgagaaaggaatgaaaaggagctgagtgatctgaaaagagatttgattcaatgggaatatacataacggggatttaacataggctgaaggctaagaaagacttctctaatgccttcatatctggataacaactatgtaatgcagactatgtgctttacaggtattaactacacctcacaacaatacttggtagtaataggatacatggaacttggccaagtaggggaagtggggtacagtcagagagcagcttgtgctcagttgtgtgggagaaaagagagtgtgtgacgtgtgccaggaacatttgaggaccagagaaaaaccctgtgtgattgcagattagaaaaccaaagggaaaagagtgtgacgtgttttgtaaacatgttaataacttgaggctttactctaaaggtgacaggaaaccaaaggaagggcttaaacagagcttaaacatgatcacagtgttttaaaaagtacttctggttgtcagatggagtatggattgctccaaggactatgtgtgtttgtgggttggtaggtgaatctggatgttaggagatgagccctggtgagagatgaaggtgccttagctggatggaagacagtaaaggtggaggatcttgaatgtgttggagaacatgttagaagcagtggggtcaagagactaacaaaacccttcaccctgctgcaagagactccagcactctgttaaactcctagctctggttccctggcaacagatgaagatggtgcattgcagtgttaacaagcaacattgctcatggtcataatgatttatgattgataagtttcaactacattggaagagatgatgaattgaactataagcagctgatgggaacctcatgcttttggatttcataagtgtcataactctgccaacagtcttgtcccttgtgggctccttgaaagctgtttacggaatcatcgggaaagattttggctcctgttgggcgtgcgacttcttctaagccagaaaagcctcaacatctgtgcagtgtggatctcatctctgtgcatatgggctgtgttatcccaagagaaaatagtccccaattatatgagttcatcctcatgaactcctgcaagaactcccatgggtatatcctggtgcctgacagtgcctgctggtaagatgtggctcctgtcccacagccttcaaaggagactggtggcaagtgtcagcctgagagcttagttgaaacttagagctccctccccagagtacaagcatatttaaggaaattcatgattgcacaatatgaggggcagggtaggatcaaggatgacaccaggtttctgttttgagcaactgaatggtggaggagactatgcttgtcttgaccagttgtctccatttcttgaaaaattggtttcttcacagagagcaacagagatggagaaacttggatatgttgctccctttggaacatatcccttgggtatgttagttccctctcctagtccttattgtcacttctccttgtgaataacttattgtctttccattcttccatgatttttccaaattacctcctataggaagcctctctgaaatgatgtcctacttcctctataccgcaccacctgcatcgtagtgtgatgaagttgtattgagagtgtccctgtgtcccttttctttaagtctacaattctcatggatataatcaatctctctctctcattatcatatgctcaaagctaggataaaggttagtgctcaatatttttatttgaataaatgatcaagtaaaggattcacaattaaggagaatgagaaaggaagaactattccagttttggatacaggattcttcaagttgaggtgaggatgtgatttggaccttgaacaactagtatttagatgtgcagaaataggatgtgaagaatattttaggcctgggaaagctgggcaaaagcacacaggtgaaaagttatttattagatattgaaggaaaatatcgatttcattttttttttttacatcaagagctctttctcagctgcttctgtacccatcattagaaaggatttttttcacatattacttactcatgtattatttataatatatattatgtcaccttcatttcttatacttggctcatctttagatatcaggtctttaaaaatattgttaaattggtgtttttgctttcaaaattaaaaaaatatatagagagaaatggaaaccacaaaataaaaatcacccattaattgatcatcctagaataatatctgatgacactatgttgtatttcttcctaggttttgtttctgaggagtaaaattattttcaaaatataaattcataaatcttctttgggtattttgatattttgtctagagaaagtccacattgtatggtatcctcagttgctttaatgtacatggtgtgcactttgttgcattttttcatgtaagatttaagtgagaagaagtaaccattttctttggaattaagtgaggcagtgccatatagcaagacgaatgggaaccctgtattcagacagaccaggattttaattctgggtctatttcctgcttattgtagtaacttggacaggttgtttgtcttctctgctttggtttacctatgtatttgtttgacctgtctaccttggtttactcctatatacaataaggataataatccatttggctttatggaaagaaagagacataaagacggaaatgtgcctggtactatgtgccagtgaatatttgatgaatgccctgtatctgtaataaaaataaaagattgtagtggccatctgcattacagaacaaaataatacatctgtctcaggtatctggaagcactagctgcagagcgttttgcaaggaagttggactcacacaaatcagcagctctgtacctcggggaggaaattgcagctggtttttccaaagcaattagtcccccccatcatctctccagtggagaacaaatcttactaatatgagaatgtgaaacacacagacatcatccctctgttatggcttcagagaataacaaaataagagagtcactcattttggtaatttttttagttctccaccagacactaaaccataagatctgtggcctttcatatggagaatataaaacctatatatccaacatgtggccagagagtaaaatatggtacttgactccaaaatcagggactgtcttagcattttagcaaacaagcaaataagtaagataaaaaacatgtataaacttaactgatcagcagatgcatgagcactaagagccaatagtgtttatcccctttcctaccaataacactaaagatgattaaaccaattctgataggttggataaattagcaattgtacctgaaggtgaatgtaactaatttcataatttttacagttcagttttgattacaccaaaattacaacctggaaaagagtcatgaaaatgactagcagaaagaaaatcagcatgaagtgagatcgttcttcatttaattaacttgtgagtcatgttcaatcatcatagactgtctgtggatgttctcaaaacatctttattaaaagaagatgttatgcaacctatgcatgcatggatttattatcagataagtcactatttataaaaagcatgacttgtccagtgatagttcgtaagatttatttattttattggtatatcattttaagattacacaagtgaaatatattcacatactggcacatgtgtgtttaattgtttagcctaatataagttaaatcagagacttccctcctgtgtgccatatacctagggtgagaataagaactaggctgcttattgcttttcttctttcctctatactcctggaatagctacccatgagtccaatttaaaaaacaagaagggataatgaagagccacctcttaattacacaatcagttcacatttcttcagggagttctctagttcatcgctgcaatttgaaggagatcatgccgcctgagagtatgaattcagtgactcccaggcactgatggatttcttgtatgaggaagagatcagatcacacactcagactaaccctttcttaactgaacaatacagtcagaatgtgattgtctccaaattacatcttaaaattgcacacctgtttcgtgaatttgtaagaggatcagttagtcctgtgtttggctgaaggtgatagacacaaatactgagtcttcaggttgtcattccagggttggatggtgaggcgactgcctgagcaccacagtgtccctgaaccccatctctctcttctgctctgcccttccagtatgacgtttatcattgttatggtttggctgtgtccccacgcaaatttcatcttgaattgtagtttctataatccccaagtgtcgtgggagggaccaagtgggaggtaattgaatcacgggggtggttttctccatgttattctcatgatagtaagttctcacgagatctgaaggttttataaggggcttcccccttcactcgactctcatacttcttcttcctgccatcatgtgacgaaggacatatttgcttccccttccaccataattgtaagtttcctgaggcctccccagtcatgcagaactgtgagtcaattaaacctctttccttccaaattaccgagtcttgggcagttctttaaacacagatgttgttatcaatgaatggtccatgtagatgattctccaacagttccaccactcctgggtgttcctcttacaggtctaagtggcaacacagtcgtgttggtgagacaaaagatgaataaaactacttctatggtcttattttttaaactcaaatttccaggaacattccacttagtagacctccagtatgggacacgctcctttgtcatttcatgagacaacacaatcttagttttctccttccttactgaatgttcttgtctggcttctctagttacctaactctaaatattggggtccccaagactaatttctccctggatagctgcttcacttctagggctttaagtgccatccacatttgtaagctctaacatgtgtatgcctagagccagcactaacatgttctctgagcagcagcttgtgcctagctgcttacttgacctcactatctcattgtcttaagagtgtctcaaatacaacaggctcaaaacagagctgtttttctgccctcaacctctttctcctgaagtgcccctacccaataaacagcatcattattcacactatttcttctagctagaaaacttgtcttgtcttttcctcacttgccacatccagtccaacattgtgtcccacatatacaggctccatcaccaaaatagatttccatgtacttctctgtgtttccactgccaccactgtcctttaagcttctatcacttttcacttggaaaacagcaagaaccctctaacttccccatattcattcctcccaacataccttaatctgtcccacctagttgccaaatgagtttgcaaagtgtaaactatatcgtcacatcattcacttccttaatatccttctgtcatttctcaatcctcttaaaataaatttagattttttttaccaagagtaaatcatttgctatgttctcatttctgagaagggaatatttctccaccttcattattcagtgtttttgacttactattcttcaaacacgttggccttcttttactgcctgtaacatgccaagctatttcttgtcccaagaacttttcatttgtttttctaggctctgttcctagaacattggctgtctggctccttctcatcccttggctgtcactgaacccttccctgactaccctagttaacagtgttcttgctattgaatatactagcattttctttttgtcttctattactcaaatgttgcttatcgttattttcttccctagaagaccgtaattaccatgaagacagggccaatgcctattttacttactgttatattctaagctgttaatacaattcctgatacatagaaaatatttcttgaagagataactaaattattagagtttattaaaaagagggtattgaaagttgttttgttcttaagtaaagtcatataaatgacaactcaaagcatttgaatattaatgtattttgatgattggctgagctagataccaacttaacttcgtggaaggatataatagattagctaataataaaaaatcatcgccaggcacagtggctcacacctgtaatcccagcactttgggaggccgaggcgggcagatcatgaggtcaggagatcaagaccatcctggccaacacagtaaaaccctgtctctactaaaaatacaaaaattagctgggcgtggtggcacatgcctgtaatcccagctattcgggaggctgaggcaggagaatggcttgaacccgggagtcggagggtgcagtgagtcaaaattgccactgcgctccagcctggtgacagagcaagactccatctcaaaaaaataaaataaaataataataaataaataaaaaatcatctattttcttgcataacattttatattatttgcaatgagatgccataaaattattcttaataatattgtaaatcaaaggcagaatatcaacttctaaaaggggaaaaattgtctcatactacaacatggaaggatctttaagatatgttaaataaaataagccagtcatgaaaagaaaaacactgtatgatttcacttatataggtacctagagtagtcagatatatagacagaagctggaatggtgatttccaggagctgagaagagaagggaatgggacttactgttttatgggtgcttagtttcaatttgggaagatgaaaatattctagagatgaatggtggtgatggttgtacgacaatgagaatatacttaatgctactgaaccatacacttaaaatggttaagatggtaaattttatgttatatctattttaccataataaaaaatattgtagaaaaaagtagccataggtctactttaattatctgtttctttttatgtgggttttaatagattgtgtcttcacggaattggtccaaatgatccaggttatcagattcttggacaaatcattgtttgtaatattctattattatccttttaatgtccataaggtaagatataatcatctctctcttaattttcatattgaacatttgtgtcttctctctttttacttgtttagcctggcctaatatttatcaattttattgatcttttcaaatagccaacttttgttttattgattttctctgttggttttctatttccagttgtattgatttgtcatggaattgattgtatttcttttcttatgaccaatttagttttatattgctcttctttagtgttttaaagtgaaagattacatcactgattttatatttttcattgcttctgattgcattcatgctgtaaatttctttccaagtattactcttgctgtatcctacacattttcataatatgtattttcattttccatatagtactaattaaatttgaaaaaaaaaggcagaaaacaaaaaaaagacagaatatttttctatgcaatacagattaaatgatttcagttgtgtcaaattgtgataattcttaccaacctagggtcagtaagaaacatgagcatttgagaagttcatagcccaattgagctggtactagaagctctctttctcttcatttttggtttcttgtacaacagattctctgccttcaaagatggacaactttttatttaactctttaaggacatctggactttaagtggactttggttttcatggagaagtaaagatgtactcaatttaacaattattcattgagtagataggggcgtaggggtgccagttttctaacttggctctactctacagtttgatttgtgggtaaaaatgagaaagatgttttgaaaaagacaatttcaatctcctccaagtttttgaagatccactgtgtctcaggcattgtgttaggcactctgaagactacagtgctgacagaagtaatactcagaaaattcatagtagagtagtggattcatttgacacataactatataccatgagatggaagtcaaaaaagttccacaggaggtaaaaaaaaaaaaataaggtattacagaaattcagaggagagacaatgagtctcacttagggatattaggtaaatcttcacagaagggtagtcgctttttgctgagctttgaaaattactcagaacctgaatgtgtatagtaagggaaaggtacttctacctctgcaaaaacatgaggtcagaaaagcatgacaaatgtgcaggaaacaatgaatgggccagtttggttaaagggagaagagaaggaatacaattggaaatgtagcttctgtttttcaagaagctaaaacataacaaaggctagagtaggtaaactctatgccatgagtattaggaagttatacgggactaaatatcaaggcaagttgtgctgtaggaatctacgagccagagtattggagagacatgacaggaagttttttccaacgttgtgatggtgatgtaagtgggaatgttggaggtggtttcaacaagacttgacaacaagctggatgagggcagtaagggaaattcaaatgagactcaaaacatcatgaactggttgattgaaaggatagctgttacattaaaagaaatgagaaagacaagcagcttttggaaagaaaatcatatatggatgtaggagatcggtcagggtggtgggaaaaattgtagaagatgcaaaccttcttggaaggctggaagattttacaaaagctttggaaaaggatttggctgaaggcagccagattctcttatctggtgaaactaatctaaataagtaagttaacataggccttggaacctggcctttgatcatctgagtgcaggactactctctctggggaggggaggggacgggagagaccatgtaaattgcccacaagtgtgttgactcagagcctttgtgattaaatctatactgaataaatgcctgcagtgccagcttgtcagggccacggctgctgactctttacagcaccctccttggtgtctggtgtctgtgagcagcctggtcccctagcccactctttcactggatacctgtgtctgggtgcatttgttcatccgttgttccaccagggtctatgggtcggaccctgcctatgtagctctggaggtattaagtggggatgctaatagaacacaaagtgtggaatcatgaaaggggaatgtaggagaaaatcaggggctggagatacagccctgtggtcttggcagttatctgaaagcccaaaatttaatggatttttcaagaaagaaattatggagagattaaaaaagatgattaaagataaacattgggtgaatacctgcacttattcattcagtaaaaaaaaaaaaaaaaaaaagtagaagaataaatagagacaaaggaggagtgttgaatgaggccaagagaattttgtggcatgccaatagagaagagacttgcaaggagagaaagtgcctgtgaatatcaaatatataccttcaaatgatgtggtggttgaaagagacaagaattaagaaatcctgctgtgtctcactttctaaagtgaaatatagaagcaaagcaacacattgggaagagtgtagacattggaatcagaggaactagagtcagttccgatctggctgagccaattatcggtcacatgtttacatgcatgctacttttaaactttaatggtttcagtttttgggttttttgtttgtttctttgtttgtttttactttgcatgtaaatcaagctaggtgaaaaagaccacaattacctcatttatttgtttatttatttacttttttccttttttgctaacctgtgtgacaagaacagtcattagccttagaaagtgccagagcacttgctgattgagtgcatgttaaaggtatggcagcgacatttttcttgcagatttagtagtcccccattcgtatccgatgtttttcccagaatattttttaaaagaatgtcagacattcctagtatcctgtctttctttcaggatcccaattttctccaggggagcaacatatgctggattaaaaaaccgctctcccagaccttctctggctgttaggaggcacttgttgcatggcctgtgaggtagggatgtggtataacccagggaaaatctctcttatttaatttaaaaagcaaaaaaaaaaaaaaaaacaacaacaacaaaaaaaaatagttttccaagaaaccctctccaggagacttctgcttacctctcagtgatcaaaaaccttttcaccacagttacttaccacgtcctaccgatccgcattctcgcaagtgtccttcactccatttactctactgcatttttcactgtatttctcatgccaaaacttgggcttctccaccagtctgcacacgttcatgctctcaattctcacagccatctatttcattctccactaaactgttagagggatttctgtagaaattaaagaaattcctatcactcctaaaaaaaaaagaaaaaataattataataattaattgcaaaccattaagcattggttactcatcctccctgtggagagctgaatggagggggagcagatggagcaaggttcactcctgagggtcctgccagagcaaatggtcaggagagaacggtgtcaacagcttcagagaggctaatcagtgtgaatgatgagcgtatctgtccctgggagaagagcagggaccactttgtccatggtgcttgattttgtatcccctagtgcatagcaaaatgctctgttgataacagatactcagtaactcttcgctaggcaaatagttgattcagagagaccctgctgtaaggtaatgcacatatcaggaaaaggaataaagggtcgagcggaaactgaaatggaagaaattgaaatggaatatcatgcaatctaatggtgtgttggtggcaggcaataaacaggtgtacatcctggtatatagctgtcacaaatacaatgttacatatataccaaaagataaacatctgaaaaaccaggaaccaatgtcaggaaccaaaccaaaaaaaatgtgccaaacatgaatccaagctaatgttaatttttatgcaataatagagagacaccattacttccacttgtatctgttgttatttgtaagcagagaggtatacagataaactaatatagtgccaaatgccatttgtatgaaagttacccttttgttttattagtaagcaataggagaacaatcaataaatactgccaccagtggtaatgtgactagccttgcaaattggtctggatggcatggtgtgtgcaatgaagaatagcgctaagactccatactgataaaaatgcaaatgaagaagtattttctatcaagaaaggtggtataattccatttaaaattattgcaagatttctttctctcaagtcatctcctatgctacattcaaatttattatgttaagctagaactctgttgtaagttctttcaaacaattacatgccaaattgactatgcataaagaagaatgtgttggatgggaaatgagatcctatggtttacacatttctttcttaaaactctctgcttcagctggttatttcctcatcctctcactcctttcctgtggttgcttcacaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggtgagtatctctgctggtgcctggactccattcctgttctgacacatgatttgtagaacagcatgtagcaactgtctttcccagactgaactttgcatgaaagcaaaccactatgtcctctgctgtccccaacttgaagcttgaagattaaccaaatgaagttttggatctaagaaaatgaaatgcgtgtgagaggattcatgcaaaaatatccttgtatgcaaagttattgctgaatgaaatagaattaatacttttatcaagaaattaggacaacaaaatataccagatactaaatggacccaaaaatggggaaaaaaggcaaaagaatgattattgggctcacctctgaaacaacacagctcagaactacagaaaagtaatcacaagcatctgagctgcccaaagatatgactttgggaacttctggggctaaattatttagctgtatgtggagcaggggaagattgaaggtgtgagaagacataaaaggagacaaaatatttaatttagtttaatttttttaaaaaggaaagaaaagctatgggggaggggtagtatcccacaagtctgatggaattttctttgccctaaaaatcaccaattgttccaagtaaacatgtgcagcctgatataagaaaataggtaattgttcggttgggcaccgtggcccatgcctgtaattctagcactttgggaggccaaggcgggtggatcacttgaggtcaggagttctagaccagcctggccaacgtggtgaaaaatacaaaaatctactctattaaaaaaaacacaaaaaaattagccaggcattgtggctcacacctgtaattacagttacttgagaggctggggcaggggaggagcttaaacccaggacgtggaggtcgcagtaaactgagatcacaccactgcactccagcctgggcaacagagcaagactccatctcccagaaaaaaaaaaaaaaaaggtaataattaaacaaagaaaacaaaagcctgccaaatggttataacctacaagttggttgaatagaagccaccaacccaataaaacatttgccatggaaacatattaaaggaaaaagcaagccttctccatctcccatcctacacacatgcaaacacacacacacacacacacacacacacatacacacatacacacaaattggaagaggattcccctgagtaaagaatgctaatagattaaattttgaacaccttgattttgatgtttctgtatactattcttgaagggactttaaaatcctgccattgtaatgcatatggcatcatctagaaagctgttgtgttcttctttgctagtgactaggaagacacagggagcctgaaagattctcacctcatgtctggggagcagcgcttcaaagaaactgaagttaggggcttcccagctctcctcttcagctcagtatcctctttacaccacagacacacttttttttttctgacaaggcacagctctggctgaagcttcatttaccctcaaaacctctgctggtcaggatgaccaggtaaataattttctgaagaagacagcaaagcaaaagtgtgctagagacactgaatcctgttgccaaagaaccacaccagtgaggctgccacacacgaaggaaggaggtctctgaagcaagatgtgccgtgtgtcccctaaacagtagcttttgttttgcctcgtatgcaagaccaatgctatcaagttgaaagagactttttggcagaacttcagacatcaaagaggatggatgctgtgactatctgtggtgccaagaagggggatgaaaatgaatgcagatgtattcacttcaatagatgacagtgtccttggtttccaggagttctgtgttcaacacttgtatttacaatgctcaggcaaggaggccatgccatcaacctaatgtcattacagcaggcaggtggaaaatgagtttaaagcaatcgctttgtgccttgtttgttctctcactaattcaatctaatctcaagccccaaacagatcttccaccagttctgttctcagggggcttcagcccctagaaacacctaccttgaattcaagctgtgttgggacaaccaaaaagaaggaaaggttaaaaggaagaaaacaagggaaagaattggggagaaggagattaaggaagaaaagcaggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggtgacagagcgagactccgtctcaaaaaaaaaaaaaaaaaaaaaaaaaaagaaaagcaggaaaggaggcagggatggaattaaactgcaagagagaagtaggagagaataaaagagatgttatcagaggggaatgatctgtgtataaaaagatactgagaatgaatcgtttttgaattagatttttttttcctctgagcatggcttcagacatagagcacttaagtttagatacttttttacttggttttctgtaatggcattgtcactgggataagaatagaagcttttcacagaagctctactgaaaaagatacccatacatattaaaacactagtgtgcttatttatatttgtttattttaagagtcaactattgtttgtgtttgtgtgtttactacgctcactattgaatcattaacactttccataagcgggtcttccctaagacctgtccaactgcgagtacaggaagaacacacaaagccataccctccagggtaacaaatagcagtcttccatttcctaaactgaaggtcatgtaacaagagttgtttcttctcagaaaataaatatgcttatgaaagtcattacagccctaggaaagattctcatctttcagcatcataaatgtagaaaatacaaagaaaaaaataggttgactaaatattgactcaaaggcatttcctgaaaacaaaacaaaacaaagccaaagagtccctctagctaatgcctttgcaaattgtttgctttgggaggtggcgatatattcagagatcaatgaagggttgaaagcatatttgtctaaactatttgtttatccttcaatgggtagggagtttgggagtccttaaacttaaaagggaatatgaaagctgcctcaaggctgcacattttgacattcatgttagtggaccggcctccggactgttggcagcagctgatcgtgatctcccttcttttccccttttatggagacatcaatgctggattatcgatgacgaaaggggataaaaccaggatcatggaactgtgatctatgataggcgcagaggataatggggatgccacagttactcctggttccagtggggagcactaccccacaacccaccctgagaaccacaggaaaagtaatgcatgaaatagactaagggactttaacatggtgatggaaaagaaaaacctgtttccgattttttgactggggccatgtatttctagatcaatttcatggacttgtccaaattttctatcatttttctcaaatttgtcaatgaaagtccctcaccctgatggtcacaaaagatgttcaagttctttctttatttgattatgggacagatcttagcagtgggcatgagatcgccatggcacacagcttggtggcctgtacccaccaaaaggctgaaacgtgcacttcccatgagctgtgaataaagctgtcacctcaggagacgatgaagaaatagcgttttatttctttacaaatttatagccaagacaataaatcactccatagaaaaatttaaaacaagatacattcttgtgaccttcataacagatggagtagttagtacaatagtgaaaactgcctgctgggatgtcaggttgcagcattttgtcaggcttgaatgaaaaagaaagtccaacattagtaatggaatgggcaactgacaaaggtgccttgcccttagactcaaattgtttttgtgaataaccaagagagatgaggttagtgcagtgccgggtcttccctaagcttagctacctttgcaaagtacatgatataattcattgtgggttgttttgttcatttggggatttatttggcttcaagactacacaattatatctttgccttgactacttcaagctagatccagataatcacgtccaatcttcttacagatgctgttgtgtgacaatggctgtaaacacatgtcattaactgtctccttaaactctcacagtgatacttcttgggtcccacatcttccaaagaagtccagcatacacacacactcacccacccacaacctgtcacacatccccagaaaagagaaagagtgaaagatgcttcacaaaatcggcctcagcctggtgttcaagttgcctcgctcaatatgcctgtgcagtcagacctgcaggaagaaacagctcatttttaaactactgtatatgaaagtttttgcctggagatacatcacagataggcagatcactaaaaagaagagtggattgaatcagagtgaagtcttcagttaactgtttgtttattgcctgtgaggtccaggacagtttcctttattctctcttccattctcatctttgaaggtaaaatttcatttctttccccttcctatgtcctaagatgccctgaagacacatgagaaaatgtggctgattccccagggatggaagccagcaaaaatgcacagaagggagatgggaacattctcaagggtccttatattgagaaagaaaatgaatggattagtggtgctgtggtgatgaactatctgccctaaaactcctgccaagatcagccagctgttctctggctaggctgggtctcaggggtgtgagtgggtcttggccagctgagttgaaccatttctcacctcttgatagtcatgcagcctacatctgtctgatggaaccctctccctgtgtgcttcccatttaagagaggcacaatttgacccatgttatggaagaaaacagctagagcgttctacaggaaaagtgctataataggtcctaataactattcacactgtgttattactatgtgctatctagttctagtttcacaagcagtagaataatttcctacctctaagatgcactgagcattgacaaacaggaaagaataacacagctgggaaaatgctgacctagaaatgctactgtttcatgacacatacaaaatcaatcctcattttttattctaagtatttcagcgactagtagactttcagaactggaatttactcatcaaatgttctatccatatatgccatattagctttagctgagcttaccagttttctgaaaatgctctactatggcatgaagctaagcattccagaagcaagagcagtgattagaatagttccagggccagaggataagtttgaagatgaaatataagatatttcatgaattgtgacatatataaaatgatatcctgggtgtatatatgaatattatgggcatataaaatcagcactactttagaaacaactaaagacagccaaatacttcaaataactaattttccttcactcatggaaataaaacactaagtatggtgcctttcgaggaaacttctctgatagtcaatgaaatactccatgtggtctttgttggcagatatatcactatccatttgttaaacaagcagtagagtgctgtacatttttttatgcctagaaatgtgaaagaaagtcttcaaaattaggataaagaaatctctaaaatcaggaaattcctcaccttgatgagaccacaagggaaccagcatcctttgcagactgacctgggagcagcagctcactgggtcctgagaaaccacagggctgtcagtcaattattaaaactgagaagacgtgtatatttcctcaagagcatgcaaatcaacctggaccctcaggaaaacaagtcaagactaaatacaattatgccatagctacgcaagaagttaaaaaacacaattgtcacaatctaaataattctgactgcactcttactttgagaagtgtgtcaagaaatggcaaacatttaatttggactttggggatttttgcagctgaaatgcatataccagtttccctgatatgaaatatcacatagttgagacacatgaacctgaatcctttcatgatatctgtgatgaccacaactcctttttcctgatcactttaatcacccaggctgttaactcatttttaatcactgtgttttaaaagaagcactaatgattgattcttgccccttttcaatatattttgaacttaccaattctgcagttttgttaaatatgtcaaaatactcttttcaactgcacattttttcaacgtgattttgactcaaaaagaatacagccatcttttagtaaatggaagtcatgtttggaaagaacaaccaacccaaggaaacagaaggaaaagaaagtcctttttatttgtttctttttcattgtaaagtctttcctgctgtcgttgaggcagtttttccatgtaagggtttttagtctgtcatggaaagctgtttagactgagagaacttctgtcttggataccattcatcatctcatttattttcttttattttaaatatatcattaataaaatttttactcagtaagtaaagatattttaaataaccaaagaggaagttttttagttaggtaggagaaatgggtgaagtggagggaaaaagagttgaatccagagcctcataaaatatgaactttgggagtaatttgagctatcccagtttatgacagagggtcctgaggatgagtctcacaaggcaaatatactgagtgactgtatgcatttttagcactttaattagccacccaatatgcaggtgtgctcctactccaagaaaatcatgtaaacgaaaatccaaaattataagcacaataatttagtagttgttttaattagaaatgcaacctaatttaatacaattccctattcatttcctttaaagagcaggcactttaaaaacatgattcaatttaggaggaaaaaatctatttttgaatacttttttggaagaccatctataagaatcaaccccatcctgctctcattgacatttcaaccagactgggccatgggacatttgttcaaggctaattgcaactgtctagatccataatgaaggctttcctgggtgacctttatgaattacagtaagtaaagctcccctctgagaaaccagccattcaatacacttttacctttggatgatgggttattagaagcctgttgtcagtgtgtcaacgatattctattcgagatggaaacctttagttataaggtgatggtgagtaatagcctttgtaatttcaggttcttgtcattgtgggaagtgcatttgttctgctgaagagtggtatatttctggggagttctgtgactgtgatgacagagactgcgacaaacatgatggtctcatttgtacaggtgcagtattaaccttttctaattgctctatgccacagtttgttatagagccaagagacactcgtcatgcaatgctttaggtggctggaccaacagggccaaccgtgaatatgaaatatctaccaaaggcgaagtgggcatttgggaaaaagccctcacaaaagcctcacattattcctaggcatagaagaatacaagagaatgaagctaaattttgtgattatttgggatccttccacaaagtaacctccccaccctcaaactcacatgtatgcagttgtatattgaacacagaaaagaattttgttggcaaccattttactttgaacatggtatagggaatgaaatattcttttaaacagaatctgggtaccactagttgatgtgttggttgcttttagggaactggatgtgtgtatgggggagaggtataaagagggctcagccgtgtcatagccactgctatcctaatttattgagtcctcataattggttataaattcatttgtttagccaagttacgaggaaacagagacatgtatacttctcctcagctctagctgaaggtaaaagatgactctttgtgtgtcattaagttagacctttgctttctgcccatccttactacgtaagactctcttcacggattacttggcctgcctcatgttatgtcaaagagccttatgtttttctgtatttattcataagtcagatataacttgctctttaagggaaaacaaaattgtcacctaaaagcctagctggagtgatacaggatggtgactatctgatcggtaaagggtggcaccaaataaatgccactaattgtttgaaagattagatgtctcgcagctgcttaataagatgtaataataacatcattgcacaataagaaaatctaccaaggatgaatgaaatgatttcattgtggacacttgtgatttataatagcatgtttaaatttggcacattttgatcataatcatgatacctatatgtattttattgcagggaatggaatatgtagctgtggaaactgtgaatgctgggatggatggaatggaaatgcatgtgaaatctggcttggctcagaatatccttaacaattacatgagagaggtctggattcttattttttctgggccattagaacagataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcaaactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtctactctcactttaaactcaccaaagaagattctcttaaagaaattatgaaaaatgtacaatttaacattttaaataaatagtgacagaagttgtttatactctgtgtcagtatatatatctactgataattaaaaatgaattgttattcagggatatctattttaggtttctagaaataagggatcacatttttaaaactgggcaggggttatgcgtacaagaaatctgattttttattttaatttattccatggtagtgtggccttttaaaaagacaatattgagttacatataaaatgggcctgaagtatgcatccatttcccttaaaatacttttttttctaaggataccttacttactggaaacctggggtcatgcaaagaagtcaagacgagaaatactgtgataaaatggcaccaatctcagaagctcacaaaagaccaaaaaaaaaaaaaaatctagaaatggcttaaatagaaattacaaatattcactcagtgataggaacaaaatgtttattttcttaatggtgaaactttgctttgtatgaaattcacattgaattatgaaagtgtacaataattgggacttcccttacatatttacaggtaaatctacttatacacattagtttaggcaacctttaattatttagagctaaaaaaaaaaccactttttttctaaaggtgaattactttgtaaaatcctagaataatgtagcaaaatcatttccgtattactttaagatgaaaatttttacttggaaattttattttaatgatgtaaatattctagtcatggcttaaactttataagtcaaatttccaaaaataaggaaaatatgcatccactgagttacttaaaaatttaatattgaaaattattttaagagaacatttaactgatcctgatttttatagtactaacaatgttctcataatgtaatagatttataaaaattgttatctctatcctgagattaaggagtgcaaccatgttgtagttctattattgagtacgtaaattgatagatctcttccgtaaaatgagggaaatataagtagtcaataaataatgtaggttatattctttcctcttcactacctaaacattttaagctgtgaacaacctattattattgttttgtagcaattttgatgacgtattcgctgatgcacagacattggaattcattacattatctagccatcgtaatacaaatgacctttggatttctctatcacggcgcttatcctcctattaaggatcagaaagttaaactttacggaccacgtacgtccctgtctcatattcttctttgttggtttctgtttaatactttaaagctgtaaaaaaaatttaaaaaattccttctgagctcccaggccatacaaaagcaacttaagggtggatttggctggcagctgggcagtactttgtcagcctcagctccactggaactgcccttgattctctatagctcatcacaaaacctcaggtatgtcttatttttcttataatcctctgtatgttattatcctttttattaacaacaacaactacaacaaaagtgctgctctttttcatagtctcatgtaagaagagtgtcaaaaatgtcctcggcatttgttttctcagaaaaagaatttagatattggagaaattatcataccataaaaagttcaaaatgtgattcatctaaaattttggacaaagatgaaaatatagtcagctctgttctagtgttcatttagttagaaaccatagtaccggaactgtattatagtagaagttaatggtacctaaactctaaggaatgctttttctttgaaaacagaaatatttttacttatttctgtccactatgtttgtgtgtatgtgtgtgtttgtgtgtgtatgtgtggttttgatgccagcaatgcaaacaccaatatatctattaagaagtgattgaatttagattggaaaaaataaaatagttacatgtaaagacataaactctttccttcttaaatgtgattttcaactctatgatagaaactccctctaaaaaacaagcagggcaagaacaaacttacttgtaatgggtgagagaaaa

SEQ ID NO: 784 - DNA, 21407 bp, Human
accctttcattctctgacaaaaggcaacttgaacatgagttcaagtgcaacccatgtttgaatcttagttttgccatctgttggctgcgtaaacatgggcaatttacctaaaactcttgtgccacagttttgtgtttataaaatgggcataatagtacttatttcctagggttgttatgagtaacaatgatatacgactttgataatctgtgtatttttcaaggcatgcttgactgtctctctgctgcagttatgtgtgttcatgtcttaactctttctgggctgtttgttaagtctccttgatggctatctttggagtttttaaaatattttattttttataattttaaaatagagacgaggtctcactgtattgcctaggctggtcttaaatgcctgagctcaagccatcctcctgcctcagcctcccaaagtgctgggattacaggcatgagccactatacctggcctaatggttatctttgtatcctttatcaacacagtgccttgaacagagtaaatacttattgaaaacttgagtgaaatgtaagttcatatttggcctcacagaatacaccagtaatacagcaatcactcacctgaggacagtgggaggatagaaggtaagtagaggactgggttaagtattcgttcaagcaaatacattaattacacgcctcccatgtacttgacactgggaactcagcaatgaagaaggcccagaccaaagttcaggcttttagcttcctgtcctataaaggataagattcttaactctaggctgaggtagtaaattacgaggggacttcaaaatggtacagggtggttgagcaggatacggcaatggttaagtttgatcagaaaatagaaatcaaaaggaaaatgtggctatggttacccctagcggacctcttaaatcttcctgagaacctgcttttttgggaaggcatgagtgccagtaagacttggcactcctcctcttccgcttaccgagagaaaatgactttgcctttctgctcaaaactcatcccttcactttgtcaccctatgtttgcatcttccatccttagtgtgtgtttccatccagtctttcagcaatacacgtactacacattggactcttgggtagtctctagggctgtagcaaggagccttgctcccaagggactcatttacacaatcctgtgaacggaccaagagtaaacagtgtgctcaatgctgtgcctacgtgtgttagcccacgcggccagcctgaggagtcagggaaggctcccctaggcaaagcccccaaccagaatcaagtcttaatggttaaagagctccatcacccaaaaaggattgagggcctaccttcaactgaacagctaatgcataatctcagaaactgtgagtcaaaattccctggaataactccactttatccccaatctccttgccacctagaccaaggtccattcaccaccctgtccccagcactgactgcactgctgtggccacactaaagcttggctcaagacggaggaggagtgaggaagctgctgcaccaatatggctggttgaggccgcccaaggtcctagaaggaggaagtgggtaaatgccatatccaaaaagatacagaagcctcaggttttatcgggggcagcagcttccttctccttccccgacctgtggccaagtcacaaagcaccacagctgtacagccagatgggggaagggaggagattagaactgtaggctagagtagacaagtatggaccagttcacaatcacgctatcccaagcagaaagtgatggtggcttggactagcacggtggtagtagagatggggtaaagattcaagagacatcattgataggcagaaccaataggacatggtaataaactattctcaggaaaggggaggagtcatggctttcagccatgagcatccaccctctgggtggcctcacccacttcctggcaattctagccaccatgagtccaggggctatagccctttgctctgcccgttgctcagcaagttacttggggttccagtttgataagaaaagacttcctgtggaggaatctgaagggaaggaggaggagctggcccattcctgcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggaggtgagccgtaagggaagttggggtattgggagagagcaggacccctccccatcactgcttctgggggcttcgagtttcccatttgcgatagcagttgagcaaggtgacttgtggggcctattcaggttgatttcttgtcaagaatgttggggtccaggggactggctcaggtgaaggtataagggcagggcacatgtgggctgatgggcactgaaaactacagcaagaacaaagggaagacaagagttgatgctttattttttccccaagggtcagttgtatgaaccactccaccctcaacaccttgaaatgcagagaggaggccgggcgcggtggctcatgcctgtaatcccagcactttgggaggccgaggcgggcagatcacctgaggtcgagaattcgagaccagcctgaccaacatggagaaaccccgtctctactaaaaatacaaaaaaaaaaaaaaaaaagagaccaggcacagtggctcacacctgcaatcccagcactttgggaggcagaggtgggcagatcatgaggtcaggagttcaagaccagcctggccaatatggtgaaaccctgtctctattaaaaatacaaaaattagctgagcgtggtggcacactcctgtagtcccagctactcgggaggctgaggtaggagaatcacttgaacccgggaggtggaggttgcagtgagctgagatcatgccactgcactccagcctgggtgacagagtgacactccgtctcaaaaaaaaaaaaattagccgggcgtggtgccgcatgcttgtaatcccagctactcgggaggctgaggcaggagaatcgtttgaacctgagaggcagaggttgtggtgagccgagatcatgccattgcactccagcctgggcaacgagagcgaaactctgtctcaaaaaaaaaaaaaaaaaaaaagaaaggaaatgtggagaggagcacatgtcctaaattgatttgcagaactaaagttgtctaccctcccgcaccttgcatttctgttccatttccctcatctccatcaacattataaatatttgaaaagaagcaataggtcattaatgattagtattgatcaggcttcagaatcaagagtgccaagattagagtcttggctcctcctcttcatagcgtgtaccctgagctactattgtgagagacactgtgcccaccagcttcagggagtggcaatgggtggcaatggcagatagccttcaagtgtcagccacttaggggatttcctctgctgaagagagccagttcactccaagtcccctcccaagatggcccacatccagtgtctgatcaatgagaagtgggtgagtggggagagtggaggcaggtgtgggggaggcatttgataagggtccagccctctttcatcaactctgacaattctttttttcttcttcttcttttttttttttttttttttttttttttgagatggggtttcgctcttgttgcccaggctggagtgcaatggcacaatcactggctcaccgcaacttctgcctcccgggttcaagcgattctcctgccacagcctcccgcgtagctgggattacaggcatgtgccaccacacccggctaattttgtatttttagtagagacgaggtttctccatgttggtcagggtggtctcgaactcccaacttcaggtgatccacccgccttggcctcccaaagtgctgggattacaggcttcagccaccatgcccggactttttttcttctttttttttgagatggagtttcgctctcgttgcccaggctggagtgcaatggggtgatctcggctcactgcaacctctgcctcctgggttcaaacgattctcctgtctcagcctcccgagtagctgggattacaggtgcatgccaccatgcccggctaatttttgtatttttagtagagacagggtttcactatgttggccaggctggtctcaaactcctgacctcaggtgatcagcctgcctcggcctcccaaagtactgggattacaggcgtgagccaccacacccggccaactctgacaattttgaagggtcattctagttccaaagctcgtggggtgttggcgaatgctgtcattgggcctgaatcagctcaactccttcctgtgcccactcctgctgatttcccctcctataagtagtgatcccattggcactacttaaacatcctgcaggctaaaaaaatattatgggccagacacagaggctcacgcctgtaatcccttggcctcccaaagtgctgggattacaggtgtgagccaccatgcccagcctataaaaaatttttttttaattagccaggcatggtgttgcacacccgcagtcccagctactagggtggctgaggggagaggattgcttgagccctggagatcaaggctacagtgagctgtgatcatgctgctgcactccagctgggcaacagaatgagaccctgtctcaaaacaacaaaattattttttaaaattatagcattgtttcaagagcgtttgttatgtatttggctgggaccatgctaaccgttactcgtatttattacatttactcctgacagcattgactggttgtgaaaaccagtcattggttatgaaattggtattcctatttcacatatggcagaattgtgatttaaacctagatctgctagggtcctcctatcagcacacacactccagccccactttagaggtacccgctaccttccctcattaaaaccagctctcaagaggggatctggtaacagtctaggcaggcattccagggagcatgtgaaccgctggttcttgttgcgggtggaaggatggaggtgttgtacagagtttaggtctttttcagcaaagatctcaaacccctggtgttcaaatcaaaccaaatggttatagtcccagctctactctcaactcactgggttactttagccacgtgattgccctcgctgagagtcggtttcactgtccataagatgaagaagtacatcacggtggtctgtgaggtgtcattgaggaaagatggtccagtgcccccatgccacatggccttccgggcagtgctcccagcgccggcgccagggcctgggatacgctggaatctgcgcggcgctcacccagctttcctatgcagagtggccatcgtggtgggcgccccgcggaccctgggccccagccaggaggagacgggcggcgtgttcctgtgcccctggagggccgagggcggccagtgcccctcgctgctctttgacctccgtgagtcccaggcaaggagagcaaggttggggtcagagggacgtggactgccgggcttcagcgccccaccccttcttgtgccttccaggtgatgagacccgaaatgtaggctcccaaactttacaaaccttcaaggcccgccaaggactgggggcgtcggtcgtcagctggagcgacgtcattgtggtgggccccgcggtacagggcacagggaacaatcgggggcagggacacctggggccaggaggagcccaagtctcgcgcccgtccccactcctgtggcctttctccaggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagtaagcgccagctacgacctggccccgcccactcgcgacggcttggccccgcccccatcggatcccgcccccagcgccgcagcccttgctttggatctggcctcgccccagggccccgccgactcaaggccccgcccctgtcccccagccctcctccgggctcgcgcgcgcctcccttcacccctgcgctgacccctcctccttgtctcctgcaggctgggacaagcgttactgtgaagcgggcttcagctccgtggtcactcaggcgagtagggagcaaaagcgcagtgggggcggctcccaaacagggccccctctcaccctcaggacttcccttccaggccggagagctggtgcttggggctcctggcggctattatttcttaggtacgtgcccatccgtacacctccctcccttctcgcggcccaaggagaccgctttgggcttcacacccgctgtccctcccgccctaggtctcctggcccaggctccagttgcggatattttctcgagttaccgcccaggcatccttttgtggcacgtgtcctcccagagcctctcctttgactccagcaacccagagtacttcgacggctactggggtaacaccgccattccagacttccagcaccccgagggtcaccgcccaccgcagacggtcaggtcctgcccctgtgggagcctccatggccacccctgccggccaacccaccgcctaagccgctcccgccctccgctcctgcggcttccccgcagaccgcccacctcccatgcgcccaccgctcccttccactgcggactcgtagcgcagcctggggcagggcttggcccctcgaaggcctccgtttttccatctgcacaatgcagggctggggctgagtggccttaatctcctccttctttgccctccgtcccctctgtgcttcctcccctggaaaagactaatttgcgcccttgtcctcagggtactcggtggccgtgggcgagttcgacggggatctcaacactacaggcaagaaatccacttagggcgggagttgggtagcccagcccggggaggagcgccttcctgaaatctcccctatgtagggaaatcttcctgcacacacatttttccctgggtgcagaacggggagcgggaagtgggtaggttctaaggctctcattccctgagcctggctctccctatcgccagaatatgtcgtcggtgcccccacttggagctggaccctgggagcggtaagtgcccccaccactgggcctcccgaagccccttatcccagttctcaggctgacaactcctgagcgccccccacccccgccccgcctccaccaaaccaccctttctcacctggagtgggaggttgctttgggtacaagaatgatgctctcgcctgcgctgtccgtgcaggtggaaattttggattcctactaccagaggctgcatcggctgcgcggagagcaggtgggggccaggtcccagtgggcgtggctgggtggagggggaactgagacttcagaatatttcatgggaggtgagggcccatttcttaaagaggatgcttgtccagcggcgtgaatgatggtgctcctcatcttgcagatggcgtcgtattttgggcattcagtggctgtcactgacgtcaacggggatgggtgaggagggacatgccccacccctacccagttgggtcccaaattaccagagctgccctctgtctccctttcctagccctagtctcacgtatccactggaggaacaggagagcaagggtcgaggagatttggccctagccccaatatacccctggtccagtcccatgtaaccactcatctggcccacaggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatggtgagggaagagaggagccctacttgctgcagaggggttaacagccactcaaaaagcatggagttggcctgagggcagccagaaccaggatgggttttaagcatataagtatgtggcttagacacatggggtgctgagtggagagcagatgggagagttgaagactaattaggaagtgtttgccttaatccaagcaagagacaatgaccacctggatgtggattttggcagtggagttagagatgggagtgacttcacagatatttaggactcggattattaggacttggtgggagactggatgtggggccaggggagaggttggagttgggtgcctgtgatggcctccactgcctggaactcaggccgtgcagcaggtgctggggagaggcgggagatcagcagttcagctctggacctgttgagcttgaagggcttgggtgctttaggcggaaatatccaaagaacagttgggagtggctctccccgcttccacaagagagatctgaatgggagacaggggtttggggaaagtggatgaggtcccgggacctgtgaaataagaggcccaggatagagccctagggagcaaaagcatttaggtgactcctacaggaggtaagtctgagaaggagacagaggagtgtccagagagggaggagggaacccagggggtctgatggcccgggactcaaggaagagcatgcgttaaagagcatgcacaggaggaagtgggcgctgcagctcctgctgctgctgcaagatacaattaggtggggctggagaaatattcatgggctttagcaagaagagggtgccaggcatggtggctcatacctgtaatcccagctacttgggaaattgaagcaggagaatctcttgaacccgggaagtggaggttgcactgagctgagcttgcgccactactgcactccagcctgggtgacagagcaagactccatctcaacaaaataaaaaaaaaaatagagaaagaaaggaagaaagaaaaaagaaggggaggttattggtgacagtgacataaattgattcaggccaagatagggtcagaagccagaatgcaatggggtaaggtatgaatggagatgaaaaattggatgcagctaatgtagacagctctttcaacaggtttgtggtaaaaaggaatttgaggaatagaaaggaaaaaaaaaaacatgtttgactataagaggaaaaagagaaaaggtgatcacagaaaagagatgagggtcaagggaagattatttcaatgtggaagaacatgtagtaggttgaaaatgatgttgtggggaaatggggggatgagccagcagagagtccctgtgatgcctcagggggtgggagggtgactggcccagtgtcagggtgaaggaaggaaacctcttccagggtcaaatggggaaagggaaaagaaagttggtgtgggattatagcataacagtgggctgcctctcttcctgaagtaagagattacgtcacctgctgaaggaagtgtggggggtctgggagtttgatggaatggagaaggctagaaatagatgctagatggccaggcacggtggctcacacctggaatcccagcactttgggaggccgaggcaggaggatcactggagcctaggagtttgacaccagcctggccaacatagggagatctcgtctccataaaaatttttaaaaattagctgggcatggtggctatagtctcaactgcttgggaagctgaggtgggaggattgctttagtccagaaggttgaggctgcagtaagccatggttgcaccactgcacttcagcctgaatgacagtgcaagactgtcttaaaaataaaaaaattttaaaaggggcttgggcacggtggctcacacctgtaatcccagcactttgggagcccaaggtgggcagatcacttgaggtcaggagttcgagatcagcctggccaatgtggtgaaaccccgtctctactgaaaatacaaaaattagccgggcatggtggtaggcgcctgtaatcccagctactgaagaggctgaggcacaagaatcactttaacgggggaggcagaggttgcagtgagccgagatcgcaccactgcactccagccaggacaacagagcgagactccatctcaaaaaaaaaaaaatttagaaaagggaataatgatgcttaattttcaggatatattttcctcaatagacagtgagagttgtcactgtttttataacaatcctacttggcaggtccctctcccacctgattgttaactcctggagggtagggcagtgcctccttcacccacactttgcacccctttcctagtctcctgggatgttcccagagaagctcaggaaagttttacagtcatctagggaggctgaataacaatcagccacttcctttctgttactccttccagacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccaggtgccctggactgcctccagctagaaatgcccaagaaaggcccttggacattcgctggaagtgccaagagacacggccaggggctcatgcctggcctggtgtcccactatggactgccagaggggctgggtgaaacctccagtgggggaggtggtgtggggaacccctgggaagatgagatgaggatcccatgccctaatcgccaattctgacccattcctcgatgtctatagacctgatcgtgggagcttacggggccaaccaggtggctgtgtacaggtgagcactggctccaggggcgggatggggaaggtcctgtgccatcaagaggaggccaggccaggaggagccacaatggcaagcctaccccatcaccctatcccatcagagctcagccagtggtgaaggcctctgtccagctactggtgcaagattcactgaatcctgctgtgaagagctgtgtcctacctcagaccaagacacccgtgagctggtgaggaggcagagggcatgggccttaaaggatctgggacctcagaaaggctccaacccctgagccccacttacgtctttgcagcttcaacatccagatgtgtgttggagccactgggcacaacattcctcagaagctatgtgagtggcatgaagggggcaggagggaggtgggcttggactcccccggaggctggccagggaggtcctgactcttctgcttgccctgccagccctaaatgccgagctgcagctggaccggcagaagccccgccagggccggcgggtgctgctgctgggctctcaacaggcaggcaccaccctgaacctggatctgggcggaaagcacagccccatctgccacaccaccatggccttccttcgagtacgcccaggcaggggattggcagggctgggagagtagaacttacccactggacttgttcatctagccctggggcactgagctgggtgctgtgagtccgggggtggtcaggacacggtgcctactggccaggagaaggtgggatgtgtatggtagcaagatggcctgactcttgcccctgtcctaggatgaggcagacttccgggacaagctgagccccattgtgctcagcctcaatgtgtccctaccgcccacggaggctggaatggcccctgctgtcgtgctgcatggagacacccatgtgcaggagcaggtagggacaggcagggacaggccagggaggtgcaggacccctgatagcaaatcaggattagggttagtgccaagtcacaatgtgaaccccaaaaccttgatgtcattccaaaccctaatgaaaacctcaaaatccagccagtcatggtggctcacacctgtaatcccagcactttgggagaccgaggcaggcagattgcctgaggtcaggagttagagaccaacctggccaacatggtgaaaacccatctctactaaaaatacaaaaaaaattagccgggtgtggtgacgcatgcctgtaattccagctactcgggaggctgaagcaggagaatcacttgaacccaggaggcagaggttgcagtgagccaagagtgtgccacagcactccagcctgggtgacagagcaagactctgtctcaaaaaaaaaaaaaaaagccaggcgcagtggctcacgcctgtaatcccagcactttgggaggccaaggcgggtggatcacgaggtcaggagatcaagaccatcctggctaacacagtgaaaccccgtctactaaaaatacaaaaaaaaaaaaaaaattagctgggcgtggtggcgggtacctgtagtcccagctacttgggaggctgaggcaggagaatggcgtgaaccccggggggcggagcttgcagtgagccgagatagtgccactgcactccagcctggacgacagagcgagactccgtctccaaaaataaaataaacacctgaaaatcccagtatcccctaagctctgatgtaaattgacaaaccctgacattgtcccaaacctccaaataaacccgagccccgataccatctacaaactccttttcgtcctcagatcttcttactccctaagcccctatgtgaaccccaagcccactgttttcctaaccctgatgtaatccctaaacctcacacatccccaacttacccgcacaccccaatgtgcccctctagacacgaatcgtcctggactgtggggaagatgacgtatgtgtgccccagcttcagctcactgccagcgtgtgaggaggcctcccattctgcccgaccctggccctttctgcctatcatacctgctccacaccttagtcccctcttttcccacatcctgggcccagacccaggctccctggcttcactcctctttccccacaggacgggctccccgctcctagttggggcagataatgtcctggagctgcagatggacgcagccaacgagggcgagggggcctatgaagcagagctggccgtgcacctgccccagggcgcccactacatgcgggccctaagcaatgtcgaggtatggcccccaccctgggaacagtacccgggacctgggaggcactggagccttggctctctcatctccctccctgagagtccctcttctcttctgctttgctgtcaaagatgtaattttttattttttttttaatttggaggaggaatacttgctaatggcacagaattccaaaactctattacaaaaaccagaaaaacaaaaaaggtttaggaaccaaatgttaacaggaacctctgttaacatttggtggatttccttccagtctttttttcaatattgactcacactcacataagtatatatttattttttatgttgttaatatagtttataataatgggggtcatactctaatgttttgtgttttttatttccaaaatgaaaatgcctaaaaagtagtagtgctacagcaatacacacactagcatgtgacagtcccttgagaccccaccccaagaaacccccccctccctaccttggcacacaaatctttccagaccttccaagggagcttaaatatatatatatgatgctctgtaatttctttcttggaactgccttcctgaagggctttgagagactcatctgtaatcagaagaaggagaatgagaccagggtggtgctgtgtgagctgggcaaccccatgaagaagaacgcccaggtgaggctgctgggtcgtggtaccgggtctccacatgaataaccagattttaggggtgaggttttagagccacatagttctgggccagaatcttggtcctcacactcccttgccacatgtccttgggtgagtgactttccctctctgagcccctttacccagtgggcttccaggtaaaatagaaataataatggtggcctggtgcggtggctcacgcctgtaatcccagcactctgggaggccgagacggatggatcacgaggtcaggagttcaagaccagcctggccaacatagcaaaaccccgtctctactaaaaatacaaaaattacccgggcatggtggcgcacgcctatagtcagagctactcgggaggttgaggcagaaaaatcacttgaacctgggaggtggaggttgcagtgagccgagatcatgccactgcactccagcctgggtgacagagtgagactccgtctcggaaaaaaaaaaaaagaaaaagaatagtggtgatcttggagggtgaagactggaggccacattcagggcagggctgtcctaagtggggcacttgggcagtgaccttggccctcctcatctcccagataggaatcgcgatgttggtgagcgtggggaatctggaagaggctggggagtctgtgtccttccagctgcagatacggaggtactgacctggcgagcgtgcctacccaccacccttcccccgtctgacccccgtgcagagcccctcaggtcccttccatacagaagggtctttcgaggccaggcgcggtggctcacacctgtaatcccagcacgttgcgaggccaaggcagaaggatcactggaggtcaggagttggagaccagcctggccaacatggtgaaaccccatctctactaaaaatataaaaattagctgggcatggtggtgcgcacctacaatcccagctactcgggaggctgaggcaggagaatagcttgaaccgaacctgggaggtggaggttgcagtgagctgagattgggccactgcactccagccttccagcctgggcgacagtgcgagattctatctcaaaagaaaaaaaaaaaggtctttgaagaagcctggttccctttcttcctcagagatttatgtctgagtcttggagccctagaggaagttctttcccaggtctaacttcagtgtggcatgctctttgtataattagctctctctgaactctctaaaattctggcctcacccccagaaagtcactgggctggtgtccctggccctgtttctcctcatcccctcccctctagcaagaacagccagaatccaaacagcaagattgtgctgctggacgtgccggtccgggcagaggcccaagtggagctgcgagggtgagaggccaggggtggagaagggagatggcattcagggctctaaactccagggggcgctggggaaacctcacaggccaatcagggcatcacactctctctgggggtcttgggcacctgcaggaactcctttccagcctccctggtggtggcagcagaagaaggtgagagggagcagaacagcttggacagctggggacccaaagtggagcacacctatgaggtattggggagcctcgcgtccctggctggggtgagcgggtcctcagaactccgggtgaggcgctaagctccccacaccctgccaccaccaccccttcagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtaagagctgggtggaagaaagacctgggaaggcggccccagaccaaccaccggggcacctctgtgggctggggttcgggggagacctgggcctgaccactcctttgcccccccaggtggactgggggctgcccagccccagcccctcccccattcacccggcccatcacaagcgggatcgcagacagatcttcctgccagagcccgagcagccctcgaggcttcaggatccagttctcgtagtgagcaggctctctggtctctggcccggcctccccgggacccacggggcagaggggatgggaggagggagaggggtccgggtgtgctgtgggcctctgtgggccacgcttggtccctgggagcacttcaagtgaacatggaggagcatgctggcttgtgtctggggtgagctgaaagacacttgcactttttaaaagcttcccagtacgttaaggagcataaaacaatgccaaagcaaggttatcatagatctgagcattgtgcgctgggggatgaccctccctgcatctctgggactatgtgagcaagcccgtggaaagacagcatccgaagcttggatccaaggcccttcctgatgggaaggccaccgcttcctgaacccccggccccttctgcgttgggtcctgggggtaagggggtgggggatgatggggtgatgggccgggacgggctggggactgacgatgcttcccctcagagctgcgactcggcgccctgtactgtggtgcagtgtgacctgcaggagatggcgcgcgggcagcgggccatggtcacggtgctggccttcctgtggctgcccagcctctaccaggtggggtgggccgtggtggggcggggccgggccttctgggcggggaccactttgctctgggaggggcggggtttggtgtgggagggcaggaagagagggaaggcaaggtttactttgggggattgcagtgggattaggtcagaggcagggcttccccgccgggggtgtgggacctggactcctgcaaccaataggcctcttgtgggtgtaaacggctttcaaccccaacctgtccagaggcctctggatcagtttgtgctgcagtcgcacgcatggttcaacgtgtcctccctcccctatgcggtgcccccgctcagcctgccccgaggggaagctcaggtgagtgtggggggatggagcagagaccagtcctgcaggacccattgtcccccagtcagtgcccagccagaaaagtctgaggggtggtacgggtgggtggcatggctggaggtcaccagcctgaggtttgagtctttgtgaaaggcaggtgtcaaggtgactgaggagacacgtgggtttgcccccaggtgtggacacagctgctccgggccttggaggagagggccattccaatctggtgggtgctggtgggtgtgctgggtggcctgctgctgctcaccatcctggtcctggccatgtggaaggtgaggtgtgaaggacggtggagtccccagcggggcacaggcttggctctgccctgcctcacagggagtcaaggagagatggtggcccacccaagtgggtaatccagggaccaggggtctatgtctccactattagaatgtcattctcggtccagtggggtggctcacacctgtaatcccagcactttgggaggccaaagcgtttagatcacctgaggtcaagagttcgagaccagcctggccaacatggtgaaaccccatctctactaaaaataccaaaattagccgggcgtgttgacacatgcctgtaatctcagctactcgggaggctgaggcagtagaattgcatgaacccaggaggcggaggttgcagtgagccgagatcacaccactgcactccagcttgggcaacagagtgagcctccatctcaaaaaaaaagaaaaaaatagaatgtctttctctagtagagcaaaaaaggcaaaacaaacacaaaaatgtcattctcctgggaacccttccagacacataccactggaaaggatagcacctgaaattctgaggcctttagacacccctgccaccaaaaagattcagaggatatagagggtatagagggtgtaagtcctgccttcaggaattcctggctggtctcaaggacaagatgcacttcttcctagccctgcccttccccttgagtgaggcaagaggcccaaggattggtctagaccctattcctcccttcctatgtggccctggagggtcactcgctcctctgcacctggaggagtctcaagcacactgaagggaagacatggtgcttttagggaaaaccacgcactagacccacaataatcaaatacatatcatcatatgctcgagtcatgcagacacaaacttcagtataagaaaaattccaggctgggcgtggtggctcacaccggtaatcccagcactttgggaggccgaggtgggcggttcatgaggtcaggagttcgagaccagcctgacaaacatggtgaaaccccatctctactaaaaatacaaaaattagccaggcgtggtggcaggcacctgtacttccagctactcgggaggctgaggcaggagaatcacttgaacccgggaggtgaaggttgcagtgagccaagattgtgccactgcactccagcctgggtgagatttcatctcaaaagaaaagaaaaattccaggtggggaccaggcgcggtggatcacttgaggccaggagtttgggacagcatagtgagactccatctctacaaaaaagttttttaaaaaaaattagtcaggtgtggtagtccacacctgtagtcccagctacttgggaggctaagaggtgagaggattgcctgggtgacaacagaaagaccctgtctctaaaaataaaataaaaaagaaaaattcagaggccgggcacagtggcttatgcctgtaatcccaacacaatgggaggctgaggcaggcagatcacctgaggtcaggagtttgagaccagcccggccaacagggtgaaaccctgtctctactaaaaattagctgggcgtggtggcacacacctgtaaacccagctactcgggaggctgaggcatgagaattgtttgaacccgggaggtggaggctgcactgagccgagatcgagccactacactacagcctgggtgacagagtgagactccctctaaaaaaaagaaaaaaataaaaactcaggggagaaaaaacaaaaacccaacaattcgttccatgcattatctctaaatgtcaaaaggcatccatttgtgagtacagtgggcttcatgttctgcgctggtccagggaggtgctcatagctagcatacttcctcacatgtgctctggggccagcaaatcatctgtataccctgaccttggcccccgtgtacccccaggttggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccctgatgctgagcatgctgcctccttttggggccagagaagagatgaccgaaggaatgttttggacggggacctagggctggtggaagtatgaacgagagagtcactgccagggcgaagtttgcaaatcactgtctttggggagtgtcagggagtacagagttggggtggtaggtgtaacagaagacggagagcccggcgcagtggttcacgcctataatcccagcactttgggaggccgaggtgagcagatcacctgaggttgggagtttgagaccagccttaccaacatggagaaaccctgtctctactaaaaatacgaaattagctgggcctggtggcgcatgcttctaatcccagctactcgggaggctgaggcaggagaatcgcttgaacccgggaggcagagtttgcagtgagctgagattgcatcattgcactccagcctgggcaacaagagtgaaactctgtctcaaaaaaaaaagaaaagagggagaaagggcggcagggcctcagggaagactagaagcggatgaacatgtctaagggcaggatgggatgggagggcaggtgagggggatgggagcatcagagaaggcaggctgtgtccttggtgggcagctttatttatttatttaatgtatttatttttgagacagaatctcgctcttgcccaggctgtgcaatggcatgatctcggctcactgcaacctccgcctcacgggttcaagcaattctactgcctctgcctcctgagtagctgggactacaggagtgcaccaccacgcctggttaattttcgtatttttagtagagaagggatttcaccatgttggccaggctggtcttgaactcatggcctcaggtgatccgtccacctcaacctcccaaagtgctgggattacaggtgtgagccacctcgcccagctacggcagctttaaatagcacatttgttatgatttcggaagggtaaactttacaatgacctgaggcgtggaaaaataacacgctctccctgccttcctatcaaaaaaggactttaaagctgtttggagcgagaaggggcagaggaaggctggctcagctgttgcctgaggaaggcagcgtcatgccagggaggagacagcaagcatcgctccctggctaccctgctgctgtcccttcctccccaccaagaggggccttcagccaggaaagatgaggatggaagacagctctccagctttggtgagtagagctgagcagcatatgtggggaggtctccctggagtcctgagggatttgttccttcctgggttcaataaatatttattggccgggcatggtggctcatgcctgtaatcctagcactttgggaggctgaggcaggaggatcgcttgagcccaggagtttttggctgcagtgagctatgatcatgccgctgcactccagcctgagcaacagagaaagaccctgtctctaaaaaaaaattaaaattgtccgggagaggtggctcacgcctgtaatcccagcactttgggaggctggggtgggcggatcacctgaggtctggagttcaagaccagcctggccaacatggtgaaaccccatctctactaaaaatacaaaaaattagctggctgtggtagcaggtgcctgtaatcccaggttcttgggaggctgaggctggagaatcacttgaacctgggcggcagaggttgcagtgagccgagatcatgccattgcactccagcctgggcaataagagccaaactccatctcaaaaataaaaattactagctaggtgtggtggtatgttcctgtagacccaggtactcaggaggctgaggcaggaggattgcttgagcccaggaggtcaagactgcagagagccttgatctcaccactacactccagcctgggtgacagactgaggccctggctaaaaacaaatgtttttaattaaaaataaaaataaataatcacggagcacctactgtgtccagaattggtgggttcttggtct

SEQ ID NO: 785 - DNA, 47741 bp, Human
  misc_feature (1)...(47741): n = A,T,C or G
tggccactctgtgagggtctgctctgtacaccaagaccgtggggaggactggccgtcctgcgtgtgcctcacggggaaaggagaagggcgaggggaggcagcggcagcacggcaaagaagcgagtgttgaaacccctcaggtgctgtccttcccgaccccggctagagggttgggaagtgtcttcttggagacgtccctgaagcgggagggccatggcgtagcttccgacctccacaggctggacccttcttgggcaggtgcctgaagcgggagggccatggcgtagcctccgacctccacaggctggaggtgcccctagggcagggtggtggacagagtcttcctctgttgggggggggggtgcccgcactgggcgcacagatgtgagccgggctgagtcccgcgccgggtgcgcggatgtgtgctgggctgagtgtggccggccacttgtttgcgttgtttgtggacatacaaataggctgttgttgaactgggttcgtggtggggacttagagactctcagagtctatggctatttttaaattttattctttgaaggtatttggcttgcatgacctttgtttggttatgttttacttgaatcatgtcaaggaagctacatgaagtgtgaaccagagtgttcactgcaaaccttctcccctgtagcttaatgtccctggctctttgtttgccagagccaacagtgaaaagggtgataggattttttatttaaagaaaaggaggctgggcgccatggctcacgcctgtaatcccagcactttgggaagccgaggtgggcggatcacgtgaggtcgcgagttcgagaccagcccgaccaacatggagaaaccccgtctctgctaaaaatacgaaattagccgggcgtggtagtgcatgcctgtaatcccagctactcaggaggctgaggcaggagaatcgcttgaacctgggaggtggaggttgcaatgagcagagatagcaccattgcactccattctgggcgacaagaacgaaactctgtttctaaaaaaaaaaaggaaaggaattatttttcttaaataagaaaactaccacaaagttattgctttgtgacccagatacatttgtatgtttgttttgaaaggaaaaatagacactgggtggtatttgagttttgttttaagtctactataagacccaaaacatattcaggcacttagtttaaaagcagtcatgtaaactaagtagtatttgagtctttttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagtggcactatcatagctcactgcagcctcgaccttctgggctcaagcaatcctcctgcctcagcctcctgagtatctgggaccacaggcatgcaccaccacgcctggctaattttttgtagtctttgtagaggtggggtcttgctgtgttgcccaggctggtcttgacctcctggacccaagtcatcggcctgcctcagcctcccaaagtgctgggattacaagcatgagctacgatacctggccttgtctgtgctttttattttcctgtatggctggtctaagtagcgttttcttactggtgtttttaaagtcatgaagcaccttagttgtggttttgtttgtttggcgacttataataacacggtgagctgagcttggaagtgttgcatccatgttctcagctgctccagtgttgtggggacatgtggggactctgccctgccccggctggaacagcaaaaggtgctgatggtgggcttttcttttccaggtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcaggtgcggccatggggatgggggactggagcatccttagtcccagtggcagccccaagtaacgcctttctccttccctggtgctgacttatgtggagagagagaatgtgaggtggtgtttaaaatatcattggatttctgctctgaatttcctgcattatgaaatgcagttcccaaaggttcctggtttttatttactcattcctttttttttttttttttttgagaaggagtctctgtctgttgcccaggctggagtgcagtggtgctatcttggctcactgcaacctctgcctcccaggttcaagcgattctcctgccttagcctcctgagtagctaggactacaggcgcccaccaccacgcccacctaatttttgcatttttagtagagacagggtttcaccatattggtcaggctggtcttgaactcctgacctcaagtgatccgcccacctcagcctctccaagtgttgggattacaggctgagccactgcacctggcctgtttactcattctttaaaagatgtttttaaagtggtttttttttttttttttgggagatggagttttgcactgttccccaggctggagtgcagtggtgtgatctcggctcactgcaacctctgcctcccaggttcaagtgattctcctgcctcagcctcctgagtagctggggctacagacatgtgccaccatacccggctaattttttgtatttttagtagagacgggatttcactgtgttggccaggctgatctcaaactcctgacctcgtcatccacctcccaaagtgctgggattacaggcgtgagctaccacagctggctggtttttttttgtttgtttgtttgttttgttttttgtttttaagagatggattctggctgtgttgcccaggatgaactcaaactcctggacttaagtgatcctcccgccttgaccttctgagtagctgggacaacagatgtgctccactgtgcctggcctggattctttttattggagtataaatgaaagggcagacagtggtctaaagtctgccctttcaaaattttaattttgaattttttttagagagcccacagcctgaagaaccatgagccaattaaacattttttctttattttttttttaaagaagagtagagagcccagaaataaaccctcacataatgtagtcaaatggttttttttttttttgagatggagtttcaccctttttgcccaggctggagtccaatgtgcggtcttggctcactgcatcctctgtctcccaggttcaagcgattctcaagcctcagtctcctgagtagctgggattacaggcatgcaccaccacgcccggctaattttgtatttttagtagagatggggtttctccatgttggtcagggtggtcttgaaatcctgacctcaggtgatccgcctgcctcggcctcccaaagtgctgggattacaggcgtgagccaccacgcctggcctcatcaaatggtttttgacgagggtgcccacatgcccacaccattcattcagacttcccaacaagtggtaccaggtaaacggtatgtccacatggaaaataatgaatttgggcccttatcttataccgtgtgcaaaaattaactgaaaatggatcaaagacctaaatgtaaggcctgaaactataaaattcttagaagaaaacataggcaaaacctatgacattggatttggtattgatttcttggatttgataccaaaggcacaggcaacaaaagaaaaagacaaattgaacttcttgaaaatttaaaaaatttctgcatcaaaagacaacatcagtagtgaaaaggtgttgtacagaatgggagtaagtatttgcaaatcatacatctgacaagggattaatatccagattatagagagaactcctaaaactcaacaacaaagaaacaaaagacccagttcaaaaacgtgaaagacattgtttcaaagaagatatagaaatggccaataaggacatgaaaagatattcagcatcagtagttattagggaaatgccaatcaaaacacaatgagatcccacctcacacccattggattggctgctattaaaaacaaaaaacccagaaaatagtgttagtgaggatgtggagaaattggaactgttgtgtgctgttgcaaggaatgccaaaccgtgcagctgctgtggaaacagactagcagttcctcacaaaactaaaaatagaattaccatgtgatccagcaaccccacttctggatatagacccaaactgaaggcagggtcttgaagaaatatttgtatgcctgttttcatagcagccttatgcacaatttccagagaatagaagatacaatggaatattattcagccttaaaaaggaaggaaatcctgacatatgctgaaacataaattaaccctgaggacgttatgctcagtgaaataagccagtcattgagattcctagagtatcacatttgcagagacagaaggcagaatggagaggtggccaggggctgggggcggggagggggagccggtgtttcttggggacagagcttcagtttgggaaatgagaacattctggagcggggtggtgtgatggctgcacctctgtgtgaatgcgcttcatgctgctgaagtgtgcagtttaaaatggttaaaatggtaaattttatgttgtgtgtattttaccacaaaaaaaaaaataggccccctggaaaaacatccgttgtgcatgtgtttgtgaaatggaggtgtggccagtggactctggccaccatcctgtgcctggtgctgtctgagagtcgccccggctggcatcagggccttctcgttgctgccctctctcccattgctcctttgctgagaggctgccctctctcttggctgaatttggctgaacataactgagtgggccaaatagtaagtgtgcaagtgggtaggcacaagtcagtcctgccgcccagtgcttattaagcactgcatgaaaagggcacagaattccctggagtagaatgtgcccaagtttacgtaagtcacatacagctcaccgccaagcagcagccttgaagaccccacttcaagtgtgactgacagcagcggtgggtgcaggggaagggtgggtcacagctgccaccctgaggttgggtcggctcccaactccgcctctcctcccacctgctgctttcttttcatcctgcgtttccttgcttgcccctccccacacctgcacagacctttgtcagggggaacccaggtccccggggcctccaggtggagcgagcctgagcaacctgactttccaaacctgccgtccacccagcaggtcactcgccttcctcgggccacactggctgcatcctccacttgttaaaagttggctctttaaactcataaattgtagatgctttttctccagtgctttaaggatggttgctggcattgagtaaatacttgttgaatgggtgagtgagtataccagtggtgcatattcatggcggagagtctaagaagcactgcagagggtacaaggccactcgtgtgttgccctttccctcctcccccccacctctccatctccctggccctccttttggagttgtttctcagaggtcatgcctttaggcttcttggtgattttctctagaccttctctatgcatttgcaatgtttttccccaaacacacctctctgacttataagataatcttaccttgatattgttccatttcaatggctcgttctttttattgaagtgcagaaaatgaggcatggagagaatctgcagctccttgacttaccagaaatgcacgtgccctttaatcggcacagagatcaagaatcagaacactccctgagcccccgtccagcccggtgggaaaaagtggctgtttgaaaacgggcctgattctgtgtcccgggcgcccccagctgacccgctgctgcgtcccgggcgcccccagctgactgctgttgtgccttcagcaggtgtccatgtccacggcttcatcttcagtggaaccgcttgctccacttcagctccaggggccttggctggcagacccctcccctcccccaccaccccgactttccctgtcttttctgtgccccctgtcacagctcctcagtgaggacctctgtgcctatcttgtgtcactttgtgtctttaataagttctggaaccattcggagcctcagtttcctcactggtgaaatgagtgggccactgcctcccctgagagcttgtgtcacatttcatgagctgacgtttatagaagcaaataccctatttccacattgcttcttgggacgatcttaaatttcacagatcatttataagaatctgtgtttccataggaaatgctgatattctcttccttttttttttttttttttttttaacatttctgtatttgttatccctgtaattaaagccagttgctgaagcacagtaggatgcgtgcactgtgatagactaataggaacaactttttctcttccacagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggtaaaggctttgtagccttgaagcagcccctgggggacagtgtgtagccacagggccctcaatgtcacctgcctgtcactcacctgcctgtccagtgacagccctgccagggcatcggtggggatgtgggcttgattctggtgttgctgctgtgttcttggtattggggctttttgcaagtgtactcgtttagtcattcaacgcacatcttagggtctccctaatagctgtaggcccaggtgctgagggctgggcagacagcggaagatggaggagtaccttggtctttgtggagctcatgtgtgtttgtgccggagtttatccccttgtcccaaactctgaaggttatgcaaatgcacaccctgccactcatgtttgtatagggcacgtttgtcacttgtttggacagcagttgttgagagtcacactatgacctggcacgtttgtattctttgacccagtaattttccttttaggactttgaccaaaggaaatggatgaaagtttgtataaaacaatggaatgcggctgggtgtggtggctcatgcctgtaatcccagcactttgggaggccaaggcggggggatcacttgaggtcaggagttggagaccagcctggtcaacatggttaaaccccgcttctaccaaaaaaaaatacaaaaagccaggcgtggtggcacgcagctgtaatctcagctgctctggaggctgaggcgggagaatcacttgaaccccgggaggcggaggttgcagtgagctgagatcacgccactgaactccagcctgggtgagagagtgagctcctgtttcaaaaaaataaaataaaaaataaaaagaacgcaacctcagtgtccctaggggaatggtgattaggatattgtgcttccacttagggaatagcatgcagagtatttgctgatatggaaatattccagatgtaatgctgagtggaagaaagagagtaagaaccatgcatggtattacttgacatattgaggaagtgtgatctatcccagcagaacgcagcacagccatgagaatgaataagccacagctgtgcatcccccacctgcggccgactacggcgtctaacacagggtgctaggcaaggagggcgcgtcgcgtgtggtgctgtttctgtcaggcttacaattggacagatctaagttgtattgtttaaggatgcagccaagtggtaaaacgtagtaaatcccagcaaaactgtggtcactctaagaagtcagtagtaatggtggcctcttggagaagtagaggtagtgggctgagagggcccatacgagcatgttggggatgctggtggtgccctgtctcttgacctagtatactgatgttcactttgcaaaaatttgttcagctgacataaatgtatcatgagcttttctgtctgttttatatgtttttcaatttaaaaagtttttagaaacatagaaaaaaatcacagggaagtcaacagcacaggcacagtgacgaaggctttgttagctgtttaaaggaagagacgtagcgggcagtgtggcatgcacctgtagtcacagctgctcgggaggctgaggcagaatcacttgagttcaaagctgtggtgagctacgatcaatccttgaatagccactgtactctagcctgggcaacatagcaagaccctgtctaaaaagaaagaattaggtatgtggagggtcttcttgtgattacatttttctgtttaaaaaaaaaagcgataggctgggcgcagtggctcacgcctgtaatccccagcactttgggaggccaaggtgggcggatcacgaggtcaggagatcgagaccatcctggctaacacggtgaaatcccgtctgtactaaaaatacaaaaaattagctgggcgtgttggcaggcgcctgtagtcccagctactcgggaggctgaggcaggagaatggcgtgaacccgggaggtggagcttgcagtgagccgaaatcgcgccactgcactccagcctgagtgacagagcgagactctgtctcaaaaaaaaaagagagacaaatttgacttcgggaggccaaggtgggcatatcacttgagctcaggagtttgagatcagattggacaaaaaagcaagatcctgtctctacaaaaataccaaaaattagccaggcatagtggcatgagcttggagtcccagctgctggggcggctgaggtgggaggatcacctgagccctgggagttcaggcttcagtgagccgtgatcacaccactgcactctggcctgggcgacagagtgagaccgtgtccccagaaaagaaaagacaaacgtccctctgcccactctgagctgtcagcgctgaacgcggcctgtgctatggaagcccatgtgggcgcctctgatatccttgcctcctgtctgtcagcctgcctgtttcccattccatttgtgtttatccttgaacagtatctataattgttcattgtaaaactccatgtatatagtatcatcttgaatgtattttttcatccgacattatctgttgctcttcatccatgttgacaagcgtgttgcccagaagttcacaaccaggagtgattccctttcccagtgggctcgtgcctgtaagtgtgggtttcaagttgtcactatgacagggagccaccagtggccttgaaagagccaggaccagggatgccagcctgtcagcggggcactcagcagccaggatgtctccaaccccaaggtgaagcctccatggggctcttcgtgggccagggggctcctcctcatgggcggcagggtctccttgtggatgggtatttggtgagtcccaggggctctgggcagccctggccacccctggtgcttatgcctggggaggggtgctgctggctgtgagccctcagccagccttacccacccctcgcctgtacccctggggtagctgacaggatctggtcgtggttgaggtgctttgccttggactccactgaggtcaagcagcctttatgtcttcatttttgacatttggattttttccttatgtaatttttaatattctttatagttttccatttgtttcctccatgttttcgaattgtattactttcatagtaagaaaaatgaggtatcaggctgggcgcagtggctcacacccgtaatcccagcacgttgggaggccgaggcaggcggatcacctgaggtcaggagtttgagaccggcctggccaacatggtgaaaccccgtctctactaaaaccacaaaaattagccgggcgcggtggcaggcgcctgtgatcccagctactcgggaggctgaggcaggagaaccgcttgaactcagagggcggagactgcagtgagccaagatcgcgtcactgtactccagcctgggcgacacagcgagactctgtctcaaaaaaaagacaaatgaggtatcagaggaacacttaaaagcactgagaatctttaaatctagtaaatttaatacaaaatatggtaacttcaatattcgttttgtgtttgttttttaaatacaggatgattcaaagccgccttactcctacgcgcagctgatagttcaggcgattacgatggctcccgacaaacagctcaccctgaacgggatttatacacacatcactaaaaattatccctactacaggactgcggacaagggctggcaggtaaatgccttcagtttgttgttaaatagaggctgatggataccgagaagaaagtggagcggctgctgtctggaacacaggcacaggataggaaggtagaagggggggttggagcctcccgtgctgagaggaagaggagttgggggccggtgctgccatgctctgcctcaccttctttgtgtggagcagaaggaagcgtggttctggaggagcgtctaggcctgcatgctttactgttgtggaaattcatgtgtctgcataggatttgtgaagtgtggattgtttgagatatttccctttgaccaatgcagttcatatttgaaatgtaggagaaatttaaaacccagcctatccttccctttggcattctcctgtcttcctcatctaatcctgctaatggacagaagttttgaagtttgcagagacagttttcaaaccgcattttaccaaggaacacttagaagacatcttaaccagttggccggggtaaaaaacagatgaacgtggtgtgccctgtctcagccggggagcccacctggtcgtggaaccccggggctacccccaagagacactttgaaatctgcaaaatattccctttggtcagctcacacaccaataatttttttttttttttttgagtcagagtctcgctctgttatgccaataattttaaccctttagattatgtaggttttttctctgtgtatctgtgttgtgttggctgtttactggatgtatatgagaatcttgctatttgaaataatttggcagtgggtaggtttgaaatatagaatattaaaaacatagagaagaaatgtatgtatgcttatagttttttaattcattaagtaaccaggaacatctatagaatttctttgaggctttaatgagtaaatgatcctttaaaaaaacatctaaactacatggcttagtggtaaggatggtgcaggggcaactgttttctatttattgaaggggaaaaaccttttttgttttaaccacagatgtataaacatgttatgttaaaaaatagcctaccggccgggcacagtaactcatgcctataattctagcactttgagagccgaggcaggtggatcgcgtgactctaggatttcgagagcagcctgggcaacatggcgagaccctgtctctacaaaaaataaaaaaaaattagctgagtgtggtggcttacgcttgtagtcccagctactccagaggctgaggtgggaggatcacctgagcccaggaagcagaggttacagatatctgtgatcacaccactgcactccagcctgggtgacagagcaagaccctgtctcaaaaaggaaaaaaaaagcctaccagccacgtcttccatatttcctttgtggaggggcttgggggtctttaatcatggaaggtacagaatgagacccagcctcccctctggcccaccttgtgcccaccccccatacctggagtgtctataccctgtcctgcctgccttcctgtctacagcaagggggtatctcttaattgaccattaggaaaatgctggatttggagagtagttccatattcagttacatgtcagggtctcttaacatattgcatgctaaattctggccgtatttactctataaaactgaggctgtgcttcaaactatatacatacacacacacactctctctctctctctctctctctcacacacacacacacacacacacacacacacacacacacaaccagataataacttctacccatgttccagtgaccatggctttatggctttgtcaaggagagaaactccacatggggtccagcttgctctgtgggagtgtgtgagggtccctcagagtttacagcttattctgatggtttgagataccagttacctggggctttgtcagtgtgtttctaagaagctttattagactctaatgtgtttctcttaagtggtatttctgtgtgttttttctaacatccatttatttgagaactacctatgaacaggacaaggctttcttgctaaagagggtggctggataaaggcctggcctcagttttgggggggcccaagtcaggacaggtcttttggggagcagagcccttggagcaaggctctcctggaccacagtcgtgaagtggcgaggaccccacgggacccctcatgcatgccctgctttctgtcgtctattgcaggtgcctgcacagctcacgtcggcagggaatgacagactagcacacgtcaggcacccttctctgctgaactgctattaaacttgtttctgttgaaacattttctctcctgtctagatggaggtctgtaagtctacagctgcatctctttccccagtaaggccactcctgtgtcatttcatgcctcgtggctccagctaattaagcgggagagggattagtttctccagattcctcctagttcatggacattactctctctcttttttttttttttttgagatagagttttgctcttgttgcccaggctggagtgcaatggcgcgatctcggctcactgcaacctccgcctcccaggttcaagcgattctcctgcctcagcctcatgagtagctgggactacaggcttgagccaccacacccggctaattttgtatttttagcagagacggggttcctccatgttggtcaggctggtgttgaactcccgacctcgggtgatctgcctgcctcggtctcccgaagtgctgggattacaggcgtgagccaccgcgcctggccaatgtactttgaatttctttctgtcctcagctgtacccttggctgtcagaatactgaccctcacgggctcttcctgtgccatgagattctctgagccgcccttcccagtgcctcagaccttattctgacttcctccctcctggcttacaacaaaagccaggtgttttgtattgtctacctatggtatagctttttggtcaatccacagaggacatctgagggtgaaatgagatggtctgaggaatcctatttgaaaagatgccatatgtctttcttttgtttgcatttacgtcctatgatttgattttttcatggtacaaaagtatttaataagtgacacttcagtacagaaaacacagagcttgtagcttgtcctttaaaaccaggacggccaagtgaaaagtcagtacagagtcttatttttactattaaacaaatcaaagggacacactgggcattgaactactatgctttttcttctttctagagatgacatacgtgttttctgataagtaatgtaccacacattgcactaaagcaaagcagcaaacagccagtaaagctgtgccctgcctgctgctcctgccgggctggaccagtggaacaccatctcggtaggagaggaagaaaatgcagagtccctaacccagagagcctaacaaactggtttataccgaagtgatcttcagcaaacacgcaaacacactaacatgctgtaagaatgttttagtctatttctagcacacagcataaattcgtaggtgcccagtcaaataggaaggaacgccattgtagaaagcatttttgccttcacagcactaacacctaaaaagcacacggcatatagtactttgatctttaagtggataagcatggaagtcccaagatcatatccactagattagcctgagtattcatctataaaaatatatatttttaaaataatgcttaaaagagacttctagaaacagtgggactacatcaggagcagaagacagcgacacaaggactgcaaatgttaagactaggagtggcttttcacgtggaacttttatgtagaggacgtctctttctgttgattgctacagccgagacaagctgtgatcacaggagattctgaaatctcaagctgggcttgagtaacaccctagatagacatcaggaaccccattgaggctgaagtactgaaactgacccatgtgaagaagagataaagagatgcagatgcgcaaagattcacgcagagcctgctgggacagagggtggcggcgggttcatccacacgtccacaccagcgtgtgtgcttgggtggcggcggcgggttcatccacaccagcgtgtgtgctcgggtggcggcggcgggttcgtccacacgtccacaccagcgtgtgtgctcgggtggcggcggcgggttcgtccacaccagcgtgtgctcgggtggcggcggcgggttcgtccacaccagcgtgtgtgctcgggtggcggcggcgggttcgtccacaccagcgtgtgtgctcgggtggcggcggcgggttcgtccacaccagcgtgtgtgctcgggtggcggcggcgggttcgtccacaccagcgtgtgtgctcgggtggcggcggcgggttcgtccacaccagcgtgtgtgctcgggtggcggcggcgggttcgtccacaccagcgtgtgtgctcggggaaggaccccccaagtggagtgctggacatgggctcgctccagaggcgtctgactcagaagctcctgagagaagtgtctccttgaggaggggaggaatactacggttaatgaatacaagaaggtgtttcaggagaaataggtctaggagggttaagtcattttggttttgacctgtcaatacttaacataaatgaagaattacaaaacagagtcagtctttttccaagatgtattctgtcatcatgagctgagcctgttgggctggtgacatccagaatgttccaattcattggctggagggaggacccagtgccgcagattgttctgggaagctggcacagaagatgattgacacaacgaagtcaccactaagccactgcttaagtctagtcctcggccttctttttctgctctgtagtccaaaaccgtgaacgtagcagcatgtcgaatatgtcaccagctgcttcatttttatggtgctgtaatgtggtggtgaaagctgccatgttgaatccagaaatccgctccagcagctgttcttcaatatatttttctaccaaaaaaatgtatgcaggctgggtgcggtggctcacgcctgtaatcccagcactttgggaggctgtggccggcagatcacctgtggttggagggttcgagaccagatgaccaacacggagaaactacatctctactaaaaatacaatattattagcggggtgtggtggtgcgtgcctgtaatcccagctactcaggaggctgaagcaggagaattgtttgaacccacatggcggagactgcggtgagctgataccgcgtcattgcactccagcctgggcaacaagagcaaaactccgtctcaaaaaaagaaaaagaaaaaaagaaatgtattcattaaaaataggtgtgtaggtgagtttattctcttccgtgtcttcaaactccaggtagtacttgtccatgtaatttctctgtaataactggaactcgttatccatgataacgttctctaaatatccaaccacaacagcaaattcatcagaggtggaggagaaagacagcacaaagctctcttcttctaaggtgtccatcactgcagccccgagcaggctcctaccccgcctgtggcccaacctgcatgcagggcgtggcgggcggccgggttaaggtctcgcagccaaagctgcggcgtgctcactgcccagtcagggcagcacctgcgtgccaggcccagccctgggttagggccccgccgggccctctgtgcataccgccgacactgcgggccaaggtctcggtgactccaaaatgatttttatggttttatgattttacttcacccagaattgagataattgttgtgactatgagaagtttgaaaggacgggcctctcagcctccaaagggactagagctggttccttttatttatttttgttttatttatttttttggggacagagtcttactctgttgcccaggctggagtgcagtggcgcgatctcagctcactgcaacctttgcctcctgggttcaagtggttctccattctcagcctcctgaggagctgggactacaggtgcatgccaccatgcccggctaatttttgtgtttttactagggatgggattttgccatgttggccaggctggtctcgaactcctgacctcaagtgatccacccgcctcggcctcccaaagtgctgggattacaggcgtgagccaccgcacccgtcacttgatctcttttaaagggaggactgtactctggactcaccctcacccttgcacttttggaagcgttcctggacattagacccatcctctgaaaggaacttgtcctgttccttctcctcagtttctgtacacgtccttactgtgcagagtgcacacgggagcgcactcagggctgggtgaggaaacagacaaaccgtccttgagaaacgtgaggtctgcttaggaaggctgcaggaaggcacagaggagagccccggaagggagggagctggtgctcagggagggctgattttcagcagacgctcaatttggaaagcctttgggggaaaggtaattgctcagaattgcaaatccttttcttcatgtttagcgttaaagaataacagcccacgttttctctgaaagctttaaaatttctgaatcattagagtccagtcaatgtggttttaatacatgtagcaacagaatgaaggaacatccatcctgggtttgatcaaattacaacagccttaaattaccttagaaacatagttactttattctatttgtgtctacattaaatgtctcattaattcctcatattttctggagtcttgttggctggcaaatcacaagtaatctttcttcatttgcccttggagttgttgtcagggagatggattggagaataaaataggttagaatctattctgatgctgcgaactgggttcttttacgttttcaggacagaaaatagcagctccccaattccacagacttactttgcgtctcgtaagtgatggtggtggtgacgcaggggcagggcttctggcccgtgtcacgttcttctgctcacatggctggagtatggccccaaagtcaccttttctgcttccacattcccactgtgctaaccttctttcctcctaagagcatgcaaattaaatgactccacatcagtcagtacagccacagccttcacttcggggcttgttgactgttgtctgttcttcagactcggatgctgcgtggggtagctctttctgagtccccgcttaggaggactggtcctggtagaacagcgagaggggaagtcgtccttctcaggcagtggctgggattgccatttgcactgcttgagggttttatattaccatcgtgtgggtttgcttttcttcagtcctagtctcagaatctaccttctacttcacacttaaaattctgagagcagttggcaaagctttgccttctctgtctttgtcggggcaccaataacagtcatgtttgattttctggaggaattgatagaaagattgggcgtcagctaaagccaaataaaacattatagcagtatctgtggttattagaatatttgaaatctcatctgatgcccttacctataaacagtttcacaaatcccacacatggcctagcccacctcttcatgtcgcccatgaagtagctccatccacagggcccagatccctcccacacatggcctagccctcctctccatgtcacccatgaagtagctccatccacagggcccagatccctcccacacatggcctagccctcctctccatgtcacccatgaagtagctccatccacagggcccagatccctcccacacatggcctagcccacctctccatgtcacccatgaagtagctccatccacagggcccagatccctcccacacatggcccagccctcctctccatgtcacccgtgaagtagctccatccacagggcccagatccctcccacacatggcccagccctcctctccatgtcacccgtgaagtagctccatccacagggcccagatccctcccacacatggcctagcccacctctccatgtcacccatgaagtagctccatccacagggcccagatccctcccacacatggcccagccctcctctccatgtcacccgtgaagtagctccatccacagggcccagatccctcccacacatagcccacccctcctctccatgtcacccgtgaagtagctccatccacagggcccagatccctcccacacatggcctagccctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaataaaacattatagcagtatctgtggttattagaatatttgaaatctcatctgatgcccttacctataaacagtttcacaaatcccacacatggcctagcccacctcttcatgtcgcccatgaagtagctccatccacagggcccagatccctcccacacatggcctagccctcctctccatgtcacccatgaagtagctccatccacagggcccagatccctcccacacatggcctagccctcctctccatgtcacccatgaagtagctccatccacagggcccagatccctcccacacatggcctagccctcctctccatgtcacccatgaagtagctccatccacgggcccagatccctcccacacatggcctagccctcctctccatgtcacccatgaagtagctccatccacagggcccagatccctcccacacatggcctagccctcctctccatgtcacccatgaagtagctccatccacaggtcccagatccctcccacacatggcctagccctcctctccatgtcgcccatgaagtagctccatccacagggcccagatccctcccacacatggcccagccctcctctccatgtcgcccatgaagtagctccatccacagggcccagatccctcccacacatggcctagccctcctctccatgtcacccatgaagtagctccatccacagggcccagatccctcccacacatggcctagccctcctctccatgtcacccgtgaagtagctccatccacagggcccagaggcattaggatggcacttggacaacccctgagatgggttgtaaagtgttattttatattttgtatgttggatttcttagtcacctttgacgatttgaaattcaggctgaggcttgcaattctaataaggttaattggggaatttagaaatgatttttggatagctccagattttgttttgagtgatcaccattttaacactttaatagcttaattttaaatctacacattaatgtaaattcacgaaatgtttctatgaacccatgacgttcgtccggctttggcctgagtcaggtcccagcgggggctttcttcagggtgtctgtcaactcttagctgggcttttttctgagatggagtcttgcttctattgcccaggctggagtgcagtggtgcgatctgggctcactgcaacctcctcctctcggcttcaagcaattcttcagcttcagcatccttagtagctgggactacaggtgtgggccactgtgcccggatgatttttgtgtgggtttttttttttttttgagatggagtcttactctgtcgcccaggctggagtgcagtggcgcaatctcggctcactgcaagctctgcctcccgggttcacaccattctcccgcctcagcctcccgagcaactgggactacaggtgcccgccactacgccccgctaatttttcgtatttttagtagagacagggtttcaccgtgtttgccaggatggtctcgatctcctgacctcgtgatccgcccgcctcggcctcccaaagtgctgggattacaggcgtgagccaccatgcctggccaatttttgtatgttcagtagagacggggtttcaccatgttggccaggctggcctcaaactcctgacctcaactgagccgctgcgcccgtctggctttttgtaatagaaagaatgatgcactgatgaggagctgggagggaaatttttcctgtgtacgttacgaaattatttcagagttcaaataaaaaaacaggtactttgccaagtcctctcttcctggaagatggtgtccatcctgattttcagcctcctgctcatttttcttttttgctggtttaccaaatactttatactggattaatttacttttaatggcatgacagattctgtaagctaattctgtgcgaaaaagtattttaacagaatggctcacatcagctctgtttgtctccaagcagggagaggttggcagctaagtcattgcctccacctggaatgctcagtgctgacagttgcagtcctgggtttcccaccttgaaaggagatggagtcagaaatggcctctgtctgcgctgtgtggattgctcatccctcctgttgccagctctccaccctgcctcccggggcccgttctgccacagagtgaggtgtcctttcctctttggaagcccatagcagccttgggctgaagggctcaaaccccaggctgctacttcccttgagaattgctcacccaggcgggagggctgctccttccacacagcacagcctgtaaacgtcactctctgtcatcgtttataagcatgatgactgggttttcacgcttccccataggatgggccttccttaaatcttgttatgttgtcagcacattacttgtgtgacgcaaaagaaaaaaaattcactcttgcagtctgccaggcccaacatgtaggtttctgctttttagggcactaaaacgaggacacatttttatttctcagcaaataaatatatgaattctacgtatttttttatgtttcatagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggtaaggaaaaagaagaacaaaaggcctcacttcgtgcttactaaacttaccttcagtgtattgggaaaatttccttttgaaaatgaaggaactactaaatgcattatgattaaatgttgggatggggatttgagcaaaagtgttgggtgctgcccaggtgtttctggttctagtggctgaaacatttgagacgatttgcaaagtttaaactgcactcgacgcagtgattgttgcttcatggggctcatcgcatgttgttcataccagtgccacgtcgacgtttttcctttcccttggcacaggaaaagttctttaaaactactttttaggccgggcgctgtggctcacgcctgtaatcccagcattttgggaggccgaggcgggcggatcacctgaggtcaggaggtcgagatcagcctggccaatatggtcaaaccccgtctctactaaaaatacaaaaaaattagccgggcgcggtggcgcgcgcctgtaatcccagctactcgggagcctgaggcaggagaatcgcttgaacccggaaaggcagagattgcagtgagccgagattgcgccacttcgttctagcctgggcaaaacagcgaaactccgtctcaaaacaaaaatacactactttttagctgcttaagttcgagttgacttatacagtgttaatttgcctgagtttaaatacttatttttagcttcactaatactgtttttaacaaaaaaaaaaatgagcgtaacgtaagtcttaaatgcccacggacctgctcgctgccggctccaccgtcagtgcacgggagctgcttagagagggcagctggctccgccccacagccgtgccgcgtatgtgggtgagggcccgtgacggccctgtcccacacaggctgagtctgtctacccgagtgtcccgctcagttcacaggcgtaggcgtgcagagacgtagaacttacacaacagtacttggttgtcaggagacaaatgacaccccctttgcaaagtgcacttattaaaacagcaagtgctttctgagtgcgtcagctgtaaccatgcaatgtcttcttctcggtgacacaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccaggtgagacagcgggagaggaagcgagggccccaacagcgtgagccagacgcggacgcctgggctccacagagaagaaacagccggactggaggcctgcctgtccctctgtaccttatactagtacctgattttataggccttggaaaactaatagcactgggagtgttttttaaaaatcaatgaaggttctttaaacgacactgagtagatgcctgaaataacttagaattaacctgtttcttagtttgtcattcaaaaatccatgaaacagcccccgcacccccaccccccgcaaaaaaatcaaaacaaaacaaaaacccatgaagtagacaaactagacactggaagcaaaaacatgtcctttttttttttttttttttttttttgagacagagtctcactttgtcaccaggctggaatcttggctcgttgcaacctctgcctcccaggttcaaagaattctcctgcctcagcttcccgagtagctgggactacaggcacacaccaccacacccagctgctaatttttgtatttttagtagagacagggtttcaccatgttggccaggatggtctcaatctcttgacctcgtgacctcatgatccacctgccttggcctcccaaagtgctgggcgtacaggcgtgagccaccacgcccagcctaacatgtccattttaaggaataggtaaaacagtttgcagtttacttagtcataatgtggaataaaaatgtgtgccctggggaattaaacaaacaaacatagtgtggaaatgtgtccaaactgtctgttacagttgacagaaagtgaattgggtcatttgggattcctggccctgccgggccagagaacagccctcccctgcccactggcggtggcccctgacagccatgtctccctctctttgctctaagcccccaaaccatggcagaggcccctgacagccgtgtctctctctctgctctaagcccccaaaccacaaagggcagaggctgggtgccagaggctctgtgacagccccactctgtttttgaactttctgcttcccttccactcgttacaggaggaagatgttgatcctaggtgagtgtggccctcgtctttctggcctacaggggcagtttcttctttttttttttttgttcgtttgtcttgagacaaggtcttgctctgtcactcatgctggagtacagtgacgtgttcttggctcactgcagtctccaccttccaggctcaagcaatccgccctcctcagtctcctaaatagctggggctgtaggcgcacagtaacatgcccggttaatatttgtcgtagagacagggtctccctatgcccaggctgatctcaaactcctcccacctcagcctcccaaagtgctgggattacaggcgtgagccactgcgcccggcccagtttcctcttttattgagtattgacattttcttttttataaagaactgtgggaagaggggttaccagatatctaaatagagccaaaattgcatttttagcagttagagataggaattaaataccccttttaaaatactacacctccctcattattagtaactttactattgtgaggtgaaatagggccatatcctatattttaaattaaagtttgtatgttgcttgtcagtgctgagtgtgagaacctttgtttgtagaagtcagtatctgtaagtgtcagtcctgctgtgtctttcaccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaaggtaggcggaggggaaaggaggagaggggagaccacagggaggtgaaaggtgggccgggggggaaaggaggagaggggagaccacagggaggtgaaaggtgggcgggggggaaaggaggagaggggagaccacagggaggtcaaaggtgggcggaggggaaaggaggagaggggagaccacagggaggtgaaaggtgggccgggggggaaaggaggagaggggagaccacagggaggtgaaaggtgggcagtgggggaaaggaggagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttggccgtggggaaaagaagaaaaggggagcccccagggagttcaaagttggccagtggggaaaggaggagaggggagaccacagggaggtgaaaggtgggcagtggggaaaggaggagaggggagaccacagggaggtgaaaggtgggcagtggggaaaggaggagaggggagaccacagggaggtgaaaggtgggcggggggggaaaggaggagaggggagaccacagggaggtgaaaggtgggcggaggggaaaggaggagaggggagaccacagggaggtgaaaggtgggcgggggggaaaggaggagaggggagaccacagggaggtgaaaggtgggccgggggggaaaggaggagaggggagaccacagggaggtcaaaggtgggcggtgggggaaaggaggagaggggagaccacagggaggtgaaaggtgggcagtgggggaaaggaggagaggctgccccatcagcctcacactctgggaagtccataagatttgctcatccttggccaggcacagtggctcacacctgtaatcccagcactttgaggggctgagacggtcagatcacctgaggttaggagttggagaccagcctgaccaacacggagaaaccctgtctctactaaaaatacaaaatcagctgggcatggtggcgggtgcctgtaatcccagctactcgggaggctgaggcgggagaatcacttgaacccggaaggtggaggttgcagtgagctgagattgcgccattggactccagcttgggtaacgagcgaaactccatctcaaaaaacaaaaaaaagatttgctcatctttttctaatttgctgtttgttttagagacattttctagcaggtgtgatagccatctggttattatgttttaaactggcaagatttttatttgctttccagtaatattaatgtcgtttcttttcctttaatttcagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatggtaagacgtgctggtcggtggctccccgtggctgtgggtactgggagcagagccccttctcactcgtggtttcggttctgactgtaacaattttagcttttgtctgaggcaatgtttgcatttcgaagctgcaggaaatctagtcatgctggggaagtggtcgtggagtcggccgtcacgggattcccgtgggaggacctgcctgaaaagagatgagagtttctaatacattgagagggaaaaatactctcgcctcttgtagatttcctgggtgtggcctggaagcggcctgaaacggcgggagccgccgcgtgtcttttcccttggcctcgcgcgccctgtggcctgtggcggtgctatgctgctgagggtgggagagaggctgcttttctgtgcgctttgctctcagagtccgtccgaggccggtgcacagaaaaccgcacggatgttctgacattgacaagtggagacaccagaacctccgcgccgacaccgggttatctaccttcgccctgccctgtggagtgtggaaagggtgggagtccctgctggctgccgagtcaactctggcattggggcctggctcaggtgtgggctcccgctgctctgggttgggtacatgtgggctgttgccggctgtgtggctgatcctggcgcttgcgggatctcaagcaggcaaatccgaagctaccgactaaaactgtctctgtgcccacgacacgctttctttgaaagagggtacaggtcagaaggctttatcacgacgtttgaatccttaccgaacgctacgaacagagaccttgaaacctgcaggtacctcctactctgactcagcaccaccctgcctctccccaaatttatggaagaacaaggtctggaaccttttctagggaagactgactacctggggttttttttgtttttaagtaatagcaacacttgctgcctgtagatagatcgcagagtttgcagtcatcagttacctgtttgaatgccttcgtccccaagccctgtgtctcctccttctcttctctctgggtaactgtggctgtggatgctctaaggtgataaacctggtggcactgcaggtagctgggaggagatggaagccgggagggctggcgattggagggcaggcggttggagggctggctattggagggcaggcggttggagggctggcggttggagggctggcggttggagggcaggcggttggagggcaggcggttggctttctggtcttagtcactcccagtctgaagacaaggcagaggcctagtgattcccagattcgatatgtgtcagaatcacccagaaggcttggctgttagaggccagagtgctgcgttccccagagttcccgactaggcctgtctggtgtggggcccaagaatgcatttctgaaacagtccaggtctgccaagagcctccggtgcaggtcagaggctttctgggtccacctctcttagaagcagtttgaaaaaccgtatccctgcctggtatagtgcctcacgcctgtaatcccagcactttgggaggtcgaggtgggtggatcacgaggtcaggagttcaagaccagcctggccaacatggtgaaacaccatttctactaaaaaaaaaaaaaaaaaaacaaattagccgggtctggtggcgggtgcctgtagttgtagcttctcgggaggctgaggcaggagaatcgcttgaacccgagtgtggaggttccagtgagatgagatcatgccactgcactccagcccgggcgaccgtgcgagactctgtctcaacaaaaaaagaaaaacggtatcctttttatgtatttaagttatctggaatttttcattataaatttaagcaagtgttttaatttttcactattgaaaatattgatgttttaaaataaagcttttacgggattattttcagtgtactactggactccaaatacagacatcatgagatgtccacttgcccacgtgtggacacacaggcaggagcggcccagatcctcccttgtctgtggcctggtctttccatctcacattccctaacaggttttgtacgagtcacatactttaggcttaaatgtcatttattagtcatatcttttctctgcagcaataaaatatagatataaatattaaagtttgtctatgagtaacaaaattgataaaacccaaaaatataacaaattcttataaaaccaaaaattaaaatgttactgaagatgcctttcttagtgtatttagctttaaaggaaaccacctgattcgttctgtattcactgatggttgcacagtcctagtgtcaacactgagggcctgtttccactcaggaaggagaggacagtgtcagcactgagggcctgtttccactcaggaaggagaggacagtgtcagcactgagggcctgtttccactcaggaaggagaggacagtgtcagcactgagggcctgtttccagatgaacgtgaaagtctgtcagtgatcttggctgggtgtggtggctcacgcctgtaatcccagcactttgggaggtggaggtgggcggatcacttgagatcaggagttggagaccagcctggccaacatggtgaaactccgtctctactaaaactacaaagattagccgggtgtggtggcacattcctgtaatccctgctactctggacgctgaggcaggagaatcgcttgaacctgggagatggaggttgcagtgagccgagttcagaccactgcactccagcctgggcaacacagcgagactccatctcaaaaaaaaaaaaaagtcttgtcagcaccagtatttcctattattgctttcatgctccatcccatagttttcatccccaaagccagtgcccagttgagcagatgagagaggctgttcagagagaggaggtggcagatgggctttaagaaaagacttcaggaccaagaggagattctggaaatgattttccttaaaacagtgtcggctacagcctggatgctgaacacctaggatgagaaccactgcacaggtgctcataattttggcctcttgtagtcttttattttttatttgggaggtagtgtctcaccatgttgcccatgctggtctcaagctccggggctcaagcagtctgcccacctcggcctcccaacgtgctgagatgacagggtgagccaccgcctctggccagcacgtcttttcatgtactttatggttatttgtgtatcttctttgaagaaattttttttaagtcctttgcccatcatttaattgggttgtctttttgttgtgaaatttgtagttctttattcatatgtagagatttcaggccttttcagacatgtaggtgtaactcagagacattgcagggttggttccagaccactgcaaaaaaatgaatattgcagtagagctgccagtcacatgaaatttttgggttcctactatattaagcaattatgtttatactaaattgtagtgtagtgtattaccccaaggaaaatgtagtatttttactgaggaattatgtggatgtggccgagttttctgacccaagcatggggttagaatgtcctgtgcagggagggactgcacaggctgcctgagactctcccaggggtaccagagggctcagcaccacgagcagataggccgaggctgggctgcctgccctaagggggttccatcctcaccctggccccaagggcagcctgggccggttctgcctctgccaccagctgctgtgggacccggggctcagggcttggcccctgcgtgtgtcgtgaagacagtgctgacagatgggaggtggggctgacaggacgaggggtcaggatgttccggccatgcactgtagccctggccttgcaggacagcaggtggcttggtgggatgataggtgagttccgtgggcaggcgcagggcatgagctgccagtgtcttcctggaaggtgactctggggttgtcgctccagctggagtgtaccctcattcctgcttccataggggtctccatggaggcctcattcaaacacaggcgagcccatccctggcctgtcaggttcaccagggtggcccctggtcccgttgtcgccgttgtccacaccctgcccacctgccaatgctcctgtgtcccctgctctgctccagggccccaaaccctgtgcagagctggggtgcatcatgctgccgccccatggagaaggcctggaggagatggaagccgggaggcttcctcttacaggaagggaagccccagaaatgtgcctggcaccaagaaactgctccaagcttgttccagagtgtggggagggcttgaggcctcccctttttgagtacatggaaaggaaagcctggcattttctggaaacgctcccaagtctccctggcagggagatgtgggaagagtccaggcgcccaagctcttgcatattcacttcctcccatcacacgtgctgtgtacaagcaccctcagagctcgctttgggagacccctgcctcagggctgcgggtgccgccgtccacaccacaggcccttctgcttcctgtttccaaagctcatctcctgtctctgggctgcaggcgctgtttctggtttactggcacaactgtggttgtgtttttgtcaatgacttcatctttgctgctgttgttttgagatactgtcttgctctgtcacccaggctggagtgcagtgccgagatctcaactcactgcagccccgacctactggtctcaagccatcctcctgcctcagcctcccaagtagctgggactacaggtgtgcagcaccacatccagctaagtttttgtattttttgtagagacagggtctcactatgttgcccaggctggtttcaaactcctggactctggtgatcctctagccttggcctcccaaagtgctgggattacaggtacgagccagcatacccagccagtgttgtcgttttgatttgggagttcggggctgagctgtgtttggccagggcctcgcctgctcagtgtgctcctgggctgagctgcggtcctggagcatctcttggctcacatattgactcctccggcctctctactgtcctggtccttcatggggctcacatgtgtgtcctcttgttttctttctgtcaccttcttaagggttcacagatcactgtcagtggaaggtgttgccacagctcaagcctcacagtggaggaacctcatgaggcccttcacggggccactccctgtctggacaggcctgcctgaccagccctgctgggaagcctgggctttgctgctgcttcaccctgcgacattctcctcaggccctgcctttcgcttctttcgttaacattgttcctgccttgatcgtttgctccctcctgcctaactctgctcttcttccttgtgtagcagttacgtggtcctcaaatatcatttgttgactccagtgtttcctggggcatctcctcaagctggctggggttctctgcatctcagctgtggcgcctggtgtgagggcgcacgcttcgcagtgagagtgaaatgcccagttcgcgctggcagagggagaccctgtgaaggtctccctgtgccaggcacaggctcttattctgaaagcagaccccgtgaaggtctccctgtgccgggcacaggctcttattctgaaagtagaccctgtgaaggtctccctgcgccgggcacaggctcttattctgaaagcagacccagtgaaggtctccctgtaccgggcagaggctcttattctgaaagcagaccccgtgaaggtcttcctgtaccgggcacaggctcttattctgaaagacccagtgaaggtctccctgcgccgggcacaggctcttattctgaaagcagaccccgtgaaggtctccctgcaccgggcacaggctcttattctgaaagcagacccagtgaaggtctccctgtgccaggcagaggctcttattctgaaagcagacccagtgaaggtctccctgtgccaggcagaggctcttattctgaaagcagaccctgtgaaggtctccctgtaccgggcacaggctcttattctgaaagggtacgcagcagtttctggaaggaaggaaggagggagggagggagggagggaaagaggaaggaaggaaaggagagcgataggcacagaggaaggtagatgaagccccgcgcccccctggcggagcccagccctgttcaccgcgtgctgtgcgggtgcctgtgccaggatcagctggctggacggctatagccccacgcctgcaggccacatacctgggagagtgtgggccttccgagccttctggctcccggccccacagaggaattacggtcccatgtccctcacaaggacccttgcagagggagcagtgcatcggcacagagcaggacacaggggagccgggctgaggctgcgggtcccttgtggccgccaggtgctcacgcgtgcctcggtggggatctggcagccagatttggggtgaggatttgatgatgtgggtatccctagctggtcccacagtgacgatgggtgttgcgttgtgagcatgtaaaacggcagtgacgtctgagggtccctggacgtctttcacacccagcctcaaagcggagcctttccaggcagagcagcagctgccgccactggattgacagccccagagcagcgggatcaggccacgcggacgaggaggtgcgaggcctcgggtcggggcctgtgttctgcgggagccgcacccatcatcgctgtggcggtggcagtggagcagctgctctcgtgtctgagctgctccggcgtctctgtccacagtatagggtcttctgatgcttcctggaggtctcggaggggcttgctgcgtgtagtacccacacagcccacaactggggtgttgtcaagtgttatgacgtaggttgcctgtggagtaaaagttggccgctaagaaatgctctagacaggccgggcacggcggctcacacctgtcatcccagcactttgggaggccgaggcgggcggatcacgaggtcaggagattgagaccatcctggctaacacggtgaaaccctgtctccaccaaaaatacaaaaaattagctggacatggtggcgggcgcctgtagtcccagctattcgggaggctgaggcaggagaatggcatgaacccgggaggtggagcttgcagtgagctgagatcgcgccactgcactcccgcctgggcgacagagcgagactgtctcaaaaaaaaaaaaaaaaaaatgctccagacacttcagtttgaaaatattggaatttatgtggggaggattagtgtgcatggaaggccaaaaatgtgaatgcatctccgcagtcatctttccaaaagccgccctctgaatcagtgaggaccctcagggtggggaacgtccccttgtgagtgtctgcagattggagtaggcagcagcggagcccgtctctgtagatggactcgcagaggaacttagttctttccctaaaggagtaggaacagctgggcgccgtggctcacgcctgcaatcccagcactttggaagaccagggtgggcagactgcttgtgcccaggagttcaagaccagcctggacaacatggtgaatctctgtgtctacaaaaaatcacaaaagtggctgtggcggcagcacctgtagtcccagccaccaagaggctaaggcagggagatcgtttgagccagggaggttgaggctgcagtgaaccgtgatcgccccactgcactccatcctgggagacagggtgagaccctctccacatagtaagtaaatggaggaatagaaacgcaagccggcatacattgtctttgacagcattttgtggataggcaagttctaaccatgggggcaacgtgggatgcagcagggtttggtgtgccgtggggcaggggtaatttgcttgtttctctaagactttgtacagctctataaacagattcccattaggtcgtcctttccttgtgacaggtaatagtggaggtgtcacaaggtaagtggcctgtcttgcctggttttcaggttctacggcttttgtcttgttttttgagaaagggtctgtcactgagactggagtgcagtggcgtgatcacagctcagtgcagccttgaactcgtgggctcaagtgattctcctgcctcagcctcctgagtagccaggactacaggcacgtacaaacatgtccagctaatattttttttcttttgtagagatggggtcttaccgtgctgctcaggctggtctcaaactcctaggttcaagtgattctctcgcctctgcctccccaaatgctgggactacaggtgtgagccaccgcgcccagccttctccttgtgtttgaactggagaggacagagtgctatacatgtggtcacggtttttcttcgttgaaagctctaacagtggggtcggtccctgttattaagcctgtgtcactattccctgggccctaaaagtgcacctggctcctgtgacttggggtcctttcccactcctctccccagggccccttggcctcagaaggcccccatgtgccagctcagactggagttgcctcagttgacacagcaggccccatccagacagaccagcaggtgcttctggagacaagagcaaagccttttccggcagcccggaacctgggatgagaaacgacaggtggaaggttgtccagagacacctacagcgtggatgctgttccgagtcagcgtaggagaaaggccactggaaaccagagtcacactgcgcgtctgtgcatctctggcctaccgcagtggccccggctgtctgcacattttttgtagacacattagagtcggttgaggccacacctgcggccacagactgcgaccgcgattgcagggaggagcatctgaggtggtcacggggtttgcccagctcacaccaactgcaggtcagttcctgcttcgccttcagtagcctgagtcccttcttctttttctttcacgttactagggcagttgttcgctgacgccttaattctggaacacgttccttgcccagattcttggtggctgcttgttcccttctcatcgttcctgctgtgttttccatgcttggtgtagggggaccctcagagcttggtgtagggggagcctcagagcttggtgtagggggagcctcagagcttggtgtagggggagcctcagaggtggcgtcaggacgtgcctgccccaccggttgccctggtgccctcgtcacgccccgggaccgcgcacacgtggggactgtttccagacgcactttctgcgggcagtctgtgtggcagggctccctgcccagctcctgcagcctcatcaagtctcccactaaggaggtgtcgctcctccaactttgttctttttaaaaatcgcttcagccattctaggtccttggcatttccgcgtgaactgtaggattcctacaccaagcctgctggcgtcttgattgggacggtgttgaatccagagtgtgtggcagagctggcggagcccctctttctttgatctctgccgatctccttgatttcacgtttgttttattccacagaccaccccctccccatcttctcacctacttcaggttccatttcatggtaggaaattcctgtagtcctcccgggcttgctgaagtgctgctccaagttacagtccccgggttgtcaggcgtggcgagagccccttgtgctcagagctctcacggaacacagagcaagcctgtctacgagttcagccggtgaggggcaggggctggtgaaggcggcggcgcctctgggtgtgcccaggggcagggtcgcctccaggccccacgcgctaagccgtgactccctgtaacacacccgtgtcgacacaggtcacgtgggcccgaggtgctcatacatcacactccttgtccaggatggtccttcctggcaccatgtggtcctcggtgcaaaccagagtttgcagtgctcgctgcacagacccttctgccttattcagcatctttagatcaacagagtcagtgccttcccaagagagcacgtgtgggcctcatcaggagcatgtgcccaactcgtgtgtgtgttccttctctgccctggaggagaggggtcgccctctcttgtggcccaccccggggctgcagggctgatggctgctccctccccagctccggcacctccagggctctgctgcctttagtcttccttgcgtgccctccacctccctccgagcctctgctgagacctctgcttcagggccgggcgtgttagcacagcccctctgctgttacagggctccatgtggggtctccacgtggcggagtacctcgcgacagaggctctgtgagggcagggctgggtggatgagagtatttaagtgtcaccatttcttttctttcttttttttttgagacagagttttgcttttgttgcccaggctggaatgcagtggcatgaccttggcttactgcaacctctgcctcctgggttcaagcaattctcctgcctcagcctcctgagtaactgagattacaggtgcccgccaccacacctggctaattttgtatttttagtagagacggggttgcaccacgttggccaggctggtctcaaactcctgacctcaggtgatccgcccaccttgacctccccaagtgctgggattacaggcgtgagccaccgcgcccggcctcccagtttcttttcactccaggcctctcactactgttctctaattgacacagaataattgtgcaagtgtatggggtgcacagtgatgttgagaagcatgtgactcgtgatcggcacatccgtcatctcattgaccatttctaggtgttgggaaccttctggctgtttgaaaccgtattgttgactcccatcatctcgcagtgctgcagaacactaaacttattccttctgtctagctgtcgtttctagttttacgtctttttaaaaattattcctcctgtctgtcatttctagttttatgtccttttaaaaattatttattttttatagagacggggtcttgctatgttgtccaggctggtctcagcctcctggcctcaagggacccgcctgcctcagcctctcttgggattgcaggcgtggaccactgtgcctggcctacgcctcttgtattctctgggtcatccagtcaacttgagccctggtgagggtgaggctgttgggttgggtgagtcagccgtgttgtgctgccgtaacagaacacccaagatggaagactttagcatgaacagaaacggattggcttgcagttctggaggctggcaagggccttcttcctgtgtgctcacgtggtgatggggtgaaggcatattcacccttttagaatgaactcactcctggaatcatgagcctgtcccttggtgacagcattaagctgttagtgagggcaaagccttcatggtcaagtcaccttctgaagatgccacctcctaattaggctgcgtgggcaagtgagtttcagcatttcaggagacagatgcccacaccatagcagtgacctcatctcattcagggtattggtgcttgtcagacactggctgtgactcgcatctgggtgcgtgtgcctctctctgtgggggccaccctgccgtcaggcgccaggaaaccgacgtcagggaatgtgggggtctccctgagagggtgccgacctaacacggctcctccgggtcacgtgggtgggctcagcggcctcccgtgcctcccctaggtctggagtctcccctgccctctcgttgggctccaagcctcttcctcagcccagcttcctgctttgtggcagccgtgctttctggaagctgagcagcttcttttttttttttttttttttgagacggaatttctttgtcccccagactggagtgcaatggcacgatctcagttcactgcagcctccgcctcctgggttcaagtgattctcctgcctcagcctcccgagtagttgggactataggcccccaccaccttgcccggctaatgtttttgtatttttagtagagatggtgtttcaccatgctggccagttcgagactggtcttgaactcgtaacctcaggtgatcctctcgcctcagccttccaaagtgctgggattacaggcgtgagccaccgcacctggcctcttgttcatgttttatgtgtaaattggtcctctgctatttctgttgctcagaggtggaaaggagaagggaacacgataaagtcacacatccacactgttgacaggggtttggcttccagggaacacacctctgtggcctcagggctatgtcctgaattctaaaacggggctctcacggctgacccgatgtcactgggtccccgtttgctgcttgagtctcttcggagcccagtgttgactcccgctcttcgtggctgccccggctatctggccatgaggagctgaccacgcacctggccggactcacatccgctccgctagggaagacctgggggcggaggtcggtctctgaccagccagcgtccctgcaggggactgcgagtaggaggcgggtattgcccacgccagggcctgtggtctgagagggctggcccttgacggacaggtgggcaagtccccctcccacatctctaggcaccagggcgtagcgtaccatgtgtgctgtgtttgtggttgggttcaggtactgccctgtaggcgtgtctgctctgagcctcctgggacagcctgaagtggttgctgcacagctgctttggggcctcccaggggtgtgttcctgctcccaccctggggtgctctgagttggtcttgggttagagaagtgcagtggctggtgtgtgcgcagcctaggggcctaggacctgcttctcagagcatcacggggcccaccaagaagtgccccctggggaggtgacagcgtcttccagaaatgccgccgcccacaaggaggactggcctgtgccggaagctggagatggtggggtcctgatggcacctggtaggtgagggtgccccagagaaacagagccaaggcggcggcctggagacagattctgtggaatctgcccactctgttgtggggcctgccaagctcagcatctgcagggtggaccgaaccccggggaaagagtcagtgctggattctcaagagtccagaggccatccagggcagagtgctcccctcagaggacctcagtcttttcttagtccttcacctgattggatgaggcccacccactcatggcgatcagctgatttactcagagctgactgatttaaatgttaatttcatctaaagaagtaactatacagaaacatccagattaatggttgaccaaaatctgggcactgtggctcagccaggctggcacataacattacccatcgcatgttagttggaagcttggcctttggaattaactcagcctggtcagccgttagcagccagcagtctctgttctgcccacacacctctgtggactgacccaggacacaggtgagcagcatccatgagaaactgtggtgcttctctcctatgggacagatggagccccgctcccttctgtgtggaaatggtccaggagcatcttgtgcgggtggtggggggcgagggcagggcctccgcatgagggagagcagcgagcggcagccactccttcgccgagccagcagggccatctcctgtctgcctcaaccactactggactcagcctttctcccccagcagtgacatcaaaatagcctatttataggacataacaaagatgatgccagctgttaataaaaatgtccgctaatcaggcagttcacttgctgcagttttttggggtcccaagggcccagcccaggctcctgtgcccttggccaccgtgggccagtccctggggtcttgtgggagcctccgcgggcctgggagtggcaggacccttagagggcgagagttcacatgagagcgtggggttctgactcgcgagggttcacgtgagagcgtggggttctgagtcgcgagggttcacgtgagagcgtggggttctgactccctcgtgtcatttcagccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaacgacagaaccatttctacttcatttggaaaaagattcagtcttttatcacaggcccttttgaaactcagatcccaggtctctccgtggtatgtttgtatttggggtgtccctccggctctaggcggcctctgacccgctgtctactccccaccttcggtgagcggccgccatggtggagcagggtccgagccacgtcctgcagggcacgtctggggcatttcctgttttgtggtaggaaatgtccctgacctttcagaaccgaacccaatcctgaggctgactcctctacggaaaatgaggacaggacgggggtgagggaatgagagtgggaggtccctgcacctcctcgcccggctcctcaggaagaaaaccgctggcccttcccgagtgtgccggccgagggccgagggccgtgcacatggggagagggcgtcagcctgatggctgagcttttaaatgtcatcatcataacattatttatttaaatgtagttattttggtatttaatttttttttagagaggaaaaaacctgtattttcctggtgggatgaaatagggatgaaatggctcagaatggtatatttaggcaattttaaaacatttattatttacataaagaccaaatatgatgaatctgttccgtgaattgtgtcggccctcagcatggggctggggcagcgtcactgcggtgacgcccattgaaaggtatgaaatgactgcacactagctggattatcactcagccgtttaagaaataaaagcaaaaccatcacgtgactgagaccgtgtgtgtgaccgcagcaaagcgcagcgtgtggatggatcagagcccctcggtgcagctgtctgcatcttccaagcactttacagataccttggaatgtatatttttgtcttcttactcagaaggtttgcagtttgtaaaataatcaggattctgctctgtcctgtgtgtggggtcagctccctccacagagggctccagctctgttggtcacagctgatggggttctctgattgataggagacgagctcttgagctctaaggaacagtgaggtcgccggtggggagcttggctgggacaccaagcaaatgcatcgtatgtccccttggagacgtttttatgcagctgtgtatgttactatccagaaggagtcgggggtagactttcccgtgtaagctcagtccataaactggttacttctgatcctggaacgtggacttcacatgataggtctggatctgtttctgttgggatcacaggtaaggaaaatgtccattcaaatggtaaagaagggaggagggtgtttttttttttttttttgccgtaggcaccattctgcatcttgaacccagactgaagtgtgcctctcacagatggaaggtgcacacgctcctgtctcctcctcactctgccacgttcacttggctttttcattggtacctaggaatttaagaatatcgaagcgagagcagtaacaaaccatagatgagcagactcccacaccgggttttcttgcccgtctttaaggcactgtttctaaattttgaacttagctctgaatccccaagaacttgagcacagcaagggttgctgagctgctgtcgccgcagccctggcccctggtgctggagctgcagcacctttgggagaggtcctgcgtcgtcctcagctgcgtcgctgtgaactcccgctctccactgtgttcctcagtgtctgcttttcaggaagtctgctgtgacctttgcccaacttctgagctcctcagggactaggaacaatttcagtagctttgccctgaaccaaacgagaaaacaaaagggaactcccgtatgacccacgtcacgtggtgcactcagagtgtgtgcggcatgatcctcggttgctcctcctctcactttagtagagtacgcggtggacagctgatctccttcagtcgtctacccacttccgtcattgtcctccgctagaataacagagtagttggtagtcatggccagaaggggggtgggggcagtgtgaggacttggggtttctgtgctgtgtgacacaaggagataagtgacaatcttgaagtcctaacttccactattctagaaagtatagtggtgatttgtgtgcaaagatttgaagttttaaaaaagtaccaagttcctgaaattcaat

SEQ ID NO: 786 - DNA, 18682 bp, Human
tttctttcttcactactttcgtggagaggttttttctgggttgggagaaaattttgcttctaattatattctcccaacatagcgcatgtgcttaaaagggaaacaaaagcaggagggggaagggtctagagtgataagagctctagtgagaggctaggcctagagagggacatggagaaatagcatgcggagaggaacggtagaggagcaacgctaacattcagttgtaaataatacaatcatagcagctaatacatagagggactacacgccaagcactgttctcactgtttagccatattcactcatttagcatgcgcagtagcttgaatccggtttttcaattattcattccctctctctgcacgtggccgtagagtacactagagtgggcagaaaataagtcacaaaacagcaaagaaacagtgcttttggaagtaggtatgagacaaactcttttctaggcaaaagtaacccacgaaaatgtgtgtggaaaggccagatcctactattaggcaggatgggaatttgagccattttatttggatattacagaatggggtgaccccagaaaactggaagaactggggaccagcaaatggccgacctgcagtcctgagcagaggatgtaggccagagtggacctagaagataagaaagggaattgaatccagtaagggacagacactttatttttttatttttatttatttatttatttatttttgagatagagtctgatctggaggctggaaggcggggctaaaactcccactcacttacctctaccaacaactaggccaccaagtcatttctgaggactggctcaagaaagcagatttaacttacactggcctagcccaggccaccagatgcatccacggagatccaaatgcatataatcacttgaatcaagatctagacagggacgcgtgcagcaggcttcatctgactgattcctgacacgggagagaaagcctaagctccgaatcatccttcaatgtttacaaaggccctaaatagcagtgggctaattgctgttcctggatttccaggagacctgagacccatgaaggagcaggaaagagcttggggataaaaaattaatctggaacctactggagcggaaggggctgcactcacctggaaaagacaaagttcttgggaactggccacgtaggccaggtccctaagcaattccatcccgcaccctaacaccccgactggtgttcctgggtccctaacattgtctgtacccgcttcggaggttggacaaaatgagtttttcactgccctgcctcaggcctctctcaaaggtctggcccatgatatttggtgtacattgggaccccagcgcccagatatttgaaacggggtggggagcgggtgttgagctgctacatttccaggttctaggtaccctggggaacccctggtcgttgacggaagcacagcgttcaagggcggcagagctcaggtactggaggacacatgggccgcgccgggtctagccgcgggacatccccagaccccagcacggcctcccaggccgaccttccagaagccggcccactgccttccccgggtcccagcccagaaaagcggagaccttcccctccgtttggaagatggactcatcccctacttcctcctggctccccagaagacctggagacctcgggaagtgttctcatctatgttcgctccaacccgggggctcaggcccacctcgatcccgccttcccgggaggtccaggaaggtcccgccgcacccaccccgttggcctcaccctggctcgggcccctttatcatcctgcagctacgctccgaccaggaggcacagccagtccccacagccggctctaccgctctgctcgcaggtttgggctagtctggggcggggacttgggagcgcctaaaacttgcgaggagggcggggccgcagaccggtcctttaaaggttggaagtggccccgaggcgccggcagccctgggcggtcccgggaatcgcacaggacccggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggccggcgcggggcgaggtcagcgcggggagcgaggggagctagggcagcggggaccccgggcccaggcccgggccgagctgggctcgcggcgggagggcgggaggctgggggcgaggtgacagcgcgacctcgcggactgggacttccacgaagctgggacgaggtgggcaagatcagggacagggtccgcagctgggatcccgggctgggctcaaccccatctccctttcccgcccctggtcccggcagcccccagctccttctcccagtgacccagagccaatgtaagtatgaggccagaggtcagacgtgaagctcctccaagaaccggcgcggggagagctcagttaatgggacccacgtgggcgatgctgctccagcatcagctccaggcgctgcgggccctcgtcctccacccgactccgggcgtctgagacccaaagagcaggttgtgcgggggcgggaacgaggcgatgctgtctttggaggccctgagaaactgaggttgcacaggagcgcggctctgtcctcgaaacggcctcagtcgggtccctcctactaagtctggcctgggtccggcctgcacaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccggtgagcaggcggcgtcggggaaggaggcacaaggtcccgggaactgctgcggggctaggagggcagagttaaggacggtcggagcagacttagaggatgtatgggcccagggcaggtgaaatgtagggatcccagggtgctggacagaaaacgggaaggagttatgaattcccaaagttttacacaggctaagagaggctgcgtgtgaggctggaggcagggagtaagtgatctggagatcccatcttccaagaaggcaaagacagaaagtgggagttgcagcgatccaggaaaacagagaagcaaagtgaaagtaggaaggagatgtaaaggtgactcagaagtcaggtgaggggaccacatggaacaggagggggtgggtgacccgtgagagcagacagctaagggaagaaaacataggatgctggagagctggtttggttggaataacacggaagacacccgtgaaagacaagaagcacactggcccgcaggagacgaggaggaatgaggatggcaaatagtgaatttttttttttttttttttgagatggagtcttgctttgttgcccaggctggagtgcagtggcgcgatcttggctcactgcaacctccacctcctgggttcacgccattctcctgcctcagcctcccgagtagctgggactacaggcaccccccaccacacccggctaattttttatattttttttagtagagatggagtttcaccgtattagccaggatggtctcgatctcctgacctcgtgatccgccctccttggcctctcaaagtgctgggattacaggcttgagccaccacgcccggcccaaatagtgaatttttaaccatgggtaatgagtaaaagagagatgaatccagagatgagtgagggcagtagggatggaacatcaaatctatgactttgagacaggtgagtgtaaatgcagaaaagacccagaataagtccatagatacagattatgatagtaaatccagaaagatgaggtttaaaaaaaaaaaagcaaatgtagaatcttttgaggacaggtgaaggcgtggcaggtgaggtttaagatgtgaaattaatcaaagcaatctgtagtagacagtaggtgtaggtgtataggtgactaagatttcatcaccttaattaaggtgatttttttccaaccatagatattgatgaagtaaggccaggtaggggaagatgagtgaaggagcaagaaatggtggcaaacaggaggtttttatctacaggcaaaggatgagggctgaaataagagaaagcaggagtgcaaagttggcaaagatgggataaacgtgtctggtggataatcaaatgaggcaaagccagagataaaagcaacagtgcatggctgaaaacatggaatacggctaaccacagggagatgaggacaagaggcgggcataggaccagacagagccgtgaggccaattgtcttgatgtctccccagcccgcctgccaggagacaatgctttggacatgttccagaagcatcgagagaaggaactgaaagacagacagcagatctactggtgaccacccaccccttaaactaaccccgccaccactgtcccaccccttccctgcccctgcccctgcccctggccccatcactgaccatgacatccttcctgaagctttgtccccaactcctagctgggccacctggaaggaagggttacccctgaccatcgctgcagaccgtaaggatgatctacctccaaatatgagattccatgaggagaagaggctggactttgaatggacactgaaggcagggtgagaaaaaggctagacctcgaagtgaaataagggctgggagggccaagaatgatgatagacggtgagggactgagggatcagctgatgagttaagcctcaatacctgtcctagggctctggagatggccctcaaacgtgtttacaccctcctgagctcctggaactgcctagaagactttgatcagatcttctggggccagaagagtgccctggctggtcagtggttccccgaggtctccataatcccttaatggcccctctggatgactcatcacactccacagtcccccgtaactctttgcaagaagagaccttatcatatctggtcaactcagagaggccttgagaatgaaaacgcagaagctgggttcagggagggttatatacctgaacccctggggtagattttggagaagggatatgcaggctgtggtacatatatcctcctttcaccgcccaccaaagagaaggttcgccagtgctggcaggatgatgagttgttcagctaccagttcctcaatggtgccaaccccatgctgttgagacgctcgacctctctgccctccaggctagtgctgccctcggggatggaagagcttcaggctcaactggagaaagaacttcaggtacctctccttcccctgcctggcactgttctctccttagtagtgtggtgagaacggacagagagaatccaaactgagtcagaggaaggctgcagtactgcattgccccttggtgcagtcctgtgctggaaaaatacagaaataaaatatgtaggggaagaaactatgaggagctcccagcaggaaggggaaaatagaatggatccccagcacacagagaggggctggagatgttagcaggaacagtgacattgcctggccgcagtgttctggactccagtgttcatgggcagggagaaaagtgaggaagtgccatcaggtggggagaatcggggaggctttctagaaaaagagagcggggtttggaagcaatggactgtactgaggacaagcctaggcaaaatgtgtgcgtatgcatgtgtgtgctgtatgcggtggcaggggtagtaggggaagctctctggaatatttggcagaggacgtgagatttgaatagggaatgaaagagcatttgctgagctgataggagccaaaaccagagcgcagaccattcgggaatgatcagaaaggggcctggccatttgacaggtggtcagtttacaatgcctgtgatgccaactggattgagcaggcctggttccaaacccagatctgccaccacatccacacacaagacatctaccctcaccagactgtttcttcactttaagatgagaggaactggaccaggggctctagttctcccaacagggctccggtactgatgcaggagaatggcaagaagctagactaaatctcttgccctttgccccggccccctgggggtagactttgaactctaaaaatggatacatccctcctgtccccagaatggttccctgtttgaagctgacttcatccttctggatggaattccagccaacgtgatccgaggagagaagcaatacctggctgcccccctcgttatgctgaagatggagcccaatgggaagctgcagcccatggtcatccaggtaagggccccagacctctcccacaacgttgcactctgttcacctcaacctctgctcccagggacccaacccccagctcttggctcccaaaccccatcctcactcagtgagacttgtcttcatgtcactatttgcctgtaccctcgtctcccctgcctcatccaactagaattactttttcaagagtcaaaatggcctcttggagttctcatcctgtatccaatggtcctcacacttcagtgtgcatcagaatcacctgaatgcctgttgaaatgcagatttctggatcccatgaccagactttctgattcagtatgtctggggtgggaactaagagtttgcgtttttataagttccaaagtgatgctgacactaccagttcaggactacactttcagaatcactatctcatctctcagtggcctctggctctgaaccctcgccatctcttgaatatcttttctcgcaatttcttttttttttttgagacagaatctcactgtgtcactcaggctggaatacagttgtgtgatcttggctcactgcaacctgcgcctcctgggttcaagcaattctcccacctcagtccctccagtagctgggaccacaggcatgtgccaccatgtgggcctggctaatttttgtattttttgtagagatggggtttcgccatattgcccaggctggtcttgaacttctgggctcaagtaatctgcctgcctcggcctcccaaagtgctgggattacagctgtgagccactgcacctggccttctctcactattcttaacagtcaggtgacaagaactgtcaataatcttacacctcctacttctccttcacattccaccaccatctgagcgccgaccccaaagcagcaggtttctcccacaccactgttagggcctccttctggacccccttcttccagtccctcctgccttccacctgacatcagggcactccagctagcgagcggcaggctgggagggttcacagtcctcctgctagactataacctcctagaaggcaataatcttacttagtcatctctgtttccccaagaatgctgactataatgtcatatacggaatgggagttcaataatttctctttctcccagattcagcctcccaaccccagctctccaaccccaacactgttcctgccctcagaccccccacttgcctggctcctggcaaagtcctgggtccgaaattcagatttccaactgcacgagatccagtatcacttgctgaacactcacctggtggctgaggtcatcgctgtcgccaccatgcggtgcctcccaggactgcaccccatcttcaaggtacttattaatctattaaatcacatatccctcagaccccagagagaggaacagccccatatcaaaagatattgcagcagcaaaaactctttgtagcaatttgtgagtgaagaggagactgtctcaatatcttgagatgttgattttaattaagtttattaagtttagtcacttaacattatataggaatcctctgaaattctcagagatctgacagtctagcagtgcgctcacagtagggcttgaacactgctagtaaaacaaaagccatattcctaccttagatctagtatttagccagaaaaacaagtgatgcccataagaaccaaccagagaacagtatctggtactagagtttgaaatcacaagggacagcctataacagtatagtattgatgaagaatgtttctacccaattgaggagtcagctaagtagaaacagaccaaaaggcaaggaagaacagccagcaagccgctcatacctgcccaacagtaaggtggatagagatgtatgttagcatggtaatgacaggaatgaaaaggaaagaatctaaaacgtagtgaagggaggaaatggtagctgcagcgtgcctgggtgcaagagagagaaaagccagaagtccaagcttctgccacacctgtaagtccctggggcaggtgtgttatactgacctagaaatactgtggttttaagagctgggtgtggtggttcacgcctgtaatcccagtgctttgggtggccaaagcagtatgattgcttaagaccaggagttcaagaccagcctgggcaacacagcaagtcccggtctctaaataaaaagaaagaaagaaagaaatactgtaattttataaaacagtgagttccatatatattgctgggagaaggcaaaataagacctgtgcttgcttaagaaaatgttcttaaaatcttgatgatactttatatacagggaacttggcagagggagcacaaaaatgatacaagcttacaaaccagagtaattgtcagaaacagtaaagttagaagaaaccagagtcagcaaaaatgaggtgtttggttttaggtacatggagtttgatgtattggcaagatatgcaagtatgtcctgggtaaaaacaaccaaattgtgtttcagctgggggcctccaccaagaccccccaagcctggccagtatagctgtgccgcctctggaattttccccttcggtaacatagacaagatggagaccagtctgatgaatggaatcttggatttcattcatctcatgctgtctcctgcttccccatcctctgctccacacgaacaagtgaagcctctattcacacttacaattccttttcctagttcagtcctctccgtgtctccactcaccacagtaatgccatgccccagcggacagctgagttgctggcagatgcacacaagggtcaagcctgcacatgtcttaacagtggcctatgcaggctctgactttggattgctggggtcttagtcctgaaccccggcctcaataatttccagatgtcctcacatgttccatcgtgaggttattaaaggttaaaatgacttaatggtgtgacacaagctaaatgctacaaaaaacattagttcttgcaaatttttttttttcagagacaagttctcactctgtcacccaggctggagtccagtggcgtaatcataactcactgcagcttcaaactcctgggctgaagcgatcctctaacctcagccttcagagtagctgggactacaggtgtgcaccaccatgcctggctaattttttttattttttgtagagacagggtttcactatgtggcccaagctagtctcaaattcctgggctcaagcgatcctcctgcctcagcctcccaagtaacctggattgcaggcacatgccgccacacccagctagttcttgcaattattattattaaggactgtttatccttaggcatcctttctcctcatgtggactttggcctttccgtgacatttggcatctttcatgaatcttctgaaaagcttcaggttaatgtgagctgctttggtatcttaacaccaaaggtgtcattggggtcattgccagtgtccagcatcaacaattcagacaagcaccaaaactgcttgaaacctgcatgttaactatgtggaaaggaagacaaacagtctaagataaaaagaaacgcatgtaaggaccatgcctttttttaatagctaaggaaaatattttaatatttttaatttaataaattttaatttattaaaattaaaattttaatttaatattaaattaaaattttaattttaattttaaataaataattaaaatttaaataaatttaaatttaaaatttaaatttaattttaaataaacatttaaatttttaattttaatattaaattaatttaatttaatattaatttaacttaatttaatttaatattaatttaacttaatttaattaatttaatattaaattaaattttaatatttttaattttaatattaatttaatattaaattaaattttaatatttttaattttaatattaatttaatttaatttaatttaatattaattaatttaattttaattttaattgcttcaatattaaattaaattttaatatttttattttaatattaaattaaaattttaatttaaaattaaatatttaatattaaattaatttaaatttaatattaaattttaatagctaaggaaaatattttaatattaaaaaaagaccatggccttttttcaatagctaaggaaaagcaggagaagaggggcccaacagtgcttaagtaggggtggagaaagatttgcttaaacaggtagctgaatatagctcttctagttctgacagaaagtattctccccatccatcccctaaagaaacccccaactgtgaaacaactaaaagatggagatgcagctttgatcataagcagagaggctagtttaagaggatgtgaatgacagaggaggtagcaaagaaaatcagaaagggctgattcataaggcacctatactcaaggtagaaacaatgaagcagacagctactattccaggactcttatgtgtaatagacactctccaacatcacttaggtgagcatcaccacagcccctgagataagagagtctattgctgccccctgttgacaaatgaagagattgcagattaaaaggttattaacttggccaagtctcaaatgaggagtaaagtgtaggttaaaatcctggtcagtctggctccagggcccaactcacagggaagttggagagcacaagagtgagtgatcagaacagcaggagatcagcctgtaaaggaaagcatcaagaggagaaggcgccatgctgggtgccaggccctaccaggaaggacccaagcatggcctccaccagtcacgccctccaatctcctcctctccagttcctgatcccccatatccgctacaccatggaaatcaacacccgggcccggacccaactcatctcagatggaggaatttttgataaggtgaggagggtacggggcatgggactgcctcatccatctctccatgatctgccactttcaggatccaagatcaactatgtgtgaatgtcctcactcttaacctatgaacctgtcccttttatacccatgtctttttttttttttttttttttttttgagacagagtctagctctgtcgcccaggttggagtgcagtggcgccatctcggctcactgccatctccgcctcctgggttcaagcgattctcctgcctcagcctcccgagtagctgggattacaggcgcccgccaccatgcccagctaatttttatatttttagtagagatggggtttcactgtgttggccagactggtctcgaactcctgacctcatgatccacccacctcagcctcccaaagtgctgtatacccatgtcttaatatctgaaaatcccacatttgccccactttatggaagatgtgttggttctccagccctgtttccccctctaagacctgtgatctcctgtcccaggcagtgagcacaggtggagggggccatgtacagttgctccgtcgggcggcagctcagctgacctactgctccctctgtcctcctgacgacctggctgaccggggcctgctgggactcccaggtgctctctatgcccatgatgctttacggctctgggagatcattgccaggtgagtaaggaggagctgagaaatggtggggcggggggggggggggggctctggcctgaggccagcatggggcaaaagcaagaaggtccagaaaggagaagcagagaactcaatcctggggagagatgaggaaaagtgaggacacagtgggtggctctgaaaatgaggagactgggatgaggcagagagaggaggtgaggggagctgtggggggagactgggggaggtgtctggaaaaatcaggattttctgacgatgtatgacagcaaccatgcgaattcctagaactaaggacccacatcttccatgagatgctagtgtgtttagagggctgaggatgtcccaaaggcgaggtgtcttcccagatactgtggaagcattgggcagatgccacagaaagaggaatagaggtcagaggcgggggctttctgccctcaagtgccttttccccctgggcaggtatgtggaggggatcgtccacctcttctaccaaagggatgacatagtgaagggggaccctgagctgcaggcctggtgtcgggagatcacggaggtggggctgtgccaggcccaggaccgaggtaagatccattctagagacagaagaagctcctgggagactctgccagggcgccttcccagccctgcccttctggggacaggaccccagcctctcatcacgcctcccttcctccctccacacgggaaagcatgtgtatcccattcccacctcctccgactcaggacaattctagagacccaaggactgtcctcctcagagaccctggccatcaacccctagtcccactacaccccagtcacagatgcccctgaactgccatatcctggggccccccaggccatatccacagctgggaggggtctgcacagtccctgctgggctcatattctctcctgatggttccgttttcctaactgaggatgtaaatgggaagattttccctccgaagcccacaaggacccaccctggctttccctccctctcttcctgcctgccactgtgcagcacgcacagagggtccaggaataccgcacgcttgctacagtgcaaggtcagctcttgatgcaagctcaatcctatacatgctttgcctcaaacccaaactcagcaccctgatccttggggctcaggtttctttggctaatccaactcttccaccctaaccaccccttggccaaaatctagccactacctttagtcaactctcactccccacatttgaacctctgaggaagaaaaagcctttgctgagctcttaggtttaatcacacaggcaccagcctggactgctgtcactcatccttcggcccctccccctcacacttcagatctaggctgtgaataccatcctctgcctctgtgagacaactacagacatttactggggagcccttatggcgaatcctgggaatgtggcaaacctccttaccctggagggagcctctccctggggaatctgcaccaccctacccttccaggaccaaactctctctagttcttctcagtacagtcccttaggctcctagcagtttgggctactacaacaaaacactagctgggcacagtggctcacgcttgtaatcccagcactttgggaggctgaggtgggtggatcacgagctcaggagttcgagaccagcctggccaacatagtgaaacccgtctctactaaaaatacaaaaattagccaggcgtcgtggcacgcacctgtaatcccagctactcgggaggctgaggcaggagaatcgcttgaacttgggaggcggaggttgcagtgagctgagatcacgccattgcactccagcctgggcaacagagcgaaactccgtctcaaaaaaataaaataaaaaaaaccacacaccatagactgggtggcttataaacaacagaaatgtattcctcacagttctggaggctgaaagttcaagatcaggttctggtgagacccctcttccaggctgcccacagccgatttctccctgtatcctcacacagcagaaagatagcaagctagcactctgtcctctgctcataaaggtatcaaacccattcaggagggctgcaccctcacaccctaattatcatgtggggctccacctccaaataccatcacaataggattagatttcaatataaaaatttttcggagccaaagacattcagttcatgacacatgttaactttaacctccactaaccaccctcccccctgttctctttcagttctcatagctcacttttgtctagttttcccagcagacattttagaggctaaaattaaaaatgccatgggattagcagtcaggaacctgagttcaagatcagcctctgccttttcccaactatgcagtcctgacagtttattctctatgggctttgattttcttacctataaaatgagagtaattatatttattccacttaactgataagattattgggtctcccagcactttaggaggccaaggtgggcagatcacctgaggccaggagttccagaccagcctagccaacacggtgaaactccatctctactaaaaatacaaaaattagctgggcatggtggtgggagcctgtaatcccagctacttgggaggctgaggcaggagaatcacttgaacctgagaggcggaggttacagtgagccgagattgtgccactgcactccagcctgggcaacagagcaagactccgtctcaaaaaaaaaaaaaagattatcgggtctctgagcccccatatccactgcaaaatgagtggactgagataacctttgtgggagcccctctcagctgtgacactggaaatccatgacttattccccacattataacgcagacacttgtaattctgtccgggaataggattacgcattcctaaattatttatttattttttaatttttaaatagagacaggctcttgctctgtcacctgactaccagcaatcctcctgccttggcctcccaaagtgctgggattacaggcatgagtcaccgaccacgcatccctcaattggtttttttttttttttgagacagactctcgttgtgtcgcccaggctggagtgcagtggcgggatctcagctcgctgcaagctctgcctcccgggttcacgccattctcctgcctcagcctcccgagtacctgggactacaggtgcccgccaccacacctggctaacttttcgtatttttagtagagagggggtttcaccgtgttagccaggatggtctcgatctcctgacctcgtgatccgcccatcttggcctccccaagtgctgggactacaggcgtgagccaccgcgcccggccgcatccctcaattcttaaccactttttgaggcaagggatatttggtcactcagaacttttcagcccccaatccttccataacaataattattacttacttattgagcatttattacagaccaggtgattttgatacatcatctcatttataatgtaggtatcgtccatattttacaggtgaaaaaaactgaggttcaaataggttaagctggcctatggtaactaagtgtaagtgactgagccaggacttaaacgcatgtctgatgcaaatacgtctaaataaaataaacaaattcatcaattctaaaatatgggcatcccaaaacaacagcctttgttcctctcctcttatgctgtagcttctaactgctattcctttcctgcccaggtttccctgtctccttccagtcccagagtcaactctgccatttcctcaccatgtgcgtcttcacgtgcactgcccagcatgccgccatcaaccagggccaggtatggacagctgaaagcccaggtccctgaaggcaaggtgacctgagggagagatgggagttcaaaccctaagtaccagggttctagggttacagtttcttcctccagctggactggtatgcctgggtccctaatgctccatgcacaatgcggatgcccccacccaccaccaaggaagatgtgacgatggccacagtgatggggtcactacctgatgtccggcaggcctgtcttcaaatggccatctcatggcatctgagtcgccgccagccagacatggtgagaggggactctcgggagagggaaatgacagttggaaaggaaacatcagagtgaggggctgggctctaggtgcgtttgtctttagaaactgactgatcctttgttctgtctcaggtgcctctggggcaccacaaagaaaaatatttctcaggccccaagcccaaagctgtgctaaaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactgagatatgaatgttacatcacaaagtagtcttcttttggtttattcaaccatttaaaatgcaaaaaaaatccacaaacaaatgtgctttgtttgagacatgcacagccaggctacagactggatttggcccttgaaccctgcactagcctgaggccctgaccctacttccaaaacatccaagatcatggagcagggggatttcttagaaaaatcagcttacctcagctaactctccattcccaggaactaaccttcatgcctggtggccaatgtacaaattcctgactcagttctttggcaaattccttccacccatatttctcctattcacccatgtaccccaaaagtccctgaataagaatcatgtttttggggcagaatacaaaccactgccccaaaatggcttctttctccaaacagtcccagatgaaaggcacataattcatgtcttaaggctacttttccagcccctttaatactctgggatctatgtgtttcccacattccaagttatctttcacaagccttttaagaacaacatgcacaaaataaatggacaagaactacaaagttattctagccaatgatagtgtttatttgttaggtcctggggtctcaaggtcaaatgatccctctcaattattctgaggtcactgtcctcactagagtgggtacaacttgctcactgcaaaactgtgttcttcaaacatccctacttcttttcttttctttttttttttttttttagaagtagtctctatcgcccaggcgggaatgcagtggcgccatctcagctcactgcaaccttcgcctcccgggttcaagggattatcccgcctcaccatcccgagtggctgggatcacaagctcatgccaccacatccagctaatttttgtaatttttagtagagacagggtttcgccatgttgacctggctggtctcgaactcccgacctcaggtgatccgcccgcctcgacattcctatttctaaataattattacagatctgtcactcaccagttaaacatacaaacggcttttttggaggggatgacctatttatatttttaaatcttatatcctaccttattcaaaagtcctatcagttttcctagtttagagaagcaaagtgacatttttgtgtacatttaacaggactgcttaccttcacaacctgctcagtcggctttccctggacttctcctaaccgcccatttttcctggatttggcaccgagagttacagtatttcacgtgcgatgataaaatgttacttaggagaaacagttccaataccaagaaacttcagcaattttaaagcattttaaagccacaaaaccatgcccgatccccaaaagggggtcctaactcctttacactgtcagaatctcaattttaaaagggaggagtagagaagagatagaaacgctctctgttggtgaaaatctgtcttacttaccatttccccaacacaggagagactaaggaatttcaggtaaaaatcagatggctccaatcctccgatactaagagcccatcgccccagttcccaggagttccgccagttagactttttcccccatggcctcgctaaggctagttcctcgtcacgtgacgtgacaggcttggtcacgtgacataccagctccttccattcccgtgtgcggggggagggggaccaacaaaccggaggccctcgctcttccaatactcacgccctagctacagaggtcaaggaaggtttccccaggagcagttttggtttcagacggcgccgtctcccgcgaaagtcctgagaggagcccagccttttccgcctgccgcccccggatgggatggttgaggccggggccacgccccctctgcccccctgcgagggcatcctgggctttctcccaccgctttccgagcccgcttgcacctcggcgatccccgactcccttctttatggcgtcgctcctgtgctgtgggccgaagctggccgcctgcggcatcgtcctcagcgcct

SEQ ID NO: 787 - DNA, 9920 bp, Human
atcccagcacttggggaggccgaggcaggtggatcacttgaggtcaggagttcaagaccagcctggccaacatggtgaaaccccatctcgactgaaaatacaaaaagtagccgggcatgttggtgggtgcctgtaatcccagctactctggaggctgaggcaggagaatcgcttgaacccggcaggtggaggttgcagtgagccgagatcacaccactgtactctagcccgggcaacagagcaagactccatctcattaaaaaaaaaaacaccaaaaacaaaaaacaagcaaaccagaaaatatgcatcacagacatattttcctggacttcatttgtgttaccaggctgattgtaatccatgccatgaagtttatgttagtattccccttttgtttacattgcctgataacttgtttccctttgtctcccccaagggaagcattcatttataatgaatttttcagctcagtgtgtttcagcaaacacttattgacacccacaaaccctgacactgtgccgtctccaggggaaacaaaagtgagagtcctgctgggtgtgtagtccctgcctaggacgggctcacattagtgggggatacacacatacaaatgctcacactgcagtattaactgtgcaacagtagaagtgtgcgcaaggagaaaagtgttagaaaggaaagctgggccgggcgccgtggctcacacctgtaattccagcactttgggagactgaggtgggtggatcacaaggtcaggagttcaagaccagcgtggccaacatggagaaaccccgtctctactaaaaatacaaaaattatccaggcatggtggcaggcgcctgtaatcccagctactcggaaggctgaggcagagaattgcttgagcccgggaggcagaggttgccgtgagccgagatcgtgccattgcactccaccctgcattccagggtgacagagtgagactctatatctcaaaaaaaaaaaaaaggaaagctaattcactctggtggggtggtggggggtgaaagtaccgggtaagactttcctgagaaaccggaggtgaactagggtttagaagcatgaatagatgaatagactaatccaggagcaagttcttttgagagaacagcaggtggggttctggggaacacatggctccagcccaaaaagaaactggagacgaattagggtttagaagcatgaccagactaacccagaagtgagttctttgagagaacagcaggggcggcggggggagggggggttccggggaacacatggctccagcacaggagatgccagggtgcagtgggatgagaggtgaggagagcaggtcaggttagcaagggcattgaatgccagaaacatttggacttttattctgcagacaacagggaggcagcggcttttatgctcaaaaggaatgagtcccagtggctggcacagagaaggcaagtgtgcaaagctggtcgaatgaattccgtggcctgaatgtaccttcctcaaatgccactgcaaactgggtctcctcgcccacttcaccctctcctgcaatccaacttgtgaggcttgtgtgtgcgcgcgcgtgtccttgcgtgtgtgtgtgtgtgcacgcgtgcgtttagatggaggttggcttcccagccacccaggcttggcccaaagtccgtggtacacacgtgcataactcctacccccacctcgcctgcctgctgtaccaggcgttgattccctcttcctgcgtgttttcggtccaaatccttttctttttctccctcccgtcaagatagtggtttccactccctgctctcgccaggacaccgccttttggactggggctgaattctgccccttgaagctctgctccttggagctgggggccccagcggtaggcggagttgattggagacctgccacccacattccgaccccaagcgacctccgagagggcggggtctcaggctgggttatttagctcgtccacccttcttctccaccagaaggagcgaaacatctttgagcaagatgggtctctaccgcatccgcgtgtccactggggcctcgctctatgccggttccaacaaccaggtgcagctgtggctggtcggccagcacggggaggcggcgctcgggaagcgactgtggcccgcacggggcaaggtgagctccccagagccgggcggggtgggctgcgcccctggctccgagtcagtcaaataccggggaggacatgcgcccccgtcggcctctggccgattctctttgccaagggcccgcgcattgggctcaaagcgcgcggaggccacgggggtggggggctttagggcagtcggtggcacacagtaagcgctcaataaatgttgccgctacccgatctccttggaattgagggcatgctcctgtgcgcccctcattgcacagagctcccttgtctggaaactcagcagtcactggagccgccgtcggtcctctcgctttctctattttaaaaaccgtttcaaccgctagcgctgttggatctctacctttcaggctttatcacctggggtggagtgggtggtgagagggaagggatggggagtcaagacaggagaacgctctcgatttcccgacccacctcccgtcatatctcatgtcacatctaccgggtgttctacccggtcctgttaactttttttcttccgcgaaagcccaaattcccatcactgctctagctctctcccagatccccaaatccggatgtctgtctcagggaacgtcaaagcaacatgcccggatgaggtcctcccctctccccacctcccagccctctcctcctgcctcccccggtgtcacccgcgcctccttcctctcttcacctccctctaaacaagaatccggcgcagtcagttctagaccctgagcatctcccgcgtccctgcccaatatccgtcccgcccccgaccgcccgcgtcctcttgaacctgcggagccctgctccccgcactccacgcccttgctccgagcttccgagaaagcggggcaaagggagccagaaagagagaaaatgcgcacggagcaggtggccccgcgactccatggtgaggggacggggcacggaaggtggaaaggcgcgctccctcctcccttttttcctccctatggtgggcagttggtgacacacagtaaaggctcaataaatgttcccgctactcgatctccttggaattaaggggatgctcctgagcgcccctcattccacacagctctggtgcctggaaactgcggtcgccggagcggtcgtcggtcctcccggtttctctattttaaaagccatttcaaacctccagcggcctcgccacctctgctgcagaccttccaagcccttctgaagccggaatgatttctccctaattcactccccctgcttaacacattcgaacggctcccgcttgttctcgggaccaaatccaaagcccctggcgccaccttcgagagcctccggacctgctgaccccccacacctgggctctgagctccagatccaagatgctgctcgccctcccttccccgccgctctctttctgcgcgcctttcccctgccttccctttctgtcactctccctggctgagccctctccgcctccaggtctccgggaaggttgtccccaggccggtggggcccctgcaggtcctcagcctcgggcggggtggggtggaggggtcgcacagcgggaattgccaccagcgcgtccgggctccacagcgcgctcgtccagggcgcggcagcgctcagcccagcgcttggcacagtcagtgaccacagggaggagaaagtgaaggcaggagcgcaccttcccacctgccgtccccgtcccctcagaaccgagtcctggggccacctgctcggcgcggtccctctctctctggctcagtccccccaccccgatacgtctcctcctctcagaggctccgaggaagggcgtgggcgctggagggagcagggctcagccgggtgcccctcccgccaggccccaccggggctgagcctcttctgtcgcccgcaggagacagaactcaaggtggaagtaccggagtatctggggccgctgctgtttgtgaaactgcgcaaacggcacctccttaaggacgacgcctggttctgcaactggatctctgtgcagggccccggagccggggacgaggtcaggttcccttgttaccgctgggtggagggcaacggcgtcctgagcctgcctgaaggcaccggtaagcgcggggctgagggtgtcaggaggcctctgggctgtgtgagaagctggggggatgcgcgtgtggagaagagggcgcaggatgggggtgctggaacctggagcgccggggtctttgggggtgtcgaaggggcggtggctgcagctggcacaaagtggctggagcctgggggaggggcgtgatgctgaaggggcagaggccacacagaaggacggggtgctgaggctctcctggcagagacaagaagaggcgctcaccaaaagtcactggccaagtcctcctctgtccttctaggccgcactgtgggcgaggaccctcagggcctgttccagaaacaccgggaagaagagctggaagagagaaggaagttgtaccggtgagccctcctcccctgaccccacgtgagctgctgatgcttccagcacccatacttgatttccttcctgccccacaggtggggaaactggaaggacgggttaattctgaatatggctggggccaaactatatgacctccctgtggatgagcgatttctggaagacaagagagttgactttgaggtttcgctggccaaggggtgagagcaaggggaggctgggtgagagggaggtgtcctggtctagtggaagccaaggggcttatgggctgcactgcattggactggcccaggatcggtgcctgtggtcgtcatgttagagcctcagaatgatgctcaaaccctttgccccatcctgccctgaaggctggccgacctcgctatcaaagactctctaaatgttctgacttgctggaaggatctagatgacttcaaccggattttctggtgtggtcagagcaagctggctggtcagtcccccaccccagtatgtctcccaaccccccagatcccacccagatcccacccaacccaggggaattgaaagaagcagggtggggagaccagagacttgggtccctctggtgggctggagtcaagggggcatggttggtggggttggaaggaccaagagctcagatcccacaacttgctcaacaactgccttccccagagcgcgtgcgggactcctggaaggaagatgccttatttgggtaccagtttcttaatggcgccaaccccgtggtgctgaggcgctctgctcaccttcctgctcgcctagtgttccctccaggcatggaggaactgcaggcccagctggagaaggagctggaggtatggacatcagagccctgaggaagctcagcagtgaagtggggtggcctagtgccaatgatgctgctgcgggacccactgtgggcctggcttgctgccagccagcaaggacggattctgcaggagaggtcctgagggaccctggagaagttcagctgctcggcctccttcctacacgagagtagctgcggagggagggcgtgcaaggtggaatggttgatagaaacagggtcaaatgaagaaatgtgactggcccctggtgctagggattcggggagtgtgcagagtaagagagtcaggatcagagtgctgtggctgttcatcaggaggcgatatggaacaacagagaggaaattcatgggattaagggcagataggcttggatgtgaatcctggttctgctatttgtaagctgtgtgacctcaggcaaaatacccaacctctctgattatctgtttcctcttctgtaaaattgaggctcattcaactaggtataaaaattataaggctgagcacagtgactcacacctgtaatcccagcactttgggaggctgcaggaggatcacctgagcccaggagttggagaccagcctaggcaacgtggtgaaaccctgtctctacaaaagtacaaaaattatcacctgtaatctttggtgtagtggcatgcacctgtagtcccagctacttgggaggctgaggtgggaggatcacctgggcccaaggaagtcaaggctgcagtgagccgtggtgatcctgccacgcactccagcctgggcagcacggtaagaccctgattaaaaaaaaaaatgatatgaggaagtaagcacatgatccattacctggtataaagtagatgatggagacgagttagctccactctcttcccccttggaggaatccgagtaggaagaagatgctttatgttgatagcagcccttgacctcttcccccacccagggaggcacactgttcgaagctgacttctccctgctggatgggatcaaggccaacgtcattctctgtagccagcagcacctggctgcccctctagtcatgctgaaattgcagcctgatgggaaactcttgcccatggtcatccaggtgagaggactcaggatttctgctcccagtctctggcttttgagaaagctcagccccttatcaaaatttactgagcaccatctgcaaaggcactgggctaaggcacctgggagacgcgaaaggaggaaatgcgccaagtctctattcgaaggccttgcagtgtagctggagagacagactgggccagtctgcagaagctccaggactgaggaagtccctgaggacagagacagcccaggagggattggggaggtggggtgtcacgagctttggaggagggccaggtctcagacaagcaggagggagaggaaggaccggtcctcaggggcaagacagactgggcagaggctgaggtagaggagtcaggcaattcctaggggacagttggaccagaagccagactaagccaggctaaggagtatgaggtgggaagctggagaaggccgtgatgaaatgtgctgtgggcacgcggtgtgggcagtggtgtttagggtgggttggagaggggagatgctagaaatagggactggggcaacatgccccagcactgaccccaggaggaggggagctcggatgtgggtagtgaccatcaggatggagaggacaggtggatgcgagtgcagagggagatcaaggagaggggaaaggggagccaggccagttgcctgcagaaatagcaccgataaagagaacagggtgcccaggtggatttttgtctggccaatgttgaggtaacgggaagacacttaaattatccagcaggcagctgagaacaagagattcagtcatttgtgtagaggtggggccaaaagatgagttttcaaaaaacagtgtgggatggaggaagcaggtggtttgaatcttgtccacactgtgggaactgaaaggggaagtggaggctggaggaggcaccagaagagcagtttctgcagaatgctggaggcaaagcagcttgcagggtgctaatgcactgagcgggcaggaaggggaggggaggaaacgggagccgtagggagcggcaggagtgagatggggaaagcagaacaggtttggaggacgaagggtgaggttaacatgcaaggggggcgggaatcgctgagtgcctggcactcatgccttctctccccacacttgtccctgctccagctccagctgccccgcacaggatccccaccacctccccttttcttgcctacggatcccccaatggcctggcttctggccaaatgctgggtgcgcagctctgacttccagctccatgagctgcagtctcatcttctgaggggacacttgatggctgaggtcattgttgtggccaccatgaggtgcctgccgtcgatacatcctatcttcaaggtaactccttatccccttctctcttgcctgccactatctctgccccagggcacgttccgacctctggaggctccctctctgtggggtctcggggtacagagagaaacaatgaatggacaatgtgagagcaacagagaatgagcagggctggccatgcattttcaaaggggatagcacctcccacctgggaaagtggcgaaaataatcttactctttttatatgtaaagcacagtacatgcaaatgaccaaggattccatccaacaagaggaacccgtgaaataacgttaaaaagatcttttccagacattgattttttttttttttttgagatggagtctccctttgcccagactggagtgcagtgatgcgatctcggctcactgcaacctctgcctcctgggtttaagcaattctcccacttcagcctccccagtagctgggattacagtcgcgcaccaccaggcctggctaattttttttgtatttttaatagaaacaggatttcaccatgttggccaggctggtctcgaatgcctgacctcagatgatctgcttgtctaggtctcccaaagtgctgggattacaggcgtgagtcactgtgcctggtccaagtttgtcttctttaaagaactgaaagaagcctagtgtaatggatgaaggagagagggaggagaccaggctctggagggaggcagtggttagaacatccattctcagtgggggcacaatgtcccccaagggatgaagatggttggaaaatgtgtgtgaaaaatattattattattattattattattattgctgcccaggctggagtgcagtgtcacgatcttggctcactgcaacctctgcctcctgggttcaagcaattctcctgcttcagcctcccgagtagctgggattcaggtgcctgccaccatgcctggctaatttttgtatttttagtagagatgaggttttgccatgttggtcaggctggtctgaaactcctgacctcaggtgatccgcccacctcggcctcccaaagtgttgggattacaggcgtgagccaccgtggccggccaaatcttattactttatatagcacagatataatgtgatatatatctatataaagcacagatataatgcaatacatagacagatatacagtatatatgtagcattaatatttaatgaggtggagtgagattaggaaaaaacatctcaaaagggtacttagtgggtgattaaaaaaaaaaaagttgagaaatcttggtctagacctatgaaaaaatatgaaaagaaaaggaggccaggcacggtggttcacgcctgtaatcccagctactcgggaggctgaggcaggagaatcgcgtgaacccagaagacggaggttgcagtgagccgagatcacaccactgtacttcagcctgggaaacagagcaagactccatctcaaaacaaaacaacaacaacaaagaatgatttctttcaattatcataaagcactaagtctggtttgtggaatggaaatagttgatgcaaatcaactgaaagctcagtggttttatttttatgtatttatttttaactttaattttaggttcaaggatacatgggcaggtttgttctgtaagtaaattgtgtgtcatggggcttggtgtacagattattttgtcaccaggtaataagcatggtaccccataggtagtttttggatcccctcactccttccaccctctgtccacaagtagatgctggtgtctgttgttcccttatttgtgtccatgtgtactcaatgtttagctctcacttataagtgagaacataccatatttggctttctgttcctgtgttagtccacttaggattatggcctccagctccatccatgttgctgcagagaacatgatcttgttcttcttcatggctgcatagtattccacagcatatgtctaccacattttctttacctggtctattgttgatgggcatttaggttgattccatatctttg

SEQ ID NO: 788 - DNA, 103947 bp, Human
tttctcactgggtttttcccacaagaatgtcactctcccatcagactagaaaataccatgaggaaaggggctgtgtctgatggagctccaagtgtaagtgctgcatttcctccattagactgggggctcactgtgggatatacctgcctcctccatcagactgaaagctccctgagagggggacctctgtctgccccctaatactgggagctagctgttttcagggcccatttacctcccttcagactggggcaagctccctgagggtggggctgtatttccccctcaatctgtgggttccatgacagcaggacaatatccaccccgcccttcaccatgatcttcaactttcatgatgtcttcttcctctcctcttgccagaccttattcaacaagtcttgtctccacaggcccctctgctgggagcgcatacacaaaagtgaggctccttgaaagggggactctgtctgtgcagtgcttctgtaagggctacaaaaaccgcatggagggcaaggtttggtgcaaaatcaggaagaagtgtgagcctggtttcacccaagtctgggtgaaagggccccgctacttgctgcaggacgatgcccaggccaaggtggtcaacatcaccatggtggccctcaagctccaggactcaggccgatactggtgcatgcgcaacacctctgggatcctgtaccccttgatgggcttccagctggatgtgtctccaggtgagcgggctgcaggggcactgggacgggtggagggagtcctccctgccccacactccactaacatcagagataataaggataataatccatcaatggtcatgttgcactgtagtgttttcaaagtgcctttatggcactattcgtggcactattgtcaccattttacagatgaagataatgagacctgaaaacccagtgtgactctgagcttgtccggggtcccagagctagcaggtggctgagataaagttcaaacttggcactgtctgtgctgtgttttattcactcattgcttcaacataattcactgagcccgtattatgtggcaggcactattctaggctctaaggagacagtagtgagcaaaaacagacacaatcttgctctataataattgcaaataacaaatttttgtaagaaaaaacaacacttgtaaacaggaaagttaactcagtaatgcgggagctgtggaaatactgaggatcagaaaacacctccctgagcagatgacaccaagcagacccctgaatggtgagcattctccagctctgttgaaatctgggtgctttgaagggcactttgtggcaagggctgcatgtgcaaaggtcctgaggtcagaaggtgcttggcttgtacaagaaagacttatttggctaggtgcaatggctcacgcctgtaatcccagcattttgggaggctgaggcaggtggatcacctgaggtccgaagtttgagaccagcctggccaacatggttgaaaccctgtctctactaaaaatacaaaaattagctgagtgtggtggcatgtacttgtaatcccagatacttgggaggctgatgcaggagaattgcttgaacctgggaggcagaggttgcagtgagccaagattgcaccattgcactccaacctgggcagcagagtgagaccctgtctcaaaaaaaaataaaaagcaaagaaaaaaatgcttatttagtaactccatattgagtgcaggacagtgattgatgaggctgggagtcaagcagccctgaagcctatgagatgaagtttgggtgattctaagtacaagaggaagctactggagagctaagagaggtgtgtcacagcttatttttaagtatgtagtggccacttgtcgaggatggtctagggagggtatgagcatgggcatggaggccattgtgagcacagtggacagagttgcttcccagcctggagggcgaggcaacctctgtaaaacaccagtactagccctcccaacatttacaggtggaaagctggtgcgggaaaatatcagccaatacatgtgccatagtaggggacagtcccaggacagcggcctgggaccctcgatacttcatccaagatgatcgcttctatggcgtcttcaccgtcaccatgactgagctcagagtagaggccttgggattccatgggtgtggaatctctaaatcccctgagatctctattgtcagaatcatctgcctggtggtatctcaaggtgagttctgtcccttcgtatttgtgggtctcagacttcctgaatcacaaggtgttagagctggagaggatcctagaaatcttctccttccaccttctcatcactgaaaactggggacatggagaagaaaagcccctggcctaaggtcacctgctgctgaagggcagagccagccccagaatgcaggcctgctggcttttggttcttccttccacatcgtacgtatcgcccttaacatttttgctgctactaacaggactcctccatttatttggaatgagtttaaagtttccccatgcttgagcacaaagggcttaatggtccattccagacatccctacccttgactctaactgccagcatcttctcaaagggctgtagtcaagaaagatcactgagtaatggggtggggggataaatgtgacataggagatagccaaacaatgaggctgacatgagacttagggggtgaggctgggaggtgtagtagccaggggctcaggggacctggatcctctccctggacctgcccttatcagttgagagtcattaagcttcaaaatgagaagctaggggtcaccactaatcctaaggcccctgggcattccccctgaaattagagttgccaagctctcctgcctttttctgtgatggttagaaacagtggtgctttttccctgctgctgagtgtgcccagccacttggtcaaatgggcatctggaggaccccaataagcttctctttcttcactgcccaagctttggctcactgcccattccctggagggcacagggctaagctaggccctggatggggactcaaaagccttgagatcccatccggagctggaggagcccacagttgggccagagaaacagcatgtgatgaagggttatgacgtaaggtggtaggtggcattagagaaatatggtggacggaagaataatgaaagacagaaaggagggagaaggtttaaattcctagcaccaggggaattctaagcttgaggaaaacaaggtgcatatggaatacattaataaaagataacttataaggcaatatgccacaggcataggtgaatgcaaggtagaatgaatgatataaagtaaaataatcaaggatttattcttgaagttggggacatatggattggtgaagaatagcaggcaagtgcagttccaataaagtgaatagcctgaatatttcttttttcttccttctttctgcctttcctccctccctcctttcctcctttccttcttcctgactctaacctaggctgatcacacagtattcttaggttatagcaaaagaaaaccctgcttcttggccatgtccatttccttccttagctccatttaccctaacacctacccattcacccactcatccatcttttcatctacttattcttcctacatcctgtccattcctccactcatccatctatttatccacctacccatccactcacttccaaatagtttatccgttaaatcacccacttatccatccatccattcatccaatgttcttttcacaggtctcttaggtacccctgcctccaatgttaatcctacccagaacatgcctcagattcccacagttcttcctaccaccactaaggccctgagcccactgtatgccagcccaagaaccatgacccagccttcacccaagtcaactgctgatgtctccactcctggcccacagtcaacaataaaaatgtgacaaatgtcatcaactatgatttcccagcctctgagccccgggtttggacatcaagctctttgttccccagttcgtgtgctgagaggatgtgggagtgagggaaaggggaaggtggggcaggagcagacttgagtcacattagtctgggtagaaatgtccaggggaagaaggaggtggtgatggagaataggggaggctctcagccaggctgtcattctccctagttcaccttccttgttttcttgcaacctgagtattaaggagagggaaatggcatcctccccaaattccaatggagctcatccaaccccaggggcctgatgagtagtgggaacgcactctgaatgagggaccctggatctagtatctacctgactaactgactgtgactttgggtgagtcaggaaccctctctggctttagcttccttgtcaattcagtaggcatgctagaaacccagagctggaagacattgttcacccaacagctctcagcaggagccacatgttagggctaaatgcaatattggtttttgccttgtttggttagttttaaaaaaaaaatactgatgtgtgtgttctcatacacagaccaatagaatcagaatttctggaaatgaagcccatctcagtatttttttataaatacttcagaaagaaactcagagaggaaaggacaaacaggctgaggaatgagaaagaataaaactctttcttttgaaataaaaaaaaaatttatgcgatttttttccctttaagaggaaaatctgctttaattaaatggaaacaatgatccaagctacttaagtataaaagcacattgtactataaaatgtttaatctgtattaataagaagctaaatttataacaaggagctgaatgctttttagttgactatgttgaggcaaaagtctataaaacagcatttcctacaatggtggaatgttctctctccctgtccaacatgggtagccactagccatgcgtggtaattgagcatctgacctgagacaaatgagagtgaaggactgaatttctatttatcatttaatttttgttaatttaaatgtaaatagccaccttgacaaaattttgggagtgttttaaggcaagattaggacttattgagaagtttgatttaaggtaggtctttcaaagcaggggctgggctatgattaagtaaggatcacgatcaaacagtcctggattggtagaaacaataggatgaggattttgaagtgggggattcaaagaatcttatgttgccaactacctcttagggctttccatgaaagagttgatgaatctttcaggaatttcctataatgaacaagcaaaccattttcccagacaagaaaactcctggtaaagtagtattcacaaagacagaggaatagcaaagtcatgttaatgtagacagcaaggtgtgatttcagttctcagtgtcaagactgaatgtgggtatggatggtttctattcccaataaaaaaattatttttctaacaaaatatactgtggacaaaagcaacataggggaacagctccatgatattgtcttgacaaccttgcatatgccacataggtcacactggcagacacatgaactacagctaatttgaagcatggcagaatgcctgcaaccctcctagaacataaaaggatggaggcttgtgagaaccatggcccagtaacttctctgtctcccctgaaagacagttcctcatgccctcctgagttctgatgaggccagaggctctgtcccagacctcagaatagggctgcaggttatgaaaccacttatctgcctctagagtagattcctcagcagtggaatgtcccacaactcatattgcagttgtctggccccttttgttttggggtgtgggacaagagccatgaggagctggcacctttgcctaatctttcccttgttgtctgtgtaaataataaattgactgaaagtaaaagtggctcattgctgacattgtgccactgcactccagcctggcaacagagcaagactccttgaaaaaaaaaaaaagcggctaattgcattattagcagtcaaatcagtcaggacttggctttggcgcagccttgtctcacatgagcttaacaagtgacaaatgacagactgagacaagatatttgcaatttctaacatagaataatatctagttttttttccaagatggctgcctggaagcattttaatcacacctcatccacttagaagaaccaaatagtgtgtagacaatcacactttgaatacattatccaagagggaacttgagagttcaacagaaaagcaaaagaaaagtccaaaatcaaggaaatagaaagaaaacaggaagcttgtgtagttgggaccagctgggaaccagaacagaccctcccaaatgggagagagtgagtgagagtctttctgtgatccactttcccactggggaatcatacaatccaggacatgggagtgcaacttgactctccaatccctgaatctaacttacagagcagctgggagactgtgagaagaaacttccccatggaggtagcatgccctgggtttcacacccttcctgagacctaagaaactgccattcttgatccttgctcttaaaaaattgtgtgtggtcctaggaaccagtgatggcagtcttaggcattaaggaaactcaggctgcaacttgcagaaccagggcttcagtgaggaataggttcccacaaccaggactaagaagtaagcatagtgtggacttcagcttcaatgctggaacagggtacacctcctccccaaaacctgagcaggatgagatttgcctcagtgacttggttgagctgggcaggggttcctatagcccagggctaagttacaggccaggtgcaaactgcctggcctgactgaacactgggtttactatgacagccaggatatgggagggagccccaccacgacgggggcataagaggaatgcaaatcctcaaccagttgccaaatctgtggctactgggaccacccccacactccctgtagcaggacctcagtgcaacaatgcttgcccctcactgaagcattttgccaggggcctgagtactgctccatccccctgtagcagctggtgcatgcactcgccattggagggtctgagtatcagctttcctggccaagttgtgcccagcttcatcctacctcccaccccgagacagagtgcagaatctaagctccgaggggtttcacaacccaatccaccacctgggacacccacacacttccccctatgcaggacagaagtcaggcaaaaacaccctaccactcccacctcagctggcttctaccttcaagctccacctactgacctgaaggccggtccacacagcccattgcaaccactgccaacacaaaaacacagcactcaggaccaagaagaagaactcgccactactgctattgccatcacccatgccactttggctgtccaggagttgagagcccactcacctgccaagtacaccactactgcaactgaccttagaaaaagccaccccagatgcccaagaatcagcctgcctgggcccatcaatacaagtgccagtgtacgctgccctaggtcacaagaatagacatgcttagcccaccactgctactactgaaacctaaaggcccatctggcatttcagtccccagcacaacttcaccatagtctccaccaataactacatccaaacacaccaaggaaaccacagatactaccaacactatttatagccaaataactcatacagagtcttcaccactgcacacatccagaagcaaagcttaagggtactaccaaaacaagattatagtcacatcttcaagaaaaaagcctccccctcccctcatgagagtaaattcaaacacagaagaaatgactattacaccagatgtgcagaaattaatgtaaagaaatgtggcaggccaattctccctgacaatcacatagacagacctgcatagcactccagttacacagacagatttccacagcactgccttaacattgagcaaatagttaaacctaaggaaatcagtgcccagacatcaaagctaggaatgaaacatatggtcagtaggaccttacctgggcttctccttaacctggagcaagccaaatagtagaggcagtcttacattcctagtgccagggcccaacttgggttgacaaaatctgagatgacccgaggtaacaggggcagctgtttgaatagattcattgcagagtctaaagaaaatctctggaccaaactataaaggagataagatagaaataatcactccggtaccgcagtagacaggccttgaaggtactggggctctcaaagcttaatcggacttaacaagccttttttttttttttttttttgcctccgaccttctagttgaaacaaaattagttaccaatagacaggtgaatgctatactgcacataggcacataacccaacctacgtaagcactaagaaaattgtaaaatgtttagttggtctggtggaattatctctggccttctccctgtatccagttacagcaataaattcccttctttcctagtttgcctgcttctcattattgggccttgagaaaaagcagctggacctggcctggttccaggaacagaaacaggaaacattaaaaagcaaggtaatatgacaccctgaaaggaacacaataattcttcagcaataaatcctaaccaaaaagaaatccttcaaatctcagataaagaattcaaaatattgattttgattcagagacaagatgaaggataggagacagggcgaatgtgcagctcccacttggacagacagaacagtgtgtggagactcacaccatgatcttttgctccaagaaccactgcagaaacatatcaggaaaaccaaaagaatccacagattctttgaaagaagcagcatgccactgcaaattccatgagacaggcaaaaaaaactgtgagttcacaaagtgtgagggggggaaaacctgcctccaaacacacatttcaccagggaatctgaaaatccatatcatgagagaaggatttaaccttacctggagctaaaatggatttaggaagttgcatgacacataaaactagaagaagcagtgggaagtgccttccctgcagacactcccagtctccagctcaagcccagggaagccacccctgactatatctcacacaggccctcagggaaggcatccagcagaattagggaggggtcacagggtgaaagaagctcccaactgaaattagtagtaatttcaactgggcacaaattttcttgagcagaatccaggggatgaatgggaactgctgcagatatgagcacaggagctgctgccaacagtgtgggcagatggggagggttgaagcctgaaagccatgcttgctttctcagtggggaagctcatggcttggggcaagttctgaatggagcactgagggggcaagactggccttgccaactgcatgagagctggatgaggcctctcgctaccagctatcccccacttccctgatgaactataagacacagcagaagcagtcaaaatcccctctggaacataataccattggcctgagaatcaccccaccatccttcacagtggctatggcaagctctgcccaaggagagtctgaacccagacccacttaactctgccacccacctgatggtatttctctatgttctctggtagctgactaaaaagaaactcttgggagctttatggccccacccaacacctgagaaactaaaatacttatcttgtccaactcaggacatacttggatccccctactattaccacagatggtgctctcttgaaaacccaacctcttgtttggaggccaaccaacacaagccatcacagcaactcatgacagaacaatcctgatcccaagaaagagaagacaacagcaattccactgcttgcaatatcctggctggccaaaggtcctgagtgtgtccacgtgatatggttttgctgtgtccccacccaaatctcatcttgaattgtagctctcataattcccatgtctcatgggagggactcagtggcaggtaattgaattatggtggcaggtctttcccgtgctgttctcatgatagtgaataactctcatgagatctgatggttttataagggggagtttccctgcgcaagttctctctctttgcctgccaccacccatgtaagacatgacttgctcctcctttccttccaccatgattgtgacccctcctcagccacatggaactgtgaatccattaaacctctttttcttcccagtctcaggtatatctttatcagcagtatgaaaatgcactaatacaccacatgataacttcactgccagcataaccagcatttgacaaagccagcacactaaacatatctacaaccaaagactctcacagagtgtacttcactcccctttcaccagagcagctgttgggagacctgaagatgggtcacatcacaggactctttgcagacattctccagcaccaacccagagcctggtagtcccactggatggccacaaccagaagagcaataacaatcactgcagtctggttctaaggaagtctcatccttaggggaagggagagagtgccacaccaagggatcaccctttgaaacaagagaatctgaacagctgaacagcaggccttgagttccagatctttccattgaaatagtctacccaaatgagaaggaaccagaaaaacaattctagtaatatgataaaacagggttctataacatccccaaaagatcacaccagctacccagcaatggatccaaatcaagaagaaatctctgaattgccagataaagagttcagaaggttgattattaagctcctaagggagataacacggaaaggtgaaaaacaacttaaataatctttttttaaaatacagaatatggatgaaaaattctccagagaaatagttatcataaagtaaaaacaatcacaacttctggaaatgacatacacacttagagaaatacaaaatgcaatggaaaatttcaacaatagactagaacaagtagaagaaagaacttcagagcttgaagacaaggcttttgaattaatgcagataaagacatagaaaaatgaatttttaaaaaaagaacaaatcctccaataaatttgggattaagttaaatagccaaacctaagaataatttctgttcctgaggaaaaagagaaatctaaaagttgggaaaacttacttgaggcattaattgaggaaaatttccctggccttgctagagatctagacatccaaatacaagaagctcaaaagacacctgggaaattcatctccaaaagatcatcacctaggcacatagtcatcggattatctaaagtcaagatgaaggaagaatcttaagagctgtaagacaaaagcatcaggtaacctataaaggaaaacccatcagattaatagcagatttctcagcagaaaccttacaagccagaagaggttggggtttgatctttagcatcctgaaacaaaataattatcagtgaaaaattttgtattcagcaaaactagcttcataaatgaaggagagataaagcctttttcagacaaacaaatgctgagagaatttgccactattaagcagcactacaagaactgccaaaaggagttctaagtcttgaaacaaaacctcaaaatacaccaatgttacatacactgcaggtttatagcagcacaattcacaattgcaaaaatatggaaccagcctaattgcccatcaaccaacaaatggataaagaaaatgtggtatatatacacaatggaatactattcagccataaaaaggaatgaaataaggtcatttgcagactcacctggatgaattcggagaccattattctaactgaagtaactcaggaatggaaaaccaaatgttgtatattctcacttataagttggagctaagctatgaggacacaaagacataaggatgatataatggactttgggggctcagggggaaggatgaaagggtgtgaaggataaaagactatacattggatacagtatacactgctcagatgacaggtgcaccaaaatctcagaaattaccactaaagaacgtatccatgtaaccaaaaatcacctgttcccccaaaactactgaaatttaatttaaatttaaaacacgaaacaaaatattgattttaaggaaactcaagatgcaagagatgcaaaagaaatcaaaataaatgcaaagcactcagaaaattaattcaggatatgaatgagaaatttaccaaagcataaatatctaccttaaaaaaaaccagaaactctaaaactaaaaaattcattgaaaggaatacaaaatacattcaaaatcttcaataatagactatgccaggcagaagaaagaatttctgaacttgaaggcaggtattttgaaataatccagtcagacacaaataaagaaacaaaatgaataaagcctttgagacatttgggactacataaggtgacaaaacttacaaattatcagtattcccagggatgaagagagatccaaaagcttaataaaactatctaatgaaataatagatgaaaacttttcaagtctagcaaaagatttagacatctatttagaggaggctcaacaatccccaggcaaatacaatgtaaaaagtttgccacagcatattaaaagcaaactgtctaaagtcaaagtgaaagaaaaaaatctaaaatcagtaagagaaaagatgtctaaccatttatagaagaacccccatcagtctaacagtggacttctcagcagaaaccttcctggccagaagaaaatgggatgacatactcaaagtgctgatagaaatttttaaaaaactggtagccaagaattctacatacagctagattaagctttgtaaatgaaggagaaataaagtctttcccatccaagcaaatgctgagggacttcatcaccaccagagcagtcctacatgaaatactcaaaggagtcctaaacttggaagtgaaaagctgatattaaccatcatgaaaacacatgaaagtataaaactcactagtaaagcaattacacaaagaaggtagagaaaagaatcaaatgacactactgcaaaatttcaccaaaccacaaagacaaacaatgagagaaaaagaaaaaaacaaagacttgatagaacaactagaaaataattagcaatatgagagaaacaaaaccccacatatcaatattaactttaaatgtaaatgcattaaatgctccacttaaatgatatagattggctgaattaatttttttaaacatgattcgactatatgctgcttacaagaaactcacattatctataaagacatatacagactgaaagcaaagtgtggaaaaagatattccatgcaaatggaaaccaaaagtgatcaggagtagctatacttatgtagtataaaacagactttaaatgaaaaacaacataaaaagacaaataaggttattatatactgataaaaggattgattcagcaagaggataaaacaattctgaatatatatgtacccaacactggagcacctagattcataaaacaaataatattagacctaaagagatagacagcaatacaataataatgaaggccttcaacaccccactcacggtattaaacagtttatctacaaaatgatctaaaatcaacaaagaaacattggacataattggacgttagaacaaatcaacagacatctagagaacattctacccaacaattgcagaatatacattctttcagcagcccttggaaacttctccaagatagaccatatagtaggctacaaaataagtctcaacaaatttttaaaaatagaaatcatatgaaatatcttctatgatcatcaaaatttattccacatcacagtggaataagttttttaaaatagaaattatataaagtatcttctaggattgcagtggaataaaactagaaatcaataccaagaagaactttggaaactatacaaatacatggaaattaacacactcccaaaaaaaatcactggaccaatgaagaaattaagttagaaatttaaaaacttttagaaacaagtgaaacctgttaggtttctacctaacagagatcttgccattgcactccagcctgggcaaaaagagcgaaactccatctcaggaaaaaaaaaaaaaaaaaaaaaaaaagaataaaagaaaaaataagaaaagctcaggaccggatagattcatagctgaattctactaatcctcctcaaaaagacatcttccaaaaaaatcaatgaggagagaattcttcataactcattctacaaggccaatagatccctgataccaaaaccagaaaaggacacaacaaagaaaagaagtctacatactaatattcctgataaacatagacacaaaatttctcaacaaaacactagcaaacaaaaaccaacagtacatcaaaaaaaagtacacgatgattaaatgtgttttatactaggaatgcaaggatggttccacaatgcaaagcaataaatgtgatatagcacataaacagaattaaggacaaaaaatgtattatcatctcaatagacacagaaaaagcattcaaaaattcagcatcccttcacaattaaaaaccctcaacaaactaggcatcaaaggaacatacctcaaaataacaagagccatatatgacaaactcacagccaacagactgaatggggaaaagttgaaagcatttcctctaagacctggaacaagacaaggatgcctactttcaccagtcctgttcaacatagtactggaagtcctgaccagagcaattgggtaagataaagaaataaaagacatccaaattggaaaggagggagtcaaattactactcttagctgatcacatgatcttatatctggaaaagcctaaagacttcaccacaaaactctcagatttgataaatgagtttagtaaagttgcaggatgcaaaataaatgtacaaaaatcagtagtgtttctatacaccaataatgatatagctgagaataaaataaagaaggcaatcccatatacaatagtttcaaacaaatttaaatatgtaggaatagatttaaccaaggaggtgaaagatctacaaaacactgatgaaagaaattatagataacaaaaacaaatggaaaaacatttcatgctcatggatcaaaaaaattagtatcattacaatgaccatacttcagttaataggattactattaaaaataaaaataaataggctgggcgtggtggctcatgcctttaatcccagtacttttggagaccgaggtgggtggatcacctgaggtcatgaatttgagaccagcctgaccgatatggtgaaaccctgtctctactaaaaatacaaaaattagccaggcatggtggcgtgtgcctgtaatcccagctacttgggaggctgagacaggggaattgcttgaacctgggaggcagaggttgcagtgagctgagatcacgccactgcactccaatctgggtgacagagtgagactccatctctaaataaataaataaatatatatatatatataaataaataaataaataaaatgaccatactgcccaaagcagtctacagattcaatgcaatccttatcaaaatatcaatattatttttcacagaattagaaaaacataatcctaaaattcacatggaaaccaaaaagaacccaaatagccaaaacaattctaagcaaaaagaacaaagctggaggcatggtgttacctgacttccaattatattacaacactaatataacaatagtaaccaaaacagtttggcactggtataaaaatagacatgtagatcagtggaacagaatagagaacttggaaataaagccacttatttgtggccaattcatttttgacaaagttgacatgaacatacattggggaaaggacacccttctaaataaatggtgctgggaaaattgaatgtccctatgcaaaagaatgaaactggtcccccatctttcaccatatacaaaaataactcaagatggattaaaaacttaaacataagacctaacattataaaaataacagaagaaaacctagggaaaactcttctggacattagtttaggcaaagaatttatgactaagacctcaaaaacagagacaacaaaaacaaaaatagacaaatgagacttaaaagcttctgcacagaaaaaaaaaagatgaacaacactttagaatgggagaaaatatgtgcaaactgtacctccaacaagggactaatatcaagaatatacaaggaactcaagcaattcaacaaccaaaaaaacccattaaacccaaataatctcattaaaatgtgggcaaaggacatcaacagacattttataccaatcagaatggccattgttaaaaagtcaaaaaagaacagatgttggcaaggatgcagataaaatggaactcttatacaccgcaggtgggaatgtaagttagaacagctactaacaaaaaataaatttctcaaagaattaaaaatagaactatcatttgatccagcaatcccaactgtatacctaacaaaagaaaaataaatcaatatatcaaaaggatacctgcacttgtgtgtttatctgcactcttcacaatagcaaagatatggaatcaaccaaagtgtccatcaacagatggctggataaataaagtatgatatatatacacaatggaatactattcagccataaaaataatgaaatcatgtcttttgcagcaacatggatggaactggaagccattagcttaagtggaacaagtcagacacagaaagacaaatagtgcatactttcactcataagctgaagctaaaatatttgtacacatgaacatagagagtagaataatagacaatagagactcagaagagtgaggggatgggggtggggtggatgatgataaattgcttaatggtataatgtacatcattcaggtgatggataccctaaaaacccttacttggacactttgcaattcgtgcatgtaatgaaattgcatttgtatcctgtgaatttatacaaataatttcaacatctaaactaaccaagggctgattaaaaatcaacaagcggaaggaaggaagccaaatagaaaatggttagaaataggttatacattgcagtaaaaaactatatgcccaagaaactcataaacagatgtttgatcgtgttagttagagaaatactaattttaaaacatggaactgtcactttgaactcatctgaatggtgagcacatggaaggtggatgacactaggagttggtgagagtggaggaaagggggatccttgagccctgctggggggaatgcaacatgacccaacattctggagaacaatctggagcctctgtggcataaatatgtggctatcccatgctcaatgttccatccctgacttatgctctgttatgcatactattttttacgtcctgtttagaaaatatttgacttctccaaggtcattttttctacattttcttccagaaactatattgttttcaccttttatatttaggtctatgatgcattttcaattaatttcatgtgcagtgtgaaagagttaaaaacctattttgttttctgggtgggtatccaactgatcattaccctttgatagaaacaacatcttttccacactaaattgcagaggccctttagtggcagtcaagtgactgtctatgtgtgggtatgttcctaaaccctctattttgttcctattttctatttggcttaatgccaacttaacatgtagtttaaaaaattcttatatggctccttcaagagcatgaatggaagtgtttattttgaggtattttgtttgcttgtttttctgtttgtatgcttgtgttgttttgtggtagtaaagagttgaagcaacttaggttcccatcactagggggaacagaaaaatgaaatccaatactgcccctacattatatgaaatcctacctagcagccaaaaattgaagatttagatttacatatagcaacaacggatagtctcagaagcacaatgctatctgaaaacatataactagagttataattttcaaaaaaaaagcttaaaccatgagacaaaaataaacacatgctaaaaattttatttaactcataatacataatttatttgagaagatgttataccagtttaaaaatggaagtcaaaaggcacaaatgtatatgaagtaaaggaatattgaaatgaattgtacgtggaagcatatcagtttggggtttgcttttccctctcagcaggggaaggaagacagggcagagtttgcttgtctatcaataacctgcctttgtgaaagttagacttctctcacaaaatgattaccagataacataaagaagagagtgcaatagataatgcagaagtttcagtttaattgcagatttttttctacaacagagtgaaatgtgtaaaaaacaaaagcacacaaaatcaattctatatattttcaagaatctacatgcatgcaaatagacatggaaaatatgaaatatgattattaagaagatgcctatgagggaagggtaggcagtgcagctcaggatgaaggtagtaaagattaaaaaaaacacacacattaagctaggagtggtagttcatggctataatcttagcactttgggaggccaaggagggaggatcacttgagcccaggagttcaagaccagcctgggtaacatagcaagactccatctctatacataaaaatacacattaaaaaaacacatgaaaccaaatgagtggtaaagtgtttcctttaaagtgggccatgaaataaggagtctgtcaactcagtttggttacatgaagatcttttgtgaaaaaaataagacaaaagctaaagctaaaacaaaaacacagcatgtttgcatttttgtttgcttacagttgaccttgccatctttcagggcgtaggttttcctttataacatgaatgcaaggattgagttccagcctgggagaagaactgacttatccgaaagtgcccagtgtgcagtggtgggagaggatgggattccacatccagccttctgatgccaaatgtcatgctcttttccctgcaaattcaagcgggggaaatgattgggtcagggagcccatacaggagataggcaaggacgtttcacttggcatcctttatggtccctctgcaacatcagaaattcccttagacaagaacaatctgtacgggatgctgcttctctggctagattagcctcaagttttctccagttcctggagagaaggaatacgaagctgctatcaaaatggcactgcctgttatttatggttcaatgaagataattatgtttaagcgtatccttattaaacttgatacagttctcatttaacagtatgcgctcagtctttctcaaccatttctcttgtcttttttaagacttaaattaaagaactgggcagaactccaatgatggattcataccagaaggaccaagccatccactggtgcctgaattgggccaactttgctacatgtgaaatataggcctttatttccctgaactcaataaagatcaacaaacccaaaaggttggagccactgaatgtcacagaggggaagccccactgccaggggtttactgaggcctagaaaagggtgaggcacttccccaaggtcactaagtatgatcaaggcagagagggaccaagaatccacaatcttctattgccctgtgatggctgcccttacctttgcaaaggactgaagttttagtatttatgtaacaaagaggcaataagaccaaattaataaaatgctcctgagtcaggagcagtgggtgatggacctgcttgaccaattgcatcattgatttgtaatcagcctgtcagtgaccgggtatccttggatgtttctcaagaaccgggaagttattttattctattacatgggttcagtagattccaaccatcctgcccatggctctgtccctttgcttggtcaactgtttatttgcagatgctatgaagtctgacttcagccccagcctgtcctgatattcacatattcagattagcatatattcaaatagcagaagagcaatgtcctctgctaattaatggaggcctctcaaattcactagcttgaaaagagttttatagaaaaacttgaggcaaaagcactgagctccaccatcccagttccacctccccatgtaggcaggaaggcttgctaacaaaggaggagggggaattggcagtgtttccaccaatgagaagcaaccgaaggtcaccaaaatgtccttcattttcctccctaataactgtgcctcatctactgctattgaaattcctgagaagaggaacagcttttcattgaccaaacggggcccatttcattgattcaccaggtatgatgaaatcagatgggttcctgtaagtcccagctgcaccacttatctgcagaatgacatagtgaataacttaatctctttgagtcttctcttctgcagtgaagacagcagcacttatttcagagtaaagagattaacaaggtacatgcttggctcatagcacatgttcaattaaccagtttctctagcggccctctgccacagggtaagataattttttatattacctagtccaacatccttgtcttacaggtgagaaaacagaggcccagagagaagctattgactttctcaaaaaagtcacaaagcaagagaatggaagacccaggtcccctggtttcaggcctgcaacttttcccattgctctgtgctgccctccaaacagcccctcatgaatgggcagatggggtccagctcattggctgtgcctaaggagacccttccatgacctgaatcctgcagctgctcacctttgcaccaataccagccaaatccgatggtgcaggacaaaggggacctgaggagacaggtgggtcatgcactaatacgcctcaagtcctgcctccagagccctatcaccacgaccctgattatagcttccgtgggataatcctccagcaggtacctcccagcccaggcccagtttaggtctttgtttctagtctccatgagcaccagagtctctgggggaccctggctccaaccccactgccaggccttcaggctggaggcatatttcatgatgttgtaagaacaggccatggtcagattctgtccttctagcaggcacatttgctcctccatgtcacctacagcttggaatctgggaatgacaagtcaagcacttcactgagcaaacatgatttcttctctcacctctgcatccccaacctcagaccacaacacagacacagcgccacagacaaagagtattcctagctcctctgtcaagcatgtaggagtgattaagtatttctgtgattatttttaaatagttctgcaatcatatatgtgtctgtttgcacatatatatgatattatataatatatatatatcttagcaagattcctacccatatggagcaaataaggcaaatatccatcatggttgaagtttgaatctacgtgatgagttgactgtgactactctttctacatttcgtagactggaaaatgttcatcataaaaaggtacaaaagaacttcaccagatttaccacccattttctattccacatatggtggcccaggcatggcttttgctttctggtacacagttcttttgtttttgtctttgttttttgagacagagtcttgctctgtcacacaggctggagtgcagtggtgcaatcactgcagtcttgaccttctgggttcaagtgatcctcccatctcagcccccaccacatagctgggactacaggcgtgtgccaccatgtccagctaactttttgttctttctagaaacagggatctcactatgttgcccagactggtctcgaactcctgggctcaagccatcctctcacctcagcctcccaaagtgttgggattacaggtgcgagccatagcacttggcctcacacagctctttgtattagctcctggtgtccccaagacagatgctcttcccattcttctctgttttctcccaaatgggatggatattcccatttggtcccagagggcagtcaacctgaacagttgtagctggcactagtctctacctcctcttcaccctaaatatcacggatcaccctacacctggttccatcatcatcatctcccatcataacatttattaagcacttattaggccctaaatactgagccaagggctttccatacatccactgtttaattcttaagacaaccctctgatacctgtgagtcggttccatttacaatgaggaaactgagcctaatagaggttagaaaccttactcaaggtcacatacatagagtgtggctgagacaggatttgccccagccctgtctgattccagaactcttgtcttcttctccacattcccttctgtgccctgctagagtgacttccacagaagttttgttttcatgttactgcctgtctttttgctgttatttaccttttgctctactaacgcctcctctgcacagtgagtgaatgcttttttaaggggagactctgtctcgcttttctttacatctcccaggatatcagcacagtgctgggggattgctctgctgaatccacctaattctctcaacttcaagatgcagtagagggacctccagcttctgtttcatcgcccagtccctcctgggtcaggctggacaagcaccgtctgcatgcattgcctcctttccctttcccatttgtaccacattacctgatcccattccagtccatcccaaagatataagaggaaactcccattagtgggcacttctgctgggctgtctacatccctctccctggtcccctcttccccagcctgcttacccactctccttacctgcagcagcaggagcagcagcagcagcagccagggccaccctcagagccctgccccctccactctatctgccacccagatgtgctgtctgccggctggcccagggcctcttgtagttgctgcaggatgttgccccacatacgcggtcaccatctccccacgaggctgggtggctactttacaattgacaaaccttgggggaagtgtgactcggggaacagctcaggaagatgcagaaaaagaggggcaggctggccacccttgtgacagcttccttcctgccatcatgatgtcacagtcctgatgggaacactcagttgcttccctttctgcaccatggtgagtctagacccacccacctgatgtccccactgcgtcactcaccccttcaggccaccaacctcctcatcactgaccactgacccctacaacccgcaagcctgcaccccagtctccctgtgaaatggtgctgcgcaaacaaacattgttcatcccccaaggccgggttcaagcctttctgctacatcctccctctttaatatcaccccgcaccatggttcccaaggacaggcacgtggcttcactcaggaagtgtggcagacatacacacccaggctccaccaccagatattctgacttggcagatctgggaagggacccaggaatctgtattttagcaacagcttaggtggttctgaggcaaggagtccaagttgaccatgtctgcaagagctgcatataggtaagatggaccctgcagcatgtctcggtgactcaggggctttgcctgagtaccaggtatgggcttccctgagctaacctgtccaggcacaggcatggagaccccagttataacagtaatagcagtaaccaccatggattgaagtcctactgtgtgtcaggtgctttactcaggcgtctccttggatcctgtcaacattgggagatggtataatggaggtgtgtcatcttttgactctccagtaccaaacacctttttcttttggggggacaggccccaatgtgtgagtttcaccagatgcagagttctgcttccccttctattgaggatggaagcagctattcctcccacccttctcccggcagctgtgctgcaggcacgtgacttgacctaagcctggccacatgcatgattctgcccaggaccccagatctgcggatgaggctcaaatgcagggccagttgcagattacttactcagaggcaatttaaggattcagagtctaggaatagcatggtggcctccagtatccagggcagtggcattgatggcaacatgtccagactgtctcatgtggcctctgctgtccattctctcttggcttctgcccattttctaaacccaatcccccagcctctcatcaactctgagttactgatatccccctagaattcccttgctgttttagatagccagagttggattctgttgttagcatccaaaatcatcactggcatggttaggcactatcatgcccattaaggcaaggaggaatattgaagcccagaaggttaactgagtcacccaggatcagacaccctgcaaggatgcagagctagattcaaacccatacatggttttcctccaagacctgtgtcgttagccacacaacactattgtatcagtcaagataacagcaagacaccgctggctcattgaaactgggtaattgaggagcatttaataaacatgtgcatagaatttagggaatccagtaaggggtgcttcagtatgctgaggctggcaatagtggtgggtcattcccactgctgggcctacagaggagaggatggaacaggtggctggacttggagatgggagctgtttgctgagaggcttgaaggagccttcagaggggaatgcagccactcctgccaccacctgccagggagggagccctgaggacagaaaccctgatctgactgtctccccaccctcggctctcctctcatgcttcccattggctcaaccagccagaagctggcagccagggagcctgctggtttagccacattggtcaggttcccaggcaggatggggaggatggagcatggcgtggcctgtaagtgcaaatgggagagtatccagcacggccatttgtcttccgatttagtgcatataatatttcagtcacgtttaatatgttggacttaaataacacttgatctataataagttaagcacacaagcatgcactggaccatgcagtgggttatgtctggatgaatctgtatgaatgtgtcatgggctttggtaaggagtgtaatgactttttggaaacaagcttgagatccactaagagggagctgtatactagtatacagtaggtctgcaggggccctggactcataaagcatttgctttatgctccaggagaatctgatgcggtggcctaaagacctctgaaaaacattgccctcatgtgttctgcctctcctagagtgtatttaatgataatacccccttgccctggtcactttgtcaacttcataaacaggaacaatgctgggattgctgaagtgtggggttccagaccagcaagctcagcattattataaacactgcatcctgtacagtcactgcctctgagctgcttggttcttttaggtaggaaaataaatgcaccaagattaacagcttctggatctagtgcgtctgcaaagattctcaccagagcatcaggatgaaataaatgcccaccacacaccttctaatgggctcaaaattgcggttcagaaatcatctctctagggtcattaccattacctgggcaggttctgacagagcagcatttaggggaatggggaagtccttatgcgatggagcagtctggaagctggacctccccgtgcagggaactttttccacagaagtggtgctcattgtaaaaatacatttacctaacatgagacacacggtatgtgtggaaaagtatgattgctcttgggaactgaggataatatctgccctgggcatcactaaattgggctggaaggacccaccatcctttccccacccatgaggcccatttccctttaaagctcaaagtaggaaataacaaaatcctgattgaaatctgtgggagattgcaagacaatctcccacagagattgtctctgtggtggcctgaacacctacctgcttcaccggggagggcactggagagagcatggaaactgaggcaggtgttccaggagcagactgagagaagaggaggagggcagagtggggaactaggcaagcacatggggacagcctccagaagcctcccagggggagagcttttactccaccatccctgacccttgtgtgatacaggaaaagaggcatttagacacaggcggaactcctggttattctattctatatggttttggggtccttcaggtaaggagcgcttcagttttcactcctgccagtgggcagtggcttattcatgtggcctcgttctagtcacatacatttctgccttcacggggctattttcaggatccagcgataaatgcacacaggatgtctgacatggtctgttgttgctctcctatggatcccatctcggcctgccagtatttccccagaagaagatactcagtttaactcttttctctgagaaggatgcactttctcaccacgatgtcttatttctccaggttccacaatcttcaacacccttttctgggagtgttggaaagaaccacacataagcatgaaacccaagtgtctgatgctagaaagaggaagtcccagcatggggcgagcaggatgcttctgtagtgggagctctgtccaggtcaggccaaaattgtatggtccagggcaaaactgagcaggagaagtatcaggtgtgccttctgcatgtcacagcccccacaagagaattacggtgaaaagcattgagctgtctgtatttcatgccaaccccaagtggctggtggaatgaaggaccaagcatgtttggggctgtaacttcttttctgaggcacaaatgcccacccaagattattagaggaacgagggcagtgggcaggaaggtgagacgctgactttagaaatagccggtgattacagatttaattcatgttattaactccctgccttttacctcctccctcctcccttggcacaactgccagatggatgtggctggaagtcagaggacattctcgtgggttcgtgggcctagggtacaaatgacctcagcgtgacagcaaacaggacagagaagaccaggctcttactcaggaatccaccagccaggagaatgacaatgttgaacaccggaaccctgcgggagacaagaggctgaacgctactgctggcaaagtctctcccacacgcacatgttccctctagaaaatgccttcatgtcccactctcctctgcttagatccttgctccacctttcccgcactgcctgaccctgtgcttttcagtctgtctcattgccaaaaactactgattagaaacaattcagtggagagtataggtccctgtccaggagaggcactggagggagacagtcgggctgatcagcccatcctcctccctgtgatgtggtagggagagaggactctggccaggaaacccgctctctattctcagtaccgtaccctgcctactgggatggtcatctcacctctttagctcggtttcctcacctataaaccgagaagaatccacccgtagtgaaaatctcatcatgaattttatagattttggcgaaatgattctaaggtttctgggtaaacatcaataggtatcataataaaaagatgcaaaggagtgagggcacttggccagttccatcagcagacatgcaagcagatgagagcacaaggatgtggcatggtaagacacagggacagacagatggcaatggaacacaaaggccagatgcagagccagtgctatgcaggaacataatgtctaaggaaatcagaggtccagtggataagccggacgtggtagcatgcacccatggtcccagctacttggagaggcaggaggatcatttagtaaatagtcttgcagtatctggacagcaacatggtaacggtgtaggcttttctacagtttatagcatgtagcagaataaatcttcccccggactaaacatttaaataaaataaaaaaaaaacaatccaagaaaagtcaccaggaaatagaatcaaacacattaaggaataaagcaaagcaattgatttaaaatcaacacacccacctatacaaaacttaaaaccacatgcacaaactagcaaagagggaaacggcgtaaaggagctagaaagcagaaaactgcctatttgcctgaaatccacccccattcaagggccctgacttgtagcacaggggactacattcccaagcctgactggtcgagttcagcaactggtgggggacagggggcagagacgggggcagggatggggcagagagacaggcagcaaggggcagggagccagcatctctctcacccctcacatggtggtgcactcagcatcctcagcatctgccccgattccagtgctgcaacctgaatgtcctggcttccgggctctgctcactgcacctcctccccaagtctctcctgccagtgctctgcattatccactctgagtgctttaccattttcctatgctgaactcctggggcatgtccactcccaacaggccaccatctgcatttttttcgaggctgcacacaagctaccaaccccctgaagggccaggaattcatgtgcttggccttggttagagctgcccttgctcagttactgccccttatagggacaactccaaatgtgacccaggagtccccagagctccttaacaagactgagccagagttatcctgtgagataccccttggttatgacacgcttgcttggcttccttcccttcctggtcccacttcctcaatggctttgccagaaatcacttcctaaaacatttttctttttgtcttttttttttttttttttttttagagagaaagagagcaggatcttgctctgttgcccaggctggagtacagtggcttgatcacagctcactgaagccttgatctcccaggctcaagtgatcctcctgcctcagcctcccgagtagctgggaccatgggtgcatgccaccatgccctgctaatttttttattatttttttgtaaagacggagtcttgctatgttgcccaagctaatctcaaattcctgggctcaagtgattctcccacctcagcctgccaaagtgctgggattatatgtgtgagccacaacacctagtcctaaaacattttaacaagactttacagcttgcttctggggaaactacctagagatagggtgatagtggctacctctgcagtgcctctccatccccaggatagcgtctcagctcttccatcacctgggcaaacaattccctgcattaaattccttcgtttcatggctggatgtggtggctcacacttgtaatcccagcactttgggaggccgaggtgggaggatcacttgatcccaagaattcgagatcagcctgggcaacacagggagacccccatctctacaaaaataataaaaagtattagctgtcctggtggtatgcacctgtggtcccagctacttgggaggcaaaggtgggaggaggttgaggctacagtgagccatgatcgtgccactccactccagcctgattgacagagtgagaccgtgtctcaaaaaaaaaaagaaaagaaaaagaaaaaaagcttcttcttttcaaacagctagtgtggattccactttccagactggactttggctgaaaggatagttcatattagatgatagataaagttaacagataaaagagagatgcagtctctagcagcaaggcaggagaatagggtctggaggcaggaacgtaagaccaattcatgctgaatcatggagcaacaccaaggtctaggggcaagaaatctaggatggattcgtgctgacttcccatagctggatcaaaaggaaaactcctggggctggggtcagggaacctaaggccaattaacataaactttctaaagctaaaacaaaaggaaaaaccccatctccccatgccccagcagcaaagaatcaaaggctactctccctacagccctcccccttccaccacgtctcagctggaaagggagagtgtcttagattggccctgagccaagcagagacgaccatccctttacccacagagggcgccaattcaccttagcctttagttagccacaaaccaaatgcttcatccagataaggggtaactgggaggaacttcacgtggagtacttaaaacccagaaaactttgtaacttggcccttgagccacttgcgtggggccacttctaccctggggagcgctttctcgcttaaataaattcctgctttcactgcttcattcctttgttactttgtgcgtcttctccaatactttgattaaaaggcccagaacctggacagcttacacttaaggccctccttccggtaaaagtaagaatatgggcaaagattatgttctcttaacttatgtattgcaaaatgaaagtagaggaaaaaaaaaaattgactcttagtagatcattcgtttgatttattccacagaagtttaatgagcactttgttccccaaacaacataatggggaaaaaggcactgccactacccatatggaggtggagtctacactcatagagaaattagagcaggcaccagttcacatttgttttagcaggaatgtgatttaactcacactatttaatgatttaaaagactaaatccgtgtctgtaagcctgccatgacactgctttatttatgcttaatggatcacactgcaaattgtttccaatcttttggaagaccattggtagatgctatttgtatacaaaatgatatcagtgtttaaattatctcatggaaatttcgagttaattatttaaaagaagaaaaatatatctgcaagaatatgtttatctcagagttatcaacactatatcaatgtctaagaacaggccaatggttatgtaagttatggctttcccaattgatagaaaaatatgcactcattgaaattatatttatgaaatttaggtagcagcatcaaagaataatttcagcaaggaaaagaataaaaacatgtataattagacttactgccatattaaaatatgtataaacatgaataaagactagaagagaatatgagaaaaaagacatgttagactagtggtgatgtggaaaagtatttccatcctgataattcagtatttaatgataaacacattctaatataaatcaacatttaataactgtaaagaggtgtgaaattgctaagttagtggttcttaagtttgcctacacattagaaatctcctaaacatcttattaaaaatactgagagggacctcatctgcaaaaattctgattctatttatctataattgggcacatgcaacaatgttatttaaaaaacaataaggcaaaaaccaatactgcatttagccccagctccagctcctgctgagagttattaggtggacaatgtcttccagctttgggtttctaccatgcctactgaattgtcaaagaagctaaagccagagagggttcctgactcacccaaagtcacattcagttagtcaggccaacactagatccagggcccctcactcagagtgctttcccactgcccatcaggcccctggggttggatgagctccactggaacttggggaagatgccatttccctctctttaatactcaggttgcaaggaaacaaagaaggtgaactggggagaaggacagcctggctgagagcctcccctattctccatcaccacttccttcttcccctggacatttctacccagactaatgtgactcaagtcttctcctgccccaccctcccctttccctcactttcacatcctctcagcacacagactgggaaacaaagggctcagtgtccaaaccaggggcccagggacctggaaactatacctgatgatatctgtcacatttgtaaggttgatttcagagtcaggagtggagacatcggcagttgacttgggtggagcttgggtcacagttctggggctggtatagagtgggcacaaggccttagtggtggtaggaggaatcttatacacattctgggtagaattctcattggagccaggggtccctgaaaaacctgcaagaagacacattggatggatggatggacagatggatgatgaatgggtggatgggtgggtgaatggatgtatggatgtatggatgaaaatgtggatgagttgatggacgggtaggtggtacggtaaatgaagctgaggagggaaatgagcatggcccaaatgcaaagttttcctttgctaaagccaaagaaatactgtggagtcaacctgagtcagaaatcgaaaaaaggaaagaagaaaaaaagggcaggaagtgagggagagcagaaagagagaagaagaaaggaattttttgtcattcgtactgttggaaatgaacttgccttctgttcttcaccaattcttgtgccccaaccttctccaagaataattccaggcttacttgattcactctgcctttcgttcacctggcttatggcatattgctttaaaagttatcttttattaatatattgtgtgtgcaccttgtcttcctcaggcttagaattccccaggtgctgggaacttgagcctgcttccctttcctctgtcttccataattcattccttaatgcaacatctcctgagggcctactttgtgtcagaaactacattatttgctaggggtgcagagcccaggaaggcacaggtgcttccctcaagcagttctgaaatgaatagggtacagataagtaaacccccctctcctatccagtgagtagagttgtgtacaaggggacacaaaatgagctctggagacttgctcccccaaaatgggagccatggaccatcagcattggcatcacctgggagatcaatagagatgcagacccctgtacccattcagttggagtgtgcatttgaaataagatccccaggtggtctgtgcccacagaaagatgtgagaggggctgcttcagaagcacacaggcatgccaccaaacgcatccttgggagggggagtcaggacatgacttctaagtggagaacaaagaatgggactaaattatcccaaatctaccactcaccttaattgtaccccaattcctaccacagcacccaaaattaggctgtgctatccaaggagaatctcatgcatggaaggttctacttactactggaccttagatgagagataaagaggtcctgggaggaagacagactgctgggaatcctgaaccccagctctgctgatgctaccaccactgcccctttcctcacctggcccttctttccccccaagtcccaggccactcacccttggtcaccaccaagcggatgcgatcgaacagcatgtgaggctccttgggaggctggtagatcacacactgatacagtccagaatcttccacttgaaggttgaccattcggacgcgcagtaaaccatgatcatggtagtcttctagtatgatcctccccacttggactggatgggaattctttgaaggcctctctgtgcatgccagggtcttgggcatctctccgtcccttattatctgccaagctttctggctgctggcaaacttctctagcgtgtagtcacatttcacatccagggtctgcccctctttcagttcatacttttcctcagttaatttagttgcagctcggagttctataagcagggaaagagaatgggttctgtgaggaattatttttctctctctgagtggggaaaaaggagaggagccccctgtttttcttgtccaaccacccatatttcagatgaggttcttgaggcctccagagaaaatacaacttgccctgcaagccagcactagacctcagatctttccactgtgagtaggttttttactataagagactgcatatggtgcatgaggatcaaatttcataaatgatcagaagaggaagactgactttgagaggaagaaactgcctgcctggagacagaacatgggatattgtactaagaccacgagtggctgcagcatggtgggagggatcgattacaagggcgtatgacataaaaagtgaacgcaaagacacggtgctagcagagagtggctccaaggacaccttgaggaacttcatctaagtcagggcaaggagatcagctcaaaagacctttggacaaacagtgaggaagccgtctggagggcatgatgggcatggatatctgactgcctggcactcctttttcccttccttgggtagcagagcacccctttccaagggaacgatcctgtgtggctctactgttggggcagcccacattctcaaggatgggcacaggacacaggatttgccaatccaagtaccccatctcggggccaggcacagtggctcacgcatgtaatcccacactttgggaggatgaggaggtcagatcacctgaggtcgggagttcgagaccagcctggccaacatggtgaaaccttgcctctactaaaaatacaaaaaaattagccaggcatggtggtgcacacctgtagtcccagatacatgggaggctgaggtgggagaatcacttgaacccgggaggtggaggttacagtgagccaagatcacaacactgcactccagcctgggccacagggcaagactctgttaaaaaaaaacacacacacacacacacacacatacacaaagtaccccatctccctgccaggctgattggtttaggaaggagcacatggctgagctggaccaatcagagtcctccctgagactgctgtagccattaatggaaatgcttcttgctgggattcacaggtcaatgagatgtgaaactttattatgtgaaactttctaccacgtaggaataggctgcccgagaatggctaaacaggcagaaagtgagtgggaggaaggaagagggggatagtggaggggagagaaagaaagagagaaaaaaacccacgttatctgagtcatggactcagctgtgctccaaaggagcaccccttgtacttcccagttacctgagccaagaaatgccccctcctatttttgatgtcacggagtcacagcagtggttctccactggggagcaatttttgctccccgccacaactctccctgaaacactggacaatatctagacatttttggttgttataaccagggagaggggtggatgctactaacatctaatggataccaggctaagcaatctacagtgcacaggacagcccccacaacaaagaatcatcccaccccaaatgtcaatagtgccatgtttgagaacccctgggttacagtgacaatagtttccatcacattcttggagtccgaactgggttaaccatctagaattggggatgctcatctggccttgtccaagggagccttgctgatgggaggccaagcagagcggaagtgagaagaccaaggtccgtgttttcagctggacacacagggctctctaagtttgctgagagactgtagcttacccactcaggcctggggtaccttcccccatggagcaccaaataacaggctagacagtgctgctgggtctactgtgtgggtcacggtaacactagtactgctgttattaataccacacacttaggtccttgcaggcctggtgaaaaatgacaagtgcttaccctttcatggagccccctggcatgcccaccccaggataggccaacagatctgcctgaccttaggaagactcaactcagggactcacaaggagtttaaaggtgaaatcagtcttgaaagccagttcttctgggagcagactccagtttctagggaaacctcggaaacagacctcttgggcaactcccacacactccagtcaggaatgtgcctccaagagactgttgaccagaggctgagtgttgtctgaaaccaagcctggttccctcatttgttcactcactcatcagactggctgggagacttctctatcataggcactgtgctgggctctttggaagacacacagactccatcctcaagttgccaccactgaagccctaacctctgaagttaatgttacagataaatctcttttatttgccagctccccagggaaggtgggagttacaggtgactgagtttgcaaacttgcctgtctctcacagaaggaaggagacaataagaaatgaaggctgctgagctgtctgtgcacaattgcaagaagggaattcctttgaatatgttaattaaaagggtagcaaatactacctattaagtattatgtgctaagggtttttaaagactatcttatttaatctttataaagtaaaaagttgacaccattattctccccattttatagataaggaaactgaggcacagacagattaagtgatttgcccaaagtctcaccatagttaagtactagagccaggattcaaacccaaggactctggttccacctaaagcactgagctacatggtccaacacagtctgatagggattagagaagtcctggcccaagtgtgaataagtatccagttgcaaggagcattgaggttaacccctaacctatccccacagggcacaatgaaatatataccactggttttctctcacacaggtacataaccttcagccctctgccatctcccagttctccttcagaaaaacatgaatcaaacacaaggaaatgcacttgtccatgaggagctaactcccttctgcccatctagattatcaccccagctccaagaagacccagagcaatgtctgagcacaggctcttcaaggcagttgtccatgactttgctcaaagtagagagcccaggaggatacctctccctgatttttcatgccttcccaaggcaagcctcgcttttaactcatattgacactttcctcctgttattcataaggattaggaggaggagtgaataaagcccgcatgcttctggtttgggtgcagatgtgagctgtgcggatcgtaagaggagacacaagaaagagctggggcatgcgccggctctgctgagcctcagcaactgtgccctccaaccccagcgtgccatggagagctgggatgatcacctccaccaaaatgagcaccagcctcttctggtcacgtctgtgtcctcagcagtagtatatttgctgtcccatagtagacccctgggaaatatttgttaaatcaattctgtcttttgggtttaacagattgtcaacatcaaacacatcatgatggaatataagaaaaaaatttcaacatcaaataaacttattgtagatcatgccatgatgagatctactctatcattattcccatactaggctttgcatgtctctaacaacatcgacatgcacagacatcttttttccctgactctctccttcttttacttttgtgtgcagacactgcatgttctcccaattctgggtagagcagcacggtctgccataactactggttggctctatcttggatggccctgtgctctgaagcttcaacagaaaagggctccccgagatcctggaccaaacgcctcccctgctcagtcctcttccttgtcttacctgagacaaagagcatccacagcagcccccagagcctggtcttcctcatccttcctgtgcaccagctccaactgctgctgagggctcccgggacagctacaaggcaccacaatgacctagaggcttcggaaagttgcacaacaggatatgaggccattcctgggagtcactgagtttgggttctgtttcatcaccagttgctctgactcctgacatcaacacaataatacagagaccaagactcacttctcagttaagtttctttgaactccagttttcctttctgtggtaataatgacaattacctttcaaccttacaaaatctaagggagaatgatacttgaatgtaaatcaaagtaaggcattcatattaggaaggggaacagagggccctttgctctccagaggccccctctccattcacatccagtttagtgtagtgaagagagtcaggcccacatagggagaggctgcgacaatcgtatctcatcttcagggtttttgtgagaacatgttgcttcatcctgccctgctcagccccgtgggttctcttggcttctggtgacctggggtgcacctcctcttcatcaccaggagggccacaccctgcatttgtccttcagcattgccacagacatggcctgggagctcacgggggtgtagggaccccagaaacaatttgagaggacactgccaccacccaacaagaacagacttagatttaaaaaggaaacttggttcaagacgctgaagcaagaagaaaaaatccagcaggttttgtactagaagcaagaaaagacagatttgacagtgtgaaaatcaaatcaataatggagaggattcacttcagaaatattcccaaatgtgaaatgaataaagacatttagaagagctcagaaatttaagggaggacaaatcacagaattccaatctacaaatcagagatgtccttaaagcataaaatggaatggtggatcacaagcaagattaaaaattttatcttaaaaaatatgctttccaggtctgagaagaaatctaaaattggaggttgagagttcaacatgggcaaggaaaaaattcacaaagtgagacctagaataggaagtttccaggtgaaaatttttaaatttaaataaaaagattcctactgctaaataaacaaaaaagtaacttggtttcttcaaaggaattgaaataatcaggactcagatttcttctctgagtaacaaataccatgagagagtgggatgaggtataaagaacattatgaccctaatattttacacccaaattgattgctactcaagtataggaacagctaaaaggtactatcatgtctgtaaattaaaacaaacaacaaccaaaaaaattttcaaggctaactttaattttttttattaaagctgttcaatgcagcaatttataaaatatagaaaataatacataaacttaaatcatgttattacactttatagagatcatttgtagtggagattttactatgtttattttttgttctacaaataatgtcggaaaacaggcttcaaacatgcttgaactgaaatctgctggcccctccttttgctgtactcaagcagtccctaaagaggaaaaatagacagaaagctcttgacattttctgactcagagaggagcctacgtgacttctgtggcgatgagtcaaattaataaagtttatttcagtgaataaatcccctccttacaacaaaattaatattccacacttaaataatagctatttcacatactttctacatttttgtgtcttcatatactttgtgtggaggattaagctcctggaagattaagagggagctttgaactaaacagtccaagaagaatttttaattagacttgaatatcactggaggctgattgctccttcacattttcctaactacggacagcacctgcatttaaattagaatgaagtagaatgaggtctttctccacttgtctgatctatttgtgtacttgaggtcaacagtgcaaatagtcacgtgtcacttaatgacagatacattctgagaaatgtgttgctaggtgattttgtgttgcaggaacatcatggagtgcacttacacgaacttaacatggcacagcctactgtacacctaggctgtatggtatagcctattaatattaggaaggggaacagagggccctttgctctccggaggccccctctccattcacatccagtttagacaaatacctttcaacctcacaaaatctaagggagaatgatacttgaacataaatcaaagtaaagcatattcctaggctgcaagcctgcacagtatgttacagtcctcaatactgtaggcatttgtaacacaatagtaagtatttgtgtatctaaacatagaagaggcatagtaacaatacggtattatgacattataatcttatgggacctccaccatatatgcagtctgtcatggaccaaaacttccttgtgcagcacatggcagcattctctaatccttaccactttatttttctgaggagtttaatgacccgatcagtaacttcttcaggctgaataggcaggacgatattcctgcctaactattagggtctctttaaattctcaagctactgctcccaacaagatattatttcttaaggcttctcatagaagagcactgtcatttgtgacctatggttcctgttaattttactaaggctgggtcacatgtcccatttccatgcttgctcatagggtggcctctagcactaggaagatttagtctttgggtaccatgaacctttccatatttgccaaacttcatcttcagagctattatgaaatcaatacagtttcaacattgatacaattaatgaaataataccaatattattctgttttgttttgtcttcaataagtcactgccccaagtcagtaggtctcgatcttcactatggggtaaattagcagtttcttccttaataaagattggttaatctaacctagctagaatatatgtgtaacattttttaacaatgagattgcatataaaatatcttcttttctggctcagaggaggggcccacatggaactggaacacagatctctgaggatagtgtgaccctggtgctgatatctctgaggaggcccaatgagactacttctgagagtggggaaaactgcaaactggaaccagtcactgttgcccgtgaaaagcatcactgaggctactcacaatgaaagagaatgaaataggaatcagtgagcatgtcctgtcttcctcctccagcctcccaatctccctctaatgcccctatcgagagtccagcagggaaccagccagcaaagacaaagcgagtttcagaatctccactcaaaccaaggtaaagaagtgttaatcagagagacgatgactgaataaccagctcactcacacagtcaaacaagagcactccacgtgtctgaggcctcacctagcagtaaagcagacaagttgaatagttaagaatcacagtggcattttatgaagaactttcttagcatagctagggggcatggctaatttcacatgtccccaggccttatctagaatcaatgctccaaaataaattgaacaacttttaaaagtcaaagaagcagtttatgaccttaaagcatttaggaaacttaatatctgacctgcataatttagaccaaatatttacatttttgaaaatatttttattttaccaataatctttaaaactgtttttatttcccaaagattacttaagtcatatgaaccaaaagacattacactttttaacttttttgacaaaatatttgatttaagcacttatttttaaaccaattaatctagctattttatattacacacacataattcatataaatacatagacagaagatagaggacttatacccaagccaggaatcaaaccctgaacccagcctgccattgtgaaaagagaacatggccacatggttacaaggtcaagctcccaaggacatacaagacaggaaggaaatctcatccagttttttcaggaacctgcagcaaagtttgtaactgactggtttactgggctgtcttgaaaagcaggcttacaggtaggtgtcttaggcttgtgttctatcctaaagtactcctctgcattatagaacacagaaagacacacaaaacataccaaattcactacagcttaagactagcttcatgaattaattcttccattaatcaaaactttacagaggagataaacagtgatttttaccattcattcaaccagtttgcacagagagagagaggagaaaggattgcctaaggcagggtgaggaaggcactcagggaggccagagaaagacacacccattgcagcgacactgaaaagttcgggcagccgcttgctgatcatgaaggaattttttccagcagtgccatcagctctcaagtttcccctttttaggaaggaaaatgctccccatgccccctgatcctgtacatgcttaaccctgtcacccacagccatcagcaaagagtgcaaagcagattatttccaagagaacagcaattaattcccatagtgctaaattcgttcttagccaaaagggactttaccaagagggactttaccgacaggggcctctaaccccctaaatcttagaagggactctaaccctcataagttgggcctctaacccagttggtcaggcgttcttgccttttattaagagggggctgtaacccactatgtcttaggagagactctaactcctttaaattgggcctctaacccaatcccattctttacccggtatatgcaccccacttacccaaagtccgccagtcagtgctgcagtctatttcctttgcattggagggtctgctcagtatcgtcccttccgtggttcacaagaaagatgttaaaaaaacatcctcagatgttttttaatgattttttcctaaatgaagttcttttaattttcagaccaaccaaacatttttaatataaaaacattttaataatatacaaacagcaatcaaaacggcatccacttggaagcgaaaggactggggcacagatgggggagtggactaaagagggacggttttcagggtcccagttgcttcccttgcctgaaatcactctggtcttagcagagggaagattaaggcatccagaggcagaggggccctgaccctgacccagagacagactaagcacagcaggcccctctaacatcaccttcccaccatgacagcctccagggaaagccagatccagttacaagagaacaggaaggtggctgtgattaacaggaaaggcaaccatcgttcctcagcaacctgttgatcacacctctgggaatagagttttccagtgactgctggattgaagaggatctaagaatcttcctgggagaaggatggaaatgggatctgagtctacatactaaccaagatgccttgcctgtaacaccagaaagctggagtggatctgctcagatgtttgggaagagaaaagaatgacagagcctttggcccagcaaagctggagtgttaacaagcattgactgagaaatcctctaggcaggccagggaggtctgtggcccaccacttacccaaaggtagccattgggttgggggtttccacactatagtcacttccatgatcagcagaaagatgttacaggaccccaccacttacccaaagttagcctttgagtcaggggtttctgtgctatagtcccttctgtggttgccagaaagatgttacaggaaatgggtctggatccagaccccaagagagggttcttgggtcttgtgcaagaaagaattcaaggcaagtccatatagtaaattgaaagcaagtttattaagaaagtaaaagaataaaagaatggctactccatagacagagcagccccaaaggctgctggttggccatttttatggttatttcttgattatatgttaaacaaggagtggattattcctgcctctcctttttagaccatatagggtaacttcctgatgttgccatggctgtaaactgtcatggtgctggtgggagagtagcagtgaggacgaccagaggtcactctcgtcgccatcttggttttggtaggttttagcgggcttctttactgcaacctgtttcatcagcaagatctttataacctgtgtcttgtgctgatctcctatctcatcctgtgacttagaatgccttaaccatctgagaatgcagcccagtaggtctcagcctcattttacccagctcctattcaagatggagttgctctggttcacacgcctctgacaactgcaccagcctttcacctactctgaaggcatacataacaattaaatgtgaacaacattattatcctgataacaaaccaaagacatcacaagaaaaaaacctacggaccaaatcccttatgaaaatagacacaaaaatcttcagcaaaaacactaacaaactgaatacagcaatatataaaaaggattacacaccatgaccaagtaggatttgtcctacctggcattcattcaacatatgaaaatatttcagtttaatactccatattacattgtaaaggaggaaaatgtcacagtcatatcaacagatgcagaaaaagcatttgacaaaattcaactctcttttatgataaaatactcaataaactaggataagaagggaatttcctctatgcaataaagggcatctattaaaaaagaccctacaactaacatatttaatgacgagagactgcaagctttctctctaagatcaggaataagacaagaatgtcttctcagccaactctgttcaacattgtactggaggttctagccagggcaattaggcaagaaaataaaaggcatccaggttagaaacaaagaagttaaatttgtacgtaggaaattctatggaatttttaagaaaactattagagctaattaacaagttcagcaaagttacaggatataagatcaatatataaaaatcagttgtatttctacttactagcaataaacaatctgaaaatgaaatgaaattaagaaagcaatttcctttataatggcatccaaagcaatgaatatttaagaacaaattgaacaaaagaatgcaagatttgcacactaaaaactacaaaacattgttatctggcagagtctttgcctttttgtacccactcacccagcttgggtcctatctccactactttatgttttctgctccaggaggccctaggtgactctgctgcagcctctatcatcctgtgacctgcaggatctcagtaagacggctaactagatgcagccaggaggaacatctgccacctaaggatggtgacatagagaagactggtgcactgagggaaggcactgagagtggatggagggaggacacagatgctgggctgaaggggagagaaagctgggaatcttgcacgggccatcataccttgggactcattcctggcccccaacaactctggggaacaggtgagttgagcaggcaaggcgtgacccacttttgccacagacctctagaatcctggcagcaggagaccccacaaccccaaagacacttgagctggcagggggagctgcttagagaggtagtaagggcaggactccagcctgtgtagagcccagagggtttagtgtgggaatgtctgtggtggagcacagctggggatgcccataccacaaggctcaccatgatctcctaggagattttagccttaggggaactgtccaatttcaacagagcaggatggtcttgccagtgagacaagccagtctgatctgagtgccctcctgtctgctggcctctcctggggccccagcctgcccatgcctgctttcagtgcagccttggataccaaactggcatgcctcctggggacctgcatcatagttccttcaccagcagactgcacctgaccatcagagcactcaagcagagtggcccctgctgatgaatatcagcccaccacaccctccctctgtggcagccttccccatgccactttaccagcacacatttgctcacagccaaccccccaccgctttcccagcacatgtgtgtgtgggcggatctcacctcccctcccccgctgctgcatgtgtgcatgtgaacctcactgtgctactactgcaggcatgagcctacccctgccccagccatgctgccattgccagtgtgaacacaggcacacaggccccacctcccaccccacactgccaccaccactagcacaaacacacacacgtagtggccctcagcctcacagccaccaggaccctaccccagccaacaagcgtgcaccctgctatgctgctgctgctgctgctgctgctgctgctgacacacacaaacacacatggatcctgctgccatcaccctgacaaagtgctttggctggtaccacccatcagagtgtcatgaccagaggccccagaatacctctgtccctctagcatggctggttcctaacctcaaggggccagagaacaaagctgggggcctcattccagcgcccccagagttagagcctgcagcttaggagtgctgagttgagccttggccccctaacatcttccagaaacaaagccagtcaacaggacccatcttataccacaatcaaacccccaaggccatcaatgaagataaaagcaaataaacccgtccaaaggacagcagcttcaaagattgaagaaacatcagcccacacatatgagaaggaatcagcacaagaactctggccactcaaaaagtcagaggtctttttacctccaaatgacaacactagttacccagcaatggttcttaaccaagtgaaatggttgaatgacaaaaacagaatttagaatgtgtataggaacaaagatcattgagattcaggagaaagccaaaacccaatccaaggattctagggaatacaataaaacaatataggagctgaaagacaaaatggccgttttcagaaagaaccatactgatttgatagagccaaaaaactcacttcaagaattttataatacaatcagaagtattaacagcagaattgatgaagctgaagaaagaatctcagagctcaaagactggttatccaaaataactcagacaaaaataaagaaaaaaactaaagaagaatgaacaaaacccctaagaaatatgagattatgtaaagagacaaaatctatgactcactagaatccctgaaagagaaggagagaaagcaagcaacttggaaacatatttcaagctatcatccatgaaaatttccccaacctcactagagaggaccacattcaggaaattcagagacccctgcaagatactagataagatggccatcaccaagaaacatagtcatcagattctctaaggttgaaatgaaagaaaaaagtattaaaggcagctagagagaaggggcaggtcacctacaaagagaaccagctagcagcagactttcagcagaaatcctacaagccagaagagactgggggcctatatttagctttcttttttgttttgttttgttttgtttgtttttaatctcaatagcttaggggtacaagtggtttttggctacatgatgaatgaatgaattgtacagtggatgaattgtatagcggtgaagcctgggcttttagtgtattcatcacctaaatagtgtgtattgtaccagtaggtaattgttcatcctgaaccccttttccactcttttccattctgagtccacaacgttcattataccattctgtatgcctttgtgtacccatagcttagctcccacttacaaatgagaacattctgtatttggttttctgttcaagtttttacttcacttaggataatagactctagttccttcaaagttactgcaaaagacagtatttcattctttttcatgaatgcatagtattctgtggtgtgtggatggatagatagatagatagatagatagatagatagatagatagataccatatatttgtatccacttatcagttagttggcagttaggatgattccatataattgcaattgtgaattatgctgcatacatttagcattcttaaagaaaagagatgccaaccaagagtttcatatccagccgaactaagcttcataagtgaaggagaaataagatccatgtcagacaaacaattgctaaggcaattcattactactagacttgtcttacaagaggtcctgaaggaagtattaaatttgttaaagaaagaccattaccagctgatataatctggatatttgtccccacccaaatgtcatgttgaaatgtaatctccaatcttggtggtagggcctggagggaggtgtttggatcaagtgggtggatcccaaatgaatggcttgggccatgacttggtgacaagtgagctctcactctgagttcacacaagatctggtcatttaaaagtgtgtagcacctcccccagtatcaggggaaccagcccccaatatttcaacgtagattcatttctattttccctaagtgttggccagtctgagaaataaagagaaagagtgcaaagagagaaattttagagctgggcctccaggggtgtcatcacatattgttaggaccatgatgatgaccccaagccacaaaaccagcaagtttttattagggattttaaaaggggagggggtatatgaacagggagtaggtcacaaggatcacatggttcaaagggctataaagatcacaaggcgaaggcaaaattagaattactgatgcgggtctatgtcccgctgtgcacgcattgtcttgataaacatcttaacaggaaacagggtttgagagcagagaaccagtctgactagaatttaccaggctggaatttcccaatcctagtaagcctgagggtactgcaggagaccagggtgtatttcagtccttatcttaaccacataagacagacactctcacagcggccatctatagacctccccccaagaatgcattccttcctcagggtatcaattattaatattccttgctgggaaaagaattcagcgatatttcccctactcgcatgtctgtttataggctcccttcaagaagaaaaatatggctctattctgcccaaccccacaggcagtcagaccttatggttatcttcccttgttccctgaaaatcaccattattctgttctttttcagggtgcactgatttcatattgttcaaacacacatgttctacaatcaatttgtacaatagtggtcctgaggtgacgtacattctcagcttacaaagataacaggattaagagattaaagtaaagacaggcataagaaattataagagtattattagggaagtgataaatgtccatgaaatcttcacaatttatgttcagagattgcagtaaagacaggcataagaaattataaaagtattaattttgggaactgataaatgtccattaaatcttcacattttatgttcttctgcctcggctctagctggtccctctgttcagggtccccgacttcccataacaccccaccattctctcttgcttctgctttcaccatgtgacatccctgtaccccctttaccttctgccatgattgtaagcttcctgagacctccccagaatcagatgttagccccatgcttcctgtgtagcctgcagaaacattagccaattaaacctcttttctttataaattatccagtctcaggtatttctttatagcaatgcaagaatgacctaatacattggccactacaaaaatgcacttaagtacatagaccattgacactattgagcagccacacaaacaaatctgcataataaccagctaacaatgtgataacaagatcaaatccacacatatcaatattaactttgaatgtaaaagggctaaatatcccaattaaaagtcacagagtggcaaattggataaagaagcaacactcaatggtatgctatcttcaagagacttatctcacacgcaatgagacctatcagctcaaagtaaaaagatggagaaaaggtaccaagcaaacagaaaacagaaaaagcagaggttgctatctaatttcagacaaaacagaacttaagccaacaaagatcaaaaaagacaaagaacattacataatggtaaaaagttcaattcaacaagaagacctaactatcctaaatatatatgcatccagcacaggagcactcagattcaaaaagcaaattcttagagacttacaaagaaactgaactcgacacttgaccaaatgaacctaatagacattgacagaactctccaccccaaaacaacagtgtgtacattcttcctacctgtacatggcacatatttgaagtcaaccacacaatcgaccaaaaaacaatcctcaacaaattcaaagaaaccaaaatcacaccaaccacactcttggaccacagcacaaaaaaaatagaaatcaatactaagaaaattgctcaaaaccatacatttgcatggaaattaaataacctgtccccagataacttttggataagcaacaaaattaaggtagaaatcaagaagttctttgaatcaatgagaacaatgatacaacataccagaatctctgagacatagctaaagcaatgttaagagggaagctaatagtactaaacacccacatcaaaaagttagaaagatctcaaattagcaacctgacatcacacttagaggaaatagagaaacacgagtaaaccaaccccaaagctagcagaagacaggaagtaaccaaaatcagagctgaactgaaggaaagtgagtcacaaaaaagatataaaagcccaatgaatccagaagttggttatttgaaagaataaatcatatatatatatatatatatatatataaaaacacattcttagctagattaataaagaaaaaagagaagatccaaaaaacacaatcagaaatgaaaaaggggacattaccagcaaccccacagaaatacaaaaaaccctcagggactactataaacacctctatgcacacaagctagaagacgtagaagaaattaatacattcctggaaacatacaacctcccaacattgaacctggaagaaatcgaatccttgaacagaacaatatgttcctaaattgaatcagtagcaaaaggcctaccaaccagcaaaaagcccagaaccagatggattcacagacaaattctaagagatgtattaatataaagaagacttggtaccattcctactgaaactattccaaaatgttgagtagggacttctccctaactcatactatgaggccagcatcatcctgataccaaaagctggcaaaggcacaacaataaagggaaacttcaggccaacatccttgacaaacatagatgcaaaaatcctcaacaacatactggtaaaccaaatccagcagcacatcaaaaagctaatccaccatgatcaagtaggcttcatacctgggatgtaatgttggttcaatatatgcaaatcaataaatgtgatttatcacataaatagaactaaaaacaaaaaccgcatgatcctctcagtagacgcagaattttgataaaattcagcatcactttatgttaaaaaccctcaacaaactcagcattgaaggaatacctcaaaataatagggaccatctatgacaaacccacagttaacatcatactgaatgggcaaaagcttgaagcattcccctggagaaccagaacaagataaggatgccctctctcaccacttctattcaacatagtactggaagtcctagccaaaacaatcaggcaagagaaagaaataaaagtcatccaaacaggaataaaggaagtcaaactgtttctcttcacagattatatgattctatgcctagaaaaacccatagtctctgccccaaagcactttgatctgataaacaactttagcaaagtttcaggacaaaaaatcaatgtgcaaaaatcagtatcatttctatacaccaacaatttccaagctgagagccaaatcaaggacataatcccattgacaatagccacaaaaagaatgaaatacctatgaatacagctatcctgggaggtgaaagatctctacaaaagaattacaaaacactgctcaaagaaatcagagatgacacaaataaatggaaaaacattccatgcttattaataggaagaatcaatattgttaaaatggccacactacccaaaacaacttacagattcaatgttattcccaacaaactaccaataacatttttcacagaattagaaaaaactattttaaaatccacatagaaccaaaagcttgaatagccaagacaatcctaagcaaaaagattaaagctggaggcatcacattacgccccaactttgaactatactacaaggctacagtaaccaaaacagcatggtgttggtacaaaaacagacacatagacaaatggaaaatacagagtccagaaataaggccacatacctacaaccaacagatctttgacaaagtcgacaaaaacaagcaatgggaaaaatccatttggctagccaattaccctagcatcatttattgcaccatttatttattcaataagttataccggcttaattggctagccatatgcagaagactgaaactgagctgcctcccttacaccctatacaaaaaatcaactcaagatggattaaagacttaaatgcaaaacctaaaactacaaaaaccctgaagataaccttggaaatatcattctcaatataggacccagcaaagacccagcattttcatgacaaaaatgccagaagcaattgcaacaaaaacaaaagttgacaaatgggatctcattaaactaaagagcttctgcccagcaaaagaaactatcagcagaataaagagacaacctacagaatgtgagaaaatatgtgcaaaccacgtacctgacaaagattcaatatccagaatctataaggaatttaaacaaatttacaagcaaaaaacaaagagccccataaaaaagtgggcaaaagatatgaaagtgattacttttcaaaagaagacatacacatgaccaacaggcatatgaaaaaacactcaacattactaatcattagagcaatgcaaatcaaaaccacagtgagacaccatctcacactagtcagaatggctattattaaaaactcaaaaaataaaagatgctggagaggttgcagagaaaagagaatgcttatgcactgctggtgggaatgtaaattagttcagccatcgtggaaatggtttggggatttctcaaagaacttaaaatagaattaccattcaactcagcaatcccattattcggtatatgcccctaaaaatataaatcactctaccacaaagatgcatgcacacatatgttcactggagcactattcacaatagcaaagacatggaatcaatgcaaatgtccatcaatgataggctagataaagaaaatgtcatgtatatacatcatggaatactatgcagccataaaaagaacaagttgatgtcctttgtagcaacatggatggagatggagcccatcatcctaaacaaactaatggaaaaacagaaaaccaaatacctcatgctctcacttttaagtgggaactaaacattgagtacatatggacacaaagaagggaataacagatacctgggtactgtgcttattacctgggtgatgaaataatctgtacaccaaattcctgtggcatgcaatttacctatgtaacaaacctgaacatgtatttctgaacctaaataaaagttactttttaaaaaagaaatatggtaataaaattaaatccttacagtttaaaaatacatatataaaatgcttcatgaatttgcatgtcatctttgcaaaggggcaatgctaatcctctctgtatcattccaattttagtatatgtgctgccaaagtatgaacaggactattaagttgaggttattaggtcatggggatcttcccttatgaatggattaatgctggtattggggaactggattagttattgcaggagtgtgttcctgacaaaaggatggtgatatggtttggctctgtgtccccactcaaatctcatgttgaattgtaatacccaatgttgtgggagagacctggtgggaggtggttggatcatggcagaggatttcccctttgctgttctcatgttggtgagtgagttctcatgaaatacgatggtttaaaagtgtgtggcacttcccctttcactcactctgtctcctgttgccatgcgaagacgtgcttgtttcttcttcacccttctgctacgattttaagtttccggagggctccccagccatgcctcctgttcagcctgcagaaccagagccaattacacctcttttttccataaattacccagtctccagtatgtctttatagcaatgtgacaatgaactaatacagatggatttggttatctcttcctctggataggttggttcctctcaatccttcctctttctgccatgggatgattcagaaagaaggccatgatcagatgtgcccccttagtcttggacttttcacccccaaaactatcagccaaataaatttcttacctttataaattttaaaaagattgttaaaagaaattttttaaataactgaataaatggaaaaacactccttgttcatggattataagacttaatattgcttaaatggcaatattccctaacttgatctacagagtaaatgcatttcctatcaaaattcacttagtgtagagattgacaacatgcactggcattaatataaaaatataaatcaatggaatagaatttatggtctagaaataaacctatacatttatggtcaactaatttttgataggggtaacaagttaattcaatggggaaaggatagtctttcaacagttggtttaggacaactacatgtgaacatgcaaaagagtaaacttagacacctacttcacaacatatataaaattaactcaaagtagatcaaagatctaaatgtaaaagctaaaactataaaactctaggacaaaaaatacaggagtaaatctttgtaaccttgcattaagcaacagtttcttagatatgacacctaaagcaaccaaagaaagaaaaagataaattggacttaatcaaaattaaaaacttttgtgctgcaaaattttaccatcatgagagtaaaaggacaacgcagagaataaaagaaaatatttataagtcgtatatctgataaaggtctggtatccaaaatatgaaaaaactctaacaaaccaacaataaaaagacaaataacctcatttgaaaatgggtttcccaaagaagtatacaagtgaccaataaccatcgttcttgagtcattcctattcaatgaatgtttaaggtaaatgtttaataaccagctctttaaaagatttcctgatttgtagtgactgccaatttctgtggtgtaaatactctcacatggttgatttcaagctagcaacatggcatcactggatgtggagttggaaagagaggcttgcaaacaatttttgtgagccagtgcaagctggctccagcacttcacttcttataataattttaaatttcattttggttatataaactcttcctgatgcccatgtttgttgatttttaattcaggagcattcatgctctattagctaactaatcttacttgttttttgtgactagtccttacttcatagtagcattttgccactgaaagatagtgaagttggctctgcaagtccagattatgaactgagtggggaagagtgagcagtgtactttgtaagcctttcatgtcacttcaggtctttcatgtcacttcaggtccacctgaagtgatgacttaatgcatgttaataagcaggaatcgccactgaacaaactcattttgcattcactattcacagcaatagaaattctcgtaatgtaagtggaatataacataaatttataagtggactttcaaaattgttggttattaactttgacacaactgcaaattggtattcaagttaatggcaaagaccaaaccaaacaaaacaaaaaatagcatatacaatcttcaagtgcactttcagttgtatccaattcaactttaactttactctgtcattttctattgtatcttgatatgaaagcatattagttagatttctccctttcatgagcttttttcttgcttgtcaaaagcattttaaaaaattttcaaacagtatatcatatattaccttgccatcctatattttgattatacttctgttgaaaatatggtaactttagggctgttcacaaatcttcagccacttctcattcctgcccatttctttgcactgccttgcaccctttgcaggtaggtatggccttgggatttgctttggccagtgaattctgagcagaaatacatatcgcttagtgcgaggctttaagaaacatcacagaatgccctgtgtttcctttctctctatggtggttttcgaagtttctatcagtgggatcccaaagtgtctttgatgcgcagagctttagtggcccatttgcatcagaattgaggtataagtgagaagtaaattttcgttggcctagccattgagatagggtgaagagtgagggggaaggttattcttgcagcacaatctagccccgtctaacaagtacaataattaaatcttgttcaaatgtttgataagataatgcccacaatagatttgtttcataggtatgaataaattcataggtatgaaactcacaggaatgatatgagaactatgcatattctttttcattcttagcccaaatatcttggcatttattttacattgtatttatccagagtattctccctgttagtattacctaacaacataccagtaaactgaaaaaaaaaaattctgttctagcctcagggagagattagggagggtacctaataactttagagagaattccatgtgataaatgaaagggagagtatagacaagattacagccagtatagctgggattacagccatgtaccaccacgcccagctaatttttgtatttttagtagagacggggtttcgccatgttggccaggatgttctccaactcctgacctcatgtgatccgcccacctcggcctcccaaagtgctgattacaggcctgagccaccacacccagccaacaagacccaattatacagacatcagctacttacacaataatcagttcaatcatggtacttttaaattatgaaagaattctatcataaacccttagccatttaagttttgtagggggaaaatgccattcattcaacagtaagtgcactattacaaaaaaaaaaaaaaagaaagcaaagttgcttttttttttcgagacagagtctcactccgtcacccaggctggagtgaggtggcaaggtctcggctcgctgcaacctccgcctttttggctcaagcgattctcgtgcctcagcctcctgtgagtagctgggattacaggcgctccccaccacacccgggtaattttttgtgtgtttttagtagagacggggtttcaccacgttggccaggctgggcttgaactcctgacctcaagcattccgcccacctcggcattccaaagtgctgggattacaggtgtgagtcaccacgcccggcctacacaaggttactttttaaagacaaaggtaaacaaaaaattagttttaaaatttccaaagtcagatttttttttttttttttttttgtcctaaaacaaaaccaaccagcaaaacgctcaggtcgcaaccgtttataaatccaaagtcaccaccagagggagcaactcacctggtttatctctgatttcgctcctgtaatttcctaaggcctgattacctgggaggagatctgcggggacagtagtttttagacaccttatgctcagatctcaatattcaaaaattttatccttggaataccttccacactaaaataatttgtgcctaaaataatttcctttttttctttcttaaatagcagctggagtttgcaaagagctcttcccacagaaacccaaggttgccttcctgcctacccgaatcttggtggacatacagggtttatgatctagggaagccccaaggatgtgagattcctctgtaaatgggtcataggacttgttctgattccgttagaattagcaggctggtataacagaaaactgcagtaaaagtggtttaagcaaaagagtagtttgttacctctcacttaaaagttcagtgataggctcctcagggctggcattgaagcatcagggactttggctccttctgtctgtcccaccgtctcagttcatgacttccaaaatgactgctggagctccagtcatcacatttgctttccagcagcaagaaagttttctcctcaccacatccttagcttcaatgggtcttcacctcctctctgggggtgacagggcttgttatccctaccttagtggtttgatgcttttgtttaatagaggataagagtctatttttccactctctttctccatgttttcaccactgagggaccatctctcattgctcaatccaccttcagtctttctcataagcacctggtggaggtccccgggaaagagattaaaagtgactgtgatcattccttttgtgtcctgggatcccagaagtactatacggtcatgctggcctgcacctgacctttaacaatttgttaaagtcttagctgaattgttcttgacacttgtttggtattccatagctcttcctcctttctgtgagacaggtgagctggtgctcatatcccaactctctttggagtggccttggattctagatgatttgggtgccttgcaactgcagctctctaatagggtcaggaaaagttatggctttgcagtttacctggctttgtcttcttgtgcgaatgggagctgcactcatttgagcttcctacatctggtacataaactgaacttcagaggccgtatgtgatgatgtagtggctgagaattttccggaggtttgaaaagtcattaaaccacaaatacagatcatcataaaccaagcaatataagcaaaaaacaaaaatcctcatcgtggcatattgtagagaaattgtagaatacaaagcaaagaggaagcagccaatcatttatgaagaaatttaaatagcagacttgtcaactgaaacaacacaagccagaaggtggtgaaatcatatcaccaaaatgcttaggaaaaatcactgttaaactaaaattgtgtacctgacaaaactctgaatagtgagagttgtattagggttaggttcatctataaagaacagaaaaactccaaataacagggcttaaaactgcttcaagtaaaaatccagaggtgtgttgtctaagaacgaatggggtccgtgctccatgaagttctcagggcctcaggtttcctccagctcaagatgtggttctttttttttttttttccagcttttccagttttatttaaacacaaaacatgaactgtgtactcattgtcttcgctgcacagcttggcattggggttggtgactctgatggccagctgagcagctctttccacaatggctttgtggtccttggaggaaacattgtgagcgatctcagcacagtaagatttgctgcgcatcagcagtacttccagctccttgacgttgtggaccaggaaattccagaagccacttggcagcatgtgctttgtttttttgttgccccataaccaacgttgggcatcaagatctggcccttgaaccttctacgaaccctgttgtcagtacctccgggtttccgccagttaggcttaatttgacgtatgggtcagactggtgccatatgaacttcttggttcgctttttgatgatcttgggcttcacaaggggcctgagggcagccgtgatgccgaggaagagatggctgccacctccataggcagcaccgaggaagagagaggggcaagatgtggttcttctaccaccaaggcaatgttcacaatttaaatacgtcttttcttttaggaaaaacagtggtcctagaagatgaaagtaatttttttctggtaaaataaaaatttggcctatgtcagcaatgtgacatgtttcatgaaatgctattcatctgaagaatccacgtgtctggaagccatgcctcaaagtctagaatgaccaaggcttaaatttacatccagtggtggtgggagtgggaccagggcctcttctctctttttcctttagactgtaggacatctgaaagaatatcaaagcagttgtctactagtcttcccaggcttggagacactgcttcagtcaccatcagttacttctatcattccaaagtgtgcactaagaattcccctctatatgctcctaattgttttgctccatatttcacagctgcccaagcaagtcatgctcagagaccatttgatttcaggagcttctactgctcccgggactgaggactgactgcccagggctttccagagcccccaccaccaagtccattctgagttaagggttaggaatactctgagccattgttgtgattggtcttctcagagagatctctggactgtcaccaggcaccctgaggacacaggagagagtgaccagagtattgatcactggtcataggaagacggatttcctcttattgtccttgttcatggacccctgggctgaaagaaaggaacagagacagagcaggaaagaggaagatcaggaagcaggaacagagtcagaggaaaattgcaggcttgatgggaaggggcaggcttggggggctctagagttattgatttttcagcttgatcaacttttacttgttaggatggagtgacaattttcaagctccttacttgccagactgggagctggaaatcctattgttttttacatgcatttaactttaatcaagttaccataacacctcactgactccaaaataagtttctatctcagcatggcattctttctccacggactgacccacccaccactcaaccttatcacttcttatgcttttctaagaaaatagcatgggacctacaaaagagtaaaaaactgtcaagattttgaagaatgctctatccattccagccttgcagcctcaaacatgcaaaagtcagccacacgtgtttgttctgttgtgtgatttaaccctacatgtagaaatggaaatggaagagaatatgacatgagaaaaccaaaggacatagcagtattatatgttcctaaatgaagctgagtttatgtgtgtgtgtgcaggaatgtgccttcacgtatagctcacaggtatgcatgtgcatttgtgtacctatgtgtgtgcgtgtatgtgggttagcatgcatgtgtatatgtgagtgtgtctgagtattcttacccccaatgctccaaacataacattgattaaagtccacagtgagtgagctgagtttgtggggtcctctgtaaaacagaaggaaaaatccattttcaacgagagagggatgtttgtgagctccccaagaacacgctggtggtcctagggcagcaggatggtaacctccagggttcttgacaacaacggaccagggaagccaataaaggatctgtcagtggtctccagggcctgcaggcagtgcctctggcaggccatgctctctggtcactgggaagatggacccttgagaaggtcacagccatcctctaggctcagctccaccttggtgagtgtcccataaggtcaagccaccctcacgggatagaatatgagctctccaagccaatttccaagacccttgggctctccttttctcaggtacctccagtcccaggagtggtggggggaagcagcagaccccagtattctggcctgggagtcacatagcctctagagagctcaccagagcagagtagtttagcaaaagtcaacttcccattcccttcaggatcagtttgcctattgagaaatgtttctgggaaacctatttaccaagtggaatggtttcatacaaaatactacgggtatagctcttctaaagattttttcaatcccttaggtatctttttctattggatataattttaaggagtgcccacaaatacattttgaactagtttttacttatttttctacttacactaagtacttatccaacttttagtataacatatgcaagttatcagacttcattaacccttgttgagtggtctagccttttttggggttaaaaaaattattttctgggccaggtacagtgagtcatacctgtatcccagcactttgggaggccgaggcaggaggatcacttgagctcaggaatttgaggccagcctgggcaacatagggagactccatctttacaaaaaaaaaattaaaaattagtcaagcaaggtgacacatgcctgtagtcccagctactcaggaggctgaggtgggaggatcagctgaacccagaaagtcaaggctgcagtgaactgtgattgtgccactgcactccagcctgggcaacaaagcaagaccctgtctcaaaaaatatatattattttctgtatgacatggctgtattaaaaataaatgaataaaatgaggaaagaaatatatagattcatttacacttctaccgtagttttcatgacacctaaatcacagtgccattgctgtggagtcccttgcttgcatttataatccaactcggcctcttatgagctgcctgagttgagtgatttacaaagcttctctaagtctccatttctcagttctaagtgtttagtggctccctcattgggtgttttgaagattaaatgaactaaccctttcaaagcacttacagcagagcctggtacacactaaataaatactcaactaattccaatttaggaaatacttattacctactgctatacatcaagcactgttctaggactggggatatgggaatacaaggtaaacgaagaccctgtcctcatagagcttccattctcatggaaggatggagacaaaaaagtgagccatacgtcacatggggacaactgctacagagggaaagggtggtggagagagagaaggtgcacagggtttgtgctacagcaactcagataagctggaactgcatttctgaggatccacttacctctatggctctgtgttgggtttgcaagagaaactttcatgagatttggaaggcagaggtgaagtggcaggtgcgatgttctgaaggttagtgtaggtgctagggtctctcaggtgcattgttgctcaactcaccttgttgacatgggcagcacctgcctgtagctcctcctactcagcctccctgagtcctgcccagcacatgtgcagctttgcagccaagcagcagaaaagacagaaatgaaggcagagaggcagagctacaaggtgctcacaaatacctattttcttctcttcctagacgctcaggtagacccatcttagcccatgcagtgagggcagaagtgatgggcactgttccagacctgttccagacctggcctataaacacacccatgtgccatactttctcttttctcatccactcctggaggcaaagaactctgaagacctggaggtcagcagagccacaggacagaaagcctgggcccctgaatggtcctgcggagtccccatccattagacgagtaagaaatcaacttttactctctgagatttggaactatactgttaaaggagctaagattattttagttaagataggcagaaatcaaataaatagagaaatatatgtgtgaaagagagaagagggagtgaagaagaaacaaaataaaatactgcccttgaaaaaaaaaaaaaagaacaagatatacaaatctgtagaaagactaatcaagagacaagtttaaaagtgcaaagagaaaataaagagaacaggccaggcacattggctcacgcctgtaatcccagcactttgggaggccgaggtgggtggatcacttgaggtcaggaatttgagaccagcctggccaacatggtgaaaccctgtcgctactaaaaacacaaaaaatcagccaggcctggtgatgcatgcctgcaatcccagctactcaggaggctgaggtgggagaattgcttgaacccaagagacaggggaggttacagtgagccaagattgcgccactgcactccagcctaggcaacagagcgagactctgtctcaaaagaaaaaaagaaaagaaaagagaacaaatgagaaatacctgaacacccaaaagagactttcacaataacaatactatgaataatcatacactaataaattgaataacttaaataaaatggatacatttctggaagatataaaatattaaaattggtgttgagattaaaagcttgactagagcaacaacaattcaaaaatcaacatccagtcatataaccatctcagctgctagagaggtgaggggagggcaacttcaggcacagaagaattttcaaggtatagatatttcttaattcatacaatttattccaggaaatagaaaagaggggagaagctgctcatataatttctgtggctagaacaatattaataccaaaaccacacaaggaccaaataagaataatgggttatcagcccatttttatttatgatcatagattctgtaatctaagatcatcgttcagattctcagggaaagatggcagatggaacatacacctttatttctgttcgctcctaaaacccacaaaaatgaacataaagaaatgcaggaaacataggaacgagggaaactagaaggtaaaatagcaagaaaatttggggagctgaaaaaaatatataagtaagtgggaaatgacttagaagtgagaaaacagaacctttcatcagagttgaggaaggcagaagtcaagtcttatttacacaacagtattgccaagatggctgagaaagtggaggtggtttaggggagtccgattaagaagaaatggtagaaagttgtttaagaagcaatgaggaacccagatccccttgccactttctgtagatgagcgaccttgacccaccttggcagacaactgggaatgaatgccttagagaggttgcaaagaaggctgggtttctgtgtgtggtagggaaggggtgggcaataggtataggtgaggatggtgacaatgtcctgaaaaccatgggattatgtgaagaacatgtaccagaagctgagaaacactccagccctcttctcctatttggattccagaaagttggcagccagatcttcttcctccagacaagagatggggtgagtcttccctggggatcctgagcagcccaagagagaaggctgaatgatattgacaaggcacttcctcaagcaaatggccaaggagtcaccctcctgtgaaactcccagggcaccagccccactgtgggctcacagcatccaattatctttagaattttgttacccaggcctgagaaaaagctctcaagtgaaagagaagaaagaaactaaacagagaatagtgaaggcaactgggaagaaacagagaccacctaaggaaccataaataaaaacagaaaactttttctccaagggctgtttccaaaacagagggaggcagagagagaatgagaacaacagagaaatgggagagaaaaaaaaagaaaaagacaactgatccaggaggtgaatgcttgaataaaaggagttctagaaagacagaacatagaaaacagagaggggaaaatcatgcatgaactaattcaagaaattttcctgtgaatttctagatcgaaaaggccactcactgtgcggagcaaagggatggaaatagacacactccaaggctcatccctgtgacattccaggacaccgagaacaaaaagaaaacgctgataaagtgaagacaacagatcacatattgccatagttatcataattgctcctgacttttcaacaacaataggagcaagaaggtaacatagcaatgccttcaaaatcctgaggacaaattgtttccaactcagaattttttatatcagtcaaactgtcatggtaaaacaggcatttttaaatataaaagttgtcaaaatgtattttccattccccctttctcccgtagttactcaaggatgggttccaccagtacaaaggagtaaacaaagatccaagaatcaagaaaacgttgtagaggagacaaagagaagccccagaaacatgaggaagagacagctgtgtaccaactggtggaggcagtgcatccatacagggcaaaaaaaggctgcaggcatgactttttaggaagatgctcaacaaaatacttgctgagaaaaaaaaaaacaaaacttagaaatgctggttccaaaacatgtgcttttgtttgtttgttttttcttgttctgacttttaattcattacaccactgctctccaagaaaaggctatcaattattcccttccaacaatgcataagaatgactttttccctacttctccaggacagaatataattatcatttattttaatcttttttgaactgttaaaaagataaactgaggcacagtaaaattttaaagagttttggtgagttttttttagcatgaacaatttatgaactgagcagctccgaaccagaaatagtttgggagctccactgaggaacacaaagaggagacttttataagacagacacagaagtaaagcaaagtatttaattggttactgttatacaattgctttttttggtctctcaacttggaaagcccctcgttatctaagtttgtataaatagtaacttctgattggttgagcttaagttctgcttttaaaaatatatatatagatatagatatatataggcattcacaagaaatagctcaagttaagtttggttatgtttgcaaatcaagcaaggtttaggtcacttacaaatcataacttcttttgtcccctctgggattcttcaggtctggtctccattttaatttactttaacaatcccaccgctttgggtcaccctctcagcaagctaagaagaaggtggtagcattcctctcagttaccactagtgaaatagtcactggaacaaagagtcatgtaatcttatcctcaacagttgtattgggatataagattacatggcatcattacctgcatcatgggcttcagtggtagggttgttgagttcttcaagtcaattaatgatgatggcaatcatttgatgtgtgagtgccttctggaaagctttgaaatccttgagaggataagatatagtaggatggtaaacaaaatgactacagagagaataatagccaaggatttttaaattccctggagcagagattcccaggagccaatatttcaccaataaaataaatcagtggaggaggcaacacctgtctgataaaagatatatttgttccttaagatcctttaaattgggctcaacaatttctaatttattaatatagaaacaatatttttttttttacaaataagagcctccttgttaagttgctaaggtatcaaggacttctattttggagtactattgaggttaaattgtttatttcagatagtattgcttgaagggaattcaaggtagcattctataaaaacaaaagaaaaaaaaaaggttaacattaggaacaaattatgatcttagtctttaagtccagagagcagcctgtcaagatttctaaatttgagtttgaagcatttttagatgatggaatgaggatggcaattgcaacctgatggattttcctggcttgcagtttgaatgtctctggaaatatcatcaggtgttccagtgaattctccaagtgacccacacagcagcagcatgaaaattttccatacatggtctgttgtagtaatttttctgaatttaaagtcatccaatttcagctggcagggcttcggaaaaaagcagttttagtttctagtgaaactagaaaatgttaggattcaatccaatttacaaggacataacaaagaccagaatttgatgatgggtgctatagttttctattgaaatacaatcttttttatggtcattccaaatttttccaaaaataatcatggttaactcttctttttgtgcaaaatcagtagtctcattaaacttgatctgattatttacataagtgcaacaagaaaagtgattctatgtatgcatatttttaaaatacatcattttgtcaaagttttgataatatccaaggggctttattgactttgtataagtcaatcttagttatttgttcattttattgtttgttttactatttgttaacaaggaatctcagattagacctttaaaaacctctctaggctaggaggccaagttaaggacttacccaattatgtcttgttataagaacagattcttattgaacctatgcaaatacctatattgccatgaaaataagaatattcaataagtgcttccaaattatggggtgatcaggtagggaggaaaaaaacgttttctttttgtttacaaaagtatattttatcaaattgttttaagttatagaaaaaagttttcctaaatctagaaagcaagacattaaagaaccagcaatgtttcaaacgaaaagttataaaaattataattattctcatcagttaatttagtctcacataattaatttttgttttgcttgatcttgggttagcagatttataaatacattacttttccattagaggtctggaaattcttacctagccttatagtatgagcttaaaattatcagaaacctgtactcatcagcctttatcatgaatctcttacaattctgtgtcatgcaactgacaagggagtttggttgctttggtaacatacgacattttaacataataattaaaattatggatgataacattatactagtacatatcagatttctaggaatttgacataatttctggaacactcatcaataacaaacataacttaaagaaggtttagcatcacccattatttgacattgcttctcatgcaatttaacatatcaaataagcctcactagtttaacatgtctgtttttacaagaagagaagataaattcttttgagatattccagggacccttttggacactcccaaagttggtttgaggtcaaaaagacctatatggcatggccagttctaggggtaaggttgtgtccatgccagtgtgtggcatatggcgatgttcagctagcatgagtctgaattaattaccacacataggagccagagtaaagtgttcccaggccatctacccccaaccaatgtccccacttattactgcaacctcttacatcttctataacatgctccaaaaagtacgcacaacagtaatcccccaaatgccaaataccacattatttcacgttgaacagtcttgttagtgcatgagttcgtgtgcagcacacgtggtattgtacacaaattatatttcccttctacactgtaatgaacatggagtgtgatgtaaataaccatggaatactgagttaaagctagaattttatctaaattagacctgagtttgtcgtgcccccaggtgcctgacagaactaaacagtgagaaccccagaaccctttccaatggggaacgtcagaggcaccacagccacggaccctccactctctcctgcactcattgcaccttgactgtcttccttggtgcttgcagacgtttgtcatagtggatttttttaatcagatcgtgaattttgggcaaactttctacagttcgtgggagtaaatgtttgaatggtttgagttcagaccgtgagacagatctgcattttccattctgaagaggttacacatgagctagcagatgggatcgaatttcaattatacggaaacaaggtagaaaagaagggacctcaggcaaaagagtaaaagcaagtttgcaacttagagtttacagtggctggtcacaggagtatctgaccctggaattcccaaacttctccgcaccttagaattacctgaggaatatttttaaaatgccaaagcccaggccacacccggaccaattaaattaggcgcactggggtggaatccggcatctgcatttctgaagctccctagatgatcccagcatgcagaggagtctgagaatgactagtctaatttcatttccacaatatgcttgtgaagcggtcgccactatcccctgtgattcccttaaggttccccccagtgaatttgtggcatcaggagcccagcccagcactccttccgctgcacgtgccgctgtcctggaggacaggaagcagagccagggtgctgcgtacgtggctcttcagagggctcttcagtgtgcctccaagggcgcacagccgagttgagccgtctgattacgctccggggtgatggacaggctgcccctgccccctgctggccagaggctgctattgcagccagcgtgcacacgcgtgcgcgcatcttcagccacctgcagtttctctgattcttccctggtctcctctctgcagtgtcgccagaacaccttcccacactctattctttgtggcccttctgactttctctttgccgtgtgacaggggagtcctccctaaccagcagacagtgaaggtggagtccacgtttctcggcctccacgcatagcgagtctcagaccccgcaaggctgcagacagtgctgtgtaagtgggccttcagtcctgtggggagcccaggttgaatccccaggaatagaagctccagaggaaggtccccaatcagtccgtggtccccaatcctgagaagggttgccttttctgggaggagcctgggtctcatcgctatgcgggaacagggctctgggaggtgtccaggaaatgtgagaccggaagtcgccgtcagggaacggagtagtctgtggccctgttagaggaaacagccctggggggtccccaattgcttctagaatctattctgtttactcttctagggaatacctgtaacttctttccttggaaccaagatttagcacatgagaagaatctggaagaagctgagcccacaagggtcccaggagggcattctacctgcccactgaccgtctcagcatgctacaccctcgagggaactcaggttccctgtctgtaaaatgcagattctctcctatgaaatctctgaggtgaatagctctggataaacttcagtggccttcttttagatgttttttgtttttgttttttgtgggttttttttccccttgggtcttcctgcctggggccctctgccctgggtctcctgcagaggttcccaccagctcaggaaaacactcaagggtgagtgtctcagagctcaataggcctgagttcctttcccaatacctcctaccactccctggacatacacactagcacatacatgcacacatgtgtgtgcaatcaagctaatcagagtggggccttgattgagtcagagctctttgcactcctccacatgtcctctacagtgtagcactaattctgtgtcctccggggtcagggccaggtgcagcaggtgcaacccacattgcaggtgaaacctgtgagtgaaggagcctggtgggggctcttgctgtcatctaggtggaaggagatgaagatcaggcagaggaggccgaaaaagatctggagggtttggtgacaaaggaaaagatctggagggtctgtgacaatggatttgaaagttctttgtcactttcaagttctacacaaatttgggacagacatcatatgattctagcaccattgtctcagatttcatagctgtcaaaattttacaatattctacaagaagcaaataaaattaccttgcatctttaagtttagaatttttctttatattttttttccattttgatcattgttaggtttgagccccagccgaggtccaagggagcaggtggacaggagggcagggagctggaagaatactcaagagacagcaggtagatgagacatggctttattcagcagctcactcacactgtcggtgctgcatttatgcacctcacaaacaatagtggctccaagccaggcgatgagcctctccatgttatggctacatagctgtgtttacattatacaccagactgtgtgcctgtgctacagtcccgctgagtcatgcgggatgtttacctcggcctatgcctatgtggctgcagctcagccatgttccttacaatcatcataagggtttaaagcattgtttggggaaacccaggcaatctttttttttttttttagacaaaatctcactctgtcacccaggctagagtgcagtggtacaatctcagctcactgcaacctctgccttgtgggttcaagtgattctcccgcctcagcctcccaagtagctgggattacaggcatgcaccaccatgcccagctaatttttgtatttttagtagagacggggtttcaccatgttgatcaggctggtctcgaacctctgacctctggtgatccacccgcctcggcctcccaaagtgctgggattacaggtgtgagccactgcgcccagccccaggtaatcattttttgagctgaacttgccctttactttgactctgcaagtgtgctacacttgtagctccttggcaatgaggttgtgaaaacaagtccaacacacacaggataaggatccatcattcttgcatatttagcttaataccaggtgaggctctccactcctctctcatgctcatttccctctccaggctgccatctgctaaggtatgcggtcccctctaggcccaggtcacggagcccgtgcttcacctgctggtgtctcccctcacccagcctccagaccccaccaggccagccgtgactgtcaccacctgatcatcttcactcttagacacaagaaaaaacttccaggttttgcatttcaggagttatgactttgggatctctatcccttgcttaagaaacccatgaatttattttttataatttttaccatgccagtgtgggtgggagagtaaaattccccacctcccaaggacatgtttcaggaaataaggaaacgataccagctattatcagatcctgacatttcactggggccctggcctgatcttggggacaggagacaggtgcacaccagcccaggccttaagtccactcttcttacttcattcaactcctctctttcttctcctccagctcagagaatctttatttggtctagggtgttgagggtaagactagaagagctgtttcggttcgcacacatatgggaaaatttctactcaatgtgttgagctacaatttacttaaatacatatatccatatatcaatcatcattatcaagatacagaatgtttgcattacaccaggaagttctttcacatgcctttacaattaatacacttctcccaaatgtctttcaacacgtgaacagataaacagatagcagcacatcacacgatggtatattactcagcagtaaaaaggaatggtctatgatacaccaacaacatgaattaatctccaaaaccttagaccaagcaaaagatgacacatataaaataatctgcactgtatgattccatgtatatgaaaatttgttacaggcaaagatcttctccagtgttttcgtttgtttgttttgttttgttttgtgtttgtgtgtttgtttgttttgagacgctgtctcgcacagtcgcccaggctggagtgcaatggcgcagctcactgcaacctctgcctcccgggctcatatgatactcttgcctcagcctcctgagtagctgggattacaggcgcacaccaccacaccgggctaattttttgtatttttagtagagatggggtttcactatgttggccaggctggtcttgaacttctgacctcatgatccgcccgcctcagcctctcaaagtgctgggattacaggcttgagccaccatgctcggccatccagtgtttttatctaaaagttttctagtttgaactttcacatttatgactataattcatttagaattaagttttctgtatggataactagttgtcctagcaccacttgttgaaaacactttgcttttgtccgttgaattgctttggtggctttgttaaaaatcagttgcccgtatatgtgtgggtctatttctggactatctaatctgttctatttatttaactgtctgtccttactacagtagcacactgtcttcattactgtaattttatagtaagtcctgaaatcagaggtgagttatccagctttgtacttctttttcccattgttttggctactctgtgccctgtgcatgtaagtttcagagtcctcttgtcaatttcaacaaaaatgcctactaggtttgtgtctgtgacgtaacctagtattgagtttatacatcagtttgacaagaattaacatcttaacaatattgagtctcccagttcaggaacatggtatttctctccatttatttagattttctttaatttatcttatcttcctggtgtaatgcaaacattctatatcttgataatgatgattgatacgtggatatatgtatttaagtaaattgtagctcaaaattaagtagaaattttcttatatgtgtgtgaaccgacagaaacagctcttctagtcttacccttaacaccctagactaaataaagattttaatttaatttatctcatcaatattttatagttttgaatgtataggtcttgcacatattttgttaaattcatccctaagcatttaatggtttaggatgttgttttaggtgtcattttaaaagttttcatttgtctatggtacactgcaattatatagatagtccatttgagttttctatattgaccttgtaccctgaaacactgctaaatttcagtattggctgttatagctttttgtgtagatcgcttaggatttaatgtgtatacaatcatgttgtctatgaataaagacaatgttccttcttctttacaatatgtatgccctttgtttccctttattgccttatcaagtaattaaatctccagaacaatattaaagaaaagtgctgagagagatagccctgccttttctcctaacttagatggaaatgatggggtctttcatcataaaaggtaactctgactataggtattttgcagataccctttattaggaaaaggaagttcctttattttcctagtttgcttatagttctaatttttctaatgttttcctacattttttgatatgaccttatattttgttttctttttaatatcatgaattacactgattgatttttcaaatgttaatccaacctggagttcctgggataaaccccatctggccatgtgtattaccttttttatatactgctaaattcagtacacgaatactgtgttcaggatgttcatgagggacattggtctatcattttcctttcttctaattccttttcctgccttttgtatcaggctgatttgagccttataaaatgaattgagatatgtttctagttttcttaaagagtttaagttcaatattagctttttcttaaatatttatggcattttgtcttgctaaagactatatttctcttgaagttggaggccaagatgacttcactggtaaattctatcaaatatttctatgtctgaaatggttatttttgttataatggattatcgtttattcgaaatgtttaacttaaaattgactatcacattactctatttctgcatagggtttacttttattataagtttattaggttttctttacctgcttattaattttctgtctcctgtctgccttctccatcctaccaaacacccttctctgaatatgaatataagctccaagagtgaaggaaacgtgcccgagctctccatctattccctgtgtctggaatggcagactcaataagcatttgttgaatgaattgtaggaatgaatgaagaaactccttttgttctcttggttttcagctaatatgcttgagttttcggaagctggaagaaacaaggcatggattctcctctagaaccatggggactgtgcagccctgccaacaccttgatcacagacttctggcctccaggctatgataggataaacttctgctaaggcacccagtttgtgatcatttgtcacagtagacttggaaaacgaatacaccaactaattaatatttcgattattatgtaattatagaaatatattaattcataggttttctcatatactttatttttataatttccactagtttttcattcctaaaaatatatagatgcattccttttacaaatatttttctagcagcatatttattaattacatttgatttacattttttcacctttctggatggacattcttactcttcagtatttgttcatgttatatattttatacgtgcacatactaaaatataaatatgttcttgtaaaatatttaacattttatgcatgttttaatttatgctaattacattgatataaatttattaatttatattacaactaaatacatacatatcataaatgaaaattattagaaataataggagagattgttaatttagatatatataagattcatacacaaaaattagttgcatacatatgaacaaacaacaagcaattacaaaatattatttgataaagacaccacttttggtcaccttttaaaccagaatgcaataattatttaaactttggacttgtcccagtacttactaccaccatttgtcggccctttaaaaaaatgtaactaccagtggattgaagtaaatattcaaattatttctttccaagaaggacattagtttctatcatgtgtaacaccatctggttgtcttcacagaggaaggataatagtgagacttaagagccttggatgatgctgctccttgttctctgtagaaattgatttgttgtcttctgatgtttggtgttgcagcagaaagctctgaagccaatgagacttaaaggaaataactttcttttctctcctgtcctgcacatggtaggatttgtcctagataaatgtggcgggtattgctatcgcagaacatctgtttcccctttatctctggacaaacagaagacttgtgcttttcagctccttgatgatctgcttggctaataaaatatgagtggaagtgacagtcgcacttccaggggaacaatttaaggaccagtgctcaaatttccagcactctcttccccttccgtgacaatcaggcaagcaggcattgatgtgcaagtccataaaagcaatgcacctcaaatcctgagccaacccacagaggacaggacctctaccctagagagtcatccagtcatgtggtgggcttcccaggactcagggaaaaactttatgtgaactcactgaatggggattgtttattattcagatggcctgtgctggaagacacaatttgcatctcaaattagtaagagcttcacatatgtcatccttcatttcagaaaatcttccttccattaagcctatatttgttgcttgtgtttacattcttccggccactccttcagaaacacccttacatataggctgcctctccattctttatcatcttacctctctagggtcagcaaactttttctgtaaagggcaaaacagtgaatacgtcatcgcctctgccactgtggcatggcgcctttcacagagtacacggaatgaagaagcatgtctacaataaaactttatttacaaaatcagatgtcaggctggatttggctccagggctatagtttaccgaaccctgctgtaaaaggaggaaatcaacaaagagagcgttagatatgggatcaggagagagcactttcaacacgggataaaagctatgggagttatcaaggagatggcgaaggggtatctcagaaagggatatttcagctgtgctgaaagcatagaggaaaattagtccagattgcggcgggaagacattagaccacatggggctgtgctggaggaataaaaccagtcaagaactgatatgtatgaatatgttgacacaaaatttacattgttgatgtagagtttggaaaggaatgaatgatggcacataaaatataaagcaaattttataaataaggcaattaataatttcacagaaataaaaagtagtatcaaaaagaaaatgtaatcataataaaccacatgactagggctaagaaaaatatttacattgtcatgaaatataaaatctaagtattaattgtactggtaaatgtatctgactgcattgggaggctaaaggtagggggaaaggcacaggtgtgagtggcatgaaagaggaacaagcctcacctcccgtattatgtgtctaatggagaatagctaaagctgtaaaacaaacaagtatcaacataaggatacaaatgaaaaatactttaaattgcctccaagaaaagggaattgggatgtagtgttgaagcatagaactgctgcatttttgttagtatgcacttacagcatacaatttttgaagatgtgtatctgcattattttgatgagatgttaatacttgaaagaatactgcaacgatggccaatatacacttttttaattcctagattagaatttcttagtcagagttgatttcttttctaaaatgggttttgattcatctcgccacactgtctttcagaaaggtggtgtcaattgcttttacccagcagaataagcaatcaccttttccctaaaatctcccaactctggttatcatcatttatttcaacttttgtcaatctgatgagaagagtggttttgcacttattttaataatatccgttttgaatacaatttaacattttcattaatatttcttctacagaaaagtgcctgttcctagactcatcccctttttcaattgaaatgttcattttctcttattgtttaaaggacttgcttgtctttatatgaaatttaataaccctttatatgtcaaatagggagaaaacattcacagttgtgatttgtttttaaatttcacttattgtattattctataacatccaagttttagtttgcatgtagtatgatctattatttttccctgtatagtttgtggcattgggatcataaagagaaagctctattccaccaaaaaattagataaattttacttttcttttctttcagatcttctgtgtactgctattttatgtatacatatgtataatcaaaagtcaagcaaacttgattttgtgggtgttgattattaatgacagacattaattggggagatagcatataaaaggtacttctataaatgttgtgaagtgtttactcatttattcccagaacaattatattaggggttcactaatacccattcaagaaagaaggaaactgagacttttagaggtttagcagtttgcttaaaaatgtcagagccccaaagaggcagagcaggaacccaaacagggtgtgtatctcaagagtccaaggtctttacaacactagtttgtgagttagatgccttgaaatctacaactcagggtgtgcacgtgtggggctgatattccactaaagaacagaccgtcctcttctgctgtgaggacaatttcaggaaccagaagaaatacgagtctgacatgtcccacttgctgcctagatcttatttttcaattgtcgagacccctttaaggataaatcacattaaagatattgtagttctcttaatagatctatacagtgctgaaacaaatatttttacaataaaaataagctagaattcttttacttttagcaatagtaactcatgtctattacgcaccaagcttttacatacaatatctcgtgtgatgctcacaaggattctgtgggacagatgctgtgtctccatattgcaaatgatgggattgagattcacttcagcctgcgtcctaggtgcactcctaatggctctgggtagatgggctggatgaattggcctaagatgaatgtaccttgccacacaggcactggtctgccctggagtccccatgacaaatgcttggaggcagcccctaccttggatcccacaaacagcaatgacaagggccgctggaaagcacaggatgcgtctgaaggcagctggacaagcccagactcaggtcagtggccctagagggtcttggggaaatgtccccaggggctgaacagagcctggcaatgacccttctgctccactgtgggaccctttctgcagacttgcctgcagccccaggaccttggctgtgccagaacccaacagactgttgatcactcctttactagctcccctagcagtcttcagcagctcttctcctgcccacattgcctagtggcaagtttgtttaattaccctctctgcaggctcatctcctgtatattgtgttctcacttattcccttacactttcatttccaagtgtattgcctcagagtctttcggagaagccccttaccttaggcacaggaaagccatggttcatgacctgtcctggggccaccacccacatgccccaccaatgttggccccaggatccaaagtcactgggtcctctgctttgcccatttttttcattccacctccctttttggccaggcacagtggctcacgcctgtaatctcagcactttgggaggccaagcgggcagaacacttgaagtcaggagttcaagaccagtctggccaacatggtaaaaccccgtctctaccaaaaatacaaaaattagccaggtgtggtggcaggcgcctgtaatcccagcttctcaggaggctgaagcaggagaatcatttgaacccaggaggcggaggttgcggtgaaccgagattgtgtcactgaactcccacctgggcgacagagcaagattccatctcaaaaaataaaaataaaacgctttttaatacaatatttcaaatattatattcattacacaatcaacatatatatgtatatatatataaagactttttattaaaaacaaacattgcagatgttggtcgaagtgtacaaagtttcagttagacaggatgaataagttctggagatctattatacagcgtgatgactacagttaataataatatattgtgtacttgtaaagtactaagagagggccaggcacggtggctcacacctgtaatcccagcactttgggaggctgaggcgggcagatcatgaggtcaggagatcgagaccctcccggctaacacagtgaaaccccgtttctactaaaaatacaaaaacaaaactgctaaaaatacaaaaacaaaattagccaggcatggtggcaggccctgtagtccgagctactcaggaggctgaggcgggagaatggtgtgaacccgggaggcagagcttgcagtgagctgagatcacgccactgcactccagcctgagcgatagagcgagactccgtctcaaacaaaaaaaaaaaaggactaagagagtagatcttaaatgtttacaccacaaaaaaagataagtatgtgaggtgatggatatgttaaatcagcgtgatttaatcattccaccatgtatacatatatccaagcatcttgtaatacactaaaaatatacaatttttattggtcagttataccttactaaagctgggtaaagaaacaaatattgcaacagactacagataaagttcccttcaccacttcttccccaacattcatcatagttattgccgcaaaagactgctattattagtttgatgtatagcttttcacaaacagaaaatttctgtttgtacagataagaggtttatgtgcacagacaaaccattttgagttcagtttactgtatataagtgggattataccatacatgtcattctgcagcaattattaaatttaacaagatgtttggagatctagctacgtttgcacacaagctgtattcttttttaacctttacatggtgctgtatagaagacgtggaccagaagttatgttattaattcccctgtggagatcattattataaacaatcagtgatgagcgtctttgtaaatctccttttgtgcctgtgtgtgtgtatttctcaaggatgggtgaatccttgaaatggaattgacaagtcaaggaatgcacatattaaacatcttagatccttattatttgcattcagaaatgctgaacagtttctattcccactttgaacataacacccacttctccacacccttgccaagagagtaggacaagcttttaaaatatttgtcaaattaatgaataaatattgcaatttgttttaatctgtaaatatctgatgaataaggagataagacattcttgcaaatatctctgagaatgtttatttcaattattgaaagttgctcatccatttcatgaattattgacattaattctaaattcaggtgttctgtgtgcttgtattgatggtttaccttcatgctattaatttttctcaaatgtttgagatacttgattgtcaaatagtattaatgcatagatgaattgagggaatattctcatgttggtattttgagctgttgaggcttctacttctgacattctaatttttcttattttgtttttaaccctcagaaatcaaacgtatcggtggccacttttcttgtttaacttggatttatcttttttttatttatttattttcttccatttacaaagatagggggctggaagagagaatgccagggggtccagtgggccacaccgaccctttcttccctccatgttccccgttagaatctaagcacagaaggaagaaggcctacttttccagacagtagggccttctcttggcttgcagaagtgcatttgaaatggaggtggcagagatgggataccacaccgggccaggccttgtggaacctgcaatgcattccctgcagagtgatctccagtaggcttcggagagagtaagggctggggccctgtcaagatgctgcacagggagaattcccccaggagctgtccacaggagcccctgagaaggtggaggctgaagggaggagtcagctaagggcagatgtgcagatacgtgtttgagctgggcagcctgaacttggcagaacagagcggggacagaggggagccggagctggccgtggtggtgactgagtgatttagggaaattaaagcaagaggggagatcatggaggaggaagattctcaggttgggcaaagaggctgaactgggtttggtctcccctgtttggggcgttggatcagatgcacagggagtgttccagaggggctggggacagcaatgtgggagggtcccaccacagcagggatttaggtactggtaggtgtcttctgcaggcactggatggccccttccttactcattatctcagctgtcccagagtggcaagagctgagcatcgcccctcggcctgtgctgagctgaagccttcagagacctccatagctgctgcccccagggtgttcgtgaagtgtgtgcaccgcctggccctgctcctctccaggactgcccttctccagctctgtcaccccctaacttggggctggtttctatggagcagagtggtctgctgaaggagggagtgctgaaggagggagtaagtgtctgtgtgagtgtgggtgcacttgggtgagggcctgagagtttaaaggcaaggatcttgattggcctgtaataagcaaatgagcaaacagagatgacggccaaaggatattgaaatcgatgttaaacataattttctaaccctacccctgatttttgtctcatcttctgaggctgaccacctttaccagcacagctgtccccactgtgctccatttcgctcctcctctctggccccaggccaaacccagccatactccccctgctccagcctgcagctcgggagcacatgaagggctgacagcaccaggcagcacagagaccggggccctgggggcggctgaacggggtgagggggttggaggatggggttggttccatggagtaaggaaggagaagaagcagggagaacccagctggggagatggctgcttcctgcactccctgagcccaggcctcccgcagggtgcttagggtggaagcctggttctgtgcctgacccaccctgaacttcctgtgagggagctgtgcgcccagactgcagccttgtgtgggcagtagctcaggtccctctgacctctctggcagggaaaaagctgctctgagaccagatgctttgaacctggcatcctgggaccaggaagggccattgttatgggaccattgtcatgggagcaggaataaccctgtcagggcaattgatgactgaaggatcctgctggagctggggcagagagccattggggtcagaggtataagcagacttgttggggttcagggagaagactccttggatctgcaaaaggcaagcctggatgaagagtaaggaagtgcccatggagaatctctgagcccaggaggagcaccaggtcaggagagaggaggcctgggtgctagtcctggtttggccctgaaatagctgagtgactgtggaaaggctacttgccttctctggacctcatctccctcagttgtgaaatcagcactgagagaaattcccttttgtccctgctacttctggttctatcatgggggaaatttacagctaccccttcacccctgcccagcctagcttagccctgtgctgcgttttggggatcacctccagacctctacggctccctgctttccccatttctgcatcagaggccagccctcccttcccatggacctacccaggctcggagccactgttgcaggctagactgggccttgctagaaaagcaagtacatgaagtctccagctctcccagctccttctctgggttcctgtgagtgtgtgtgacaatgagtttgggagaggaggttgctgaggttcccaagttctctgagggaccttctcagagggtgggcagggaacccagaatcccccagaaccccaggctctttgacaggactttgctgtgccctgctctgatcgtgccaagggggaggcactatccctagctcttcaagagacttctgaaagggccccagatcccaccacagctacctgccccagtccctcctgcagaaattcaacttgtgacaagggctgttgtgggtccccagggagcagggccagtcccagcctggatgaggggctgcctaagcccaggcttccctgcccccaggtcccagatgccagaggaagctgagcgtgcagatggttccagcaggggcctccccctagggtgctcaaggccccaagtctatgtggagggtgcccaccccactcacacaggtggggaagccacaacacagagagaggggcagattccccgctttgagagctcctgtcccctggggagagacgacacactctgacacagcagagaacgatacagagctggctgcaggctgaagagacacacagctagtggcacatagcaaggggtgctcttgtaagctacaagaaggagctgtcacttagagtcagcaggggtcagagaaggggaaagtcagcatgggaacacagttgctgacacacacacacacacacacacacacacacacacacggtgacgtgcctcggtgccatctgaggacagggccgccttcctccccctcgggaggatgcccccaccctgatttggtatgtaattatgttcagggagaagctgggccccactgtcggcgaggaaaccccctaaaagctcacctccgcctgtgtgtgcaattcagtgggagcctctttctcacccctggtttcctgtcatgtctgtgggtcgcatttcaaccagaccagccggaaggctccagaccgaagtcaggaggcctgttctggtcctgtgtgactctgagcaggtggctgaccatatctgggcctcagttctcacatctgtgaaaaagagaagtaatgtctccctcgcgaacctgctgagggtcttgagaaagtgtgcatgagaatgctttgtaaataatgcttgtgtgagtgagtggcgggcatcgctccctgagctgtcttctagctctggagctccagcctgctttcccaccttgggcccttgggcgccaacatctgatagccctactgtgtcctccttttgcatacccctctgcctttcccattctcagtctctgcatactcctactgtaaggagaagggcagtgtactgagatggagtggagagcaggagtccaggggcaggcaaagcagtggacttggaatcgagtccacttgacaagttccaattcccgtctcagttattacctctgttcacagagctcccggcagcagatcgccagtccagcagagcccccagtggtgcaactgcaattacacacagtgtctctaccagtcctaagatatattagctcgttctctttgtaaattgcatcgtattttaaaactgaatcttcaaagtgctgacattaactaaagaaaaatatgctagagtctttcatctgtttatgttttaattaaacaatatttctccagggtccttaagtggcagaggtccaggatgcagagatgaggccaggtcctggttcctgggctccctctaccccaccccactgatgcatcccatgctccgtgtgctcttcccaccctcccctccccgacctttgccagggaccctccctagcctcccttgctggttttgaatctccacctcctctcccctctcctttcccgcacccacgaaactcccagagtggaagcacatcactgacccaccatggaggcctgggcatgacgtccctggccatcctgtgaccagtgaggcttggggcttgtgatcagggttccaagtgcccctgagtttgtcatccaccctcagcctgcctttccctggaaagggcggcaaagctagggccctgcaaagaagagaggcagcacacagagggagcaagggggaagcagtccataactcgcccacagtttcctcctggccttttcagctcctccctcaggggtaggtcatggtggggaggggcagctgggcacaggggagagcaggcatcttctacagaggcctgggaagctgtgtgccagacagcgccgagcccaccagacccagactcacctacagctggagatccccacttccctgtgcccacagaatctgccctttgcagtctcccatctccccaacccaggcctcagcctgtctcatttttctatcagacgtgctggaagagcagcagaatcaggcccagctcccaattccctctccccagtcttctccaggtgtcccctcccatgagcgcacaggaaaaggaccacatggcctggcgagccctacacccactgctactgctgctgctgctgttcccaggtgagggggaggaggagcccagggagcagaggagatgggtgtggtggggactgtcaggacagcagggtcagggagcaggtggctctgtggccagaggcctgctgtgaggcaggttgtgcgcgtggccttgacctatgcgttacttcatcattctccaggctctcaggcacaatccaaggctcaggtacttcaaagtgtggcagggcagacgctaaccgtgagatgccagtacccgcccacgggcagtctctacgagaagaaaggctggtgtaaggaggcttcagcacttgtgtgcatcaggttagtcaccagctccaagcccaggacgatggcttggacctctcgattcacaatctgggacgaccctgatgctggcttcttcactgtcaccatgactgatctgagagaggaagactcaggacattactggtgtagaatctaccgcccttctgacaactctgtctctaagtccgtcagattctatctggtggtatctccaggtgagctctttccctagggtcctcagaggggtgcccctcacccccttttggtgcctccatcacccctggtttcccaatcgtggaagccacccatgcccacgccccagtctcctgggaaggctgttgggaacaggtgcagggggaactcatatgtgcacaagagcagccatctcacagtctgcatgactcccaagcctgcagcctgggcctcctgagagatgctgaaacagacccggtgagcatgctgaccagtcagcctatatgaccctgctacaggagggcaggaccacccggcatctttggtacatagtaggtgcccaggaaaggtgcatccactggctgcccccaccatgtagagccagtggtatctgggtagtctagataccaagatactatgggtatccctcatagtccagatcggggactaagaatgagtgaaaaaaactaagaatgagtgaaaaaaaatcaaaagaaaaacaatattttgtgacatacaggaaattcaaatttcagtgcctataagtggagttattttttggaacacagccatgcccactcaattacctattgtctgtggcccttttcatgctgtgacagcaaaattgagcagctgtgacagagaccacatggctcatccctgaccctttacagaaagtgtgccaaactcctgctcagagcagagctacccacagttcctgtggaagaggaccttctaaaaaaaaatctgcaattcacatgagtaattttttttgtaaaatacagtaaaaaaaaattactagaaaaataagaaaaagatatataaagtacaagcccaacatttattaaatttgacaaacataaaattacattttaatgaatacaatcagaacaaatatcacatagggaaaaatttataaaaactgtatacattgttcatttgaaagtgtgcctaaaggtgattgatgtagtggcttaacggtatacccataacgttttgtcattcctcagttaaaactaagtacaaagctagaagggaaattgcagttctccatattaaatgccaatatgcacccttcaaacaaacaccctgtctttccgtttttaaggattataatgtgacaaatgagcacttttcttacttggtaactttcctaatctgagaactatttatgacaccacatcacttaggagataatgtataaagaaattgtgttgattttttttaaaataatactcacagtagaagcccagaaaactggtctcacggaggtataatgtcagaaatagaagaaattttaaagcaattccgacaagctcaacagttttatatttaacttttacaaaaggaagcaagcgatgctgtaatttcaaaatgcatcttcaatcctttatcagtagccagttccaaaactttatcctaaaacttatagtttaaattatctttcgatgggaaaatatggattctagatctatgaatttcctctgcatatatcttcttctgacaaaaaaacgaaattcaaaacatgctatcaaattattaatgttttcccatgagcacttgtgaagatatgcaatatcaatattatcacttattttgttgataaatgttattaaattaagaacatgtcataacaattcatagaaatggttcttctgacttttatgtttgcacttagactttacttgccattgaaaaacatgtcgctttacttccttgcatggaaatattaacttcagaactacagtataaacaagtctgatggtacaattcacatttgtactaaactggcttcttgtcttaattaggaattcttcctatagatgaaacatgctcaacaaaactttaaatttggcatgcaacagtagctgtttatgatctgtttccatattaccacataataaagagaatgatttcaaatttaatatattcaccttataaaattcacaattctgtccatgttggtcagcacaacgttcagttaagctgcttttttttcatagtaaaactctctcaatgaaggaagcagtgcattaatttaaaatctagcccaagacttcttaacctggatgacattttcctgtcattgcaactgcagccatcagaacatactcttacataaaacttaaccccaaaccacattttgataatataaccttcatagttttatacattcagagctagttgtgtttgtgacaattaagctaaaagatacagaattccttcatatcattgtgttcaaattgcatatactaaaagaatagctatgttagcaatatttgtacattttttcaaattgccatgaaaaatactttgctagctttatttgttctaggagatggtcatccatcttgttatccaattcctgaatatgttgacctaaggcgtcaagggaaaatgatatcaagctcccttctttgctataaattacccaatgtcgtaaagcaaacgttgttcagtaatgttttggcaattgtagatggattgttggtctttgcagtacaaaatgttactttacaagaagccacaaagtctagagcttatatgtgaagtatggattcctttcaagagcttttcaatccaatactcttttttctcctaaaaacagtttgttgtgaacttgtgtttttccgttttatatgtatatgccacttgtttttttgttttgttttatttcgttttgaggcggagtctcgctctgtctggagtgcagtggtgcaatctcggctcactgcaacctccacctccagggttcaagcgattctcctgcctcagcctccggtgtagctgggactacaggcgcctgccaccacacccggctaatttttgtatttttagtagagatggggtttcaccatattggtcagcctggtcttgaactcgtgacctcaggtgatccgcctgactcggcctcccaaagtgctgggattacaggcttgagccaccatgcccagactatgccacttgtttttgttgttgttgttattgttgttgttttgagacagagtctcactcagtcacccaggctgcagtgcagtggtgtgatctcggctcactgcaagctccgcctcctgggttcacaccttctcctgcctcagcctcccaagtagctgggactacaggtgcccgccaccatgcccggctaatttttttatatttttactagagatggggtttcaccatgttagccaggatggtctcgatctcctgacctcatgatccgccctcctcggcctcccaaagtgctgggattacaggcgtgagccactgcacctgacccaactcaaggtcttcaaccttaatcacatctgcaaatttccctttgccatggaaggcaatgtcctcacaggtacctgggattagggagtagacattttggggtacccgtattctgcctaccacaatgagagattctactttcaaacaaaaccagcacaaactctttggaataactgcagaaggaaaaaatttatttagaatcagttctaccatcttcatctggcttactgtcactgccacattcaggaaagatgttttttttcagtgatttttgttttgctatctgttcattagaatgctaattaggtaatcactattctactctaacttagctaatcatgttacactctaaattttgtttaaaaaaagtttgattaaaaattaaaatgattgtaaaaataataaatcataaaattatacatctttcgagatgtttatacacttttgggctatagctaacaactttatttatttatttatttatttatttattgtgagacagagtctcactctgtcacccaggctggagtgcggtggcgcgatctcggctcactgcaacctccacctcccaggttcaacccattcccatgcctcagcctcccaagtagctgggattacaggcgcctgctaccacgcctggctaattttttgtattttagtagagacatggtctcaccatgttggccaggctggtctcaaactcctgacctcaagtgatccacctgcctcggcctccaaaactgccgggattacaggcgtgagccaccacgcctggccgctaacaagtaattttaaagtatcacacattgtaacatggctctggcataggttactagcacacagctcactccatattcgaccctccatgctaatttgacaacacccaagctggtctatatcctgttcaatgagatgagacgagttaactaatcacgggcttggatcttgaggcagtatcaaattgatataaacgttttgaaacccctactcccaatttttatacttcccttgttgtggaagggttacagacaatttgtagaccagcaccaggccatagatgacacattcaatagcacatgtctaggattttaccagagtgtcccaaacacctctcccaggctgagcacagggttatcctggccagcatcctagacagcctcagagagtgttctatgggacaggatcgtgcccacaggtccataggcctgtgactctctccagggaggaccttccagggcagtctctgggacgaggaatgactcagcctcaggcaccctctcctccaggcccctcccagccctttccccttctttccccttctccccacctcctggactccagttaggtatgtagacctagtctgctaggtcgagacactgataatccccacttcctctcccagccttggttccaaccctactttcttttccttcgccaccccaccacccgccaacagccaatgccttttcgacctcaacagtccccatcacttttccagagacagccattccccacctccaccaagggctctaagcacaggtgggtctggatcttcctgggaaggtgaacagcaggagtggtgcgcagccggttcacagagtcccagagtcaagaggggctgtgaaaggcattccctaggctgctgagacttggggtccagggctgtgcagcagaactgggaggggcagggatctgaaaactacccttcaaattccccacaagaggctcccttcccaagtcccagaggcatgagaaagagaatggagggcagagagccgaaggggcccgaagcatcatggccatgtccacccttaggaggctcggatgggtgcccatccaaagactcgagtgcctcctgagtcctcttccagtgctcctcctagactcaaggatacaactgcaggggcccagtagagcccaggccacaggtgtgtctaattctgagccagaggacttcacagttcagtccccacccctcaaattagttttcttctctgggcgcatgggctctgttcccagtctggtccaactcccccatccagctctcctgccggcaggcacaagtgaggtctcccactcactaaccacgctctttctcctccctggcagcctctgcctccacacagaccccctggactccccgcgacctggtctcttcacagacccagacccagagctgtgtgcctcccactgcaggagccagacaagcccctgagtctccatctaccatccctgtcccttcacagtgagtttcggggtgcccgtagccacacagccctgggcgggggctggcagatggagacttgcctccccagcccgtcctctccccttcctgtccctctgccttccaggccacagaactccacgctccgccctggccctgcagcccccattgccctggtgcctgtgttctgtggactcctcgtagccaagagcctggtgctgtcagccctgctcgtctggtggtgagtgtggtgtgggttgaactcggggaaaatggaacagggaacagcttctgcccaggatagagggtcagaggggaatcggccagagaacagaggtggaaattataatcggcagagctctccaaattaaagccctcatggagtccatccatctgacatgtcacacaggctcacctttgtccttcagctgcaaacttgcaggaatctcatccatgtttctctgtctctgtgttttctcctctctctctccctctctctctctttcttccccctgctcccttttcctccctttctctctccattcctccccctccctctttcccattccacccccttcctctctccctgtctctctacccctccctcctctcctcttcttccctctacctttctccttctctccttccctctcccctgtccttccactcccccatccctccatcagaaacacagacctacacagctggaaagtccctcccactacctgcccttccaggcaagcccaagtccagggactccctaaagccaccatcccaggactctgcctcattctagtcctgagggagagagggtagacacaggagggaaacagcccccagggagaaggggacacatgggaaaaaaccataggtggggctgagtgaaaggtgcagggacaactcagtcaggccaggagccggcttgctggaggaggggcaggcttggggaaagggacagggtgtgagaacggattcaagtcacttcatgtatttctcccctcatctcaagggttttaaggaatcggcacatgcagcatcaagggaggtctctgctgcacccagctcagcccaggccccaggcccatagacacttcccactgagccacagggcaccaggtgggcggccagtctccaacaaggctgggctcccagcagctcctccctgacttctgacctctgctgttatccgcaaagaaaaggccaggacttgatccaaggcctttagccacgctctccctgcagagctgcagaacccaggccctctacttgctcaccctcagtttgcactgcggccagcaccccgttgtgggagcaaagcccagcgcctgcagcatctttctaccaaacctgagtcactgatgacattccctcttccctgcctcctcctcctatctatagcccctgataaaagaaaaacgtgaggcctggaacgctggtggctgacacctgtaataccaccactgtgggaggccaaggctaaaggatggcttgaagccaagagttcccagttgcagtgagccatgatcacgccactgcactccagcctgagccacggagtgagaccttgtctctaaaacagaaaagaagaaaagaaacactttagacaaaataaatttaacagagtttatctgagcaaagaacgatttgcaaattgggcagccctcagaaccagaagaggtttagagaactctgctctgcaacctgggcagttgtagagagaaaaaaagactgaagaaagcggaaacaaggaacaaaaagaaattggtcatttcaaagttaccttcttggtaaaaggttaaagcagaggggatttccctaccataccggctaaaactgacctgttcagggatttggctgttacctctctctcctaatttctcggaaggtgagataaacaacttggttttggcttggtggtgtggaaccttagcaccagtgaccccattttggtttgggctgttgggcctagtgcaggagctcagtctaaatcaatggcctcttattactctgatttaacaccccaaatccagacgcctgggtcaccccaacgtttccctctccctctgcccttgctcagccacactctgccaaggcctctcctattgtgcctcctccccctttccaagccccttcacctcacactggcactcggaccactgtgtcagccacctaacagggggtcctgtcttcagtccccgcctcctagattgttcccctgatatgtcccttcccaacaatacctctgtgcatttctgccacccaggaattgaagtccagtgtcgttactggggtcccaataatgctttgcctagatcagccacccctgtagcacagcaccccactgtgctgtccttaccaccaccaacatggctgcagcctccacaaggaagtgaacctttcttttttcctgcacaagctggtcaagaggcgcctcaactcgccacattcaagatcactccgtgccttgccccaggcctgtcacccccacagtgctgttgtctctttctgacgcttacaatcccgatgttggacctaccagactgagactgacgtgattatcttttctctcctgtttgtcatctatttttctttattcctactttctgagaaagttccccaaggttacattctattcaaatgttttcaatgtacacgatcacatttttcatttctaaacggtccatttgttctccgaatgttcctttttatagcacagcatgttttattttggcaagccacattttctctggaaatattaaagttttaacttttgaacttttccgaagctttccatattttctatgtcctccaagtgcccatcatatcttttattttctcctttcattgacctctgtctttcttcagagctttctggaaacctttgccgcttctcggccacccacttgcttagaagccccatgcgggccgcggggtgctgtgggctccaggcggattgggcgggagtatggctccattttttctctttcacagctctgtttctctagaaaggactcttagctgtccttcctgggagtgtaagtctagacccagggttctaggcaccaactggaacagagcaaaggggtctcgctgcccaatgtctgttcccacccaggcccccactgcacactctctctctgtggcgccctgtgccctgagcagagcatctctgtgtcaccctcatcagagacttacctcaagctctctgcagctgttgagagagaggaaagacagaggatgtgggcagctaacctactctcagtctcacggaagccagagaatctaggagtctaagtgattcttaaagttccaacctgttctctggtttccagcacccacttcaaccctgccttaagagatacctgcacctcccatttctccaactttctggggttccaaggtaaaaatgacttccctcttattcccccactcccaccagctctctctgatctgtgaagtcatctgattttacccaccttcaaaacatgtatggagctctctgtttatctttgaggatgggtttatgccatttttatccagttattgctgctttcaccttcttggcaagagtgaggagggaccccagattttccatcaaaacacccctccccagcacccgccaccaagggcaggagcaagtgagatcccaggtctccacttgctcctgtaaagactcctggccccctccccttcccccaaggtcagcactcagactccagtacagcctcttggtgccttattatatccctgttcactctagttgccataagatgcccaggatgccctggtcctccctcatcacccagaatcccaactcagtaagaccttgaaaatccatgacattagccccaattcccactcgtcccaaatcccataacctttccaccctgcacctgaagtgcgcagtcatcagcacaagctcctgtatgctcagcttctctgaacgtcaccgcggtactctccctgacatctgcctgttctccgaggacaatgctttctccgcagttctcttgcggggggagggaggcggtttgttctcctttgcctcatgctcctgagcccgagggtggggtcagtgtcctctgtgcccctcacagccccttcctatcttctgatcctccctaaagcactccacaagtagctttctgccattaggctgtatcactgtgggtgaccacccatcatcactgcagattctgtacaatctggggcacggctctttattcctcatgggtctcaaccccaggctcaacgtcactctgactgctcccgccataattctttgtgatcttgggcccacgtagacaagatctacatgaatgattcttccaaatctctggcatcacagttccttggcctcctatccccagtggtctcgtcctcttccctatttcagccaccattgcagatggtcagtaagcgccaatagcccccctcttaatctcattcccaccaccccctacctcaatcctgctaacctgatcccagtattgcttcaacaccacagggacccatgatccattgatcctgccacccgcccctttccgccatctcacccatgctttcctttcccttagattccatgatccaacctcaaatcagtctttggcacacagcctccccttctgtgctcctctccccttttattgaactcctctgggaaaactgtaaccctggttgaacctagcttcctgcttactctgtgcctgtgtccagccaagatgaatgtggctgtggctgacaaaatacaatctatcatcccgaaatgtctcactgtcagcacgtgaccttgagagtggagtggctctgctccattctagacccacatcattctctgtcctccctctccacatgctcagctggtgtgcccacatcctaactcactgaaaagagagagaaagagggggaaagagagaaagagagggagggagggagggagggagggacagaatgagaggaagagaaaaagaggagggaagaaggaaagaaggaaaagggagggagggaaggaaggagaaaaaagaaagtccacttgatcccaccacacctaccaatcatctgcctctcttcttcctctcactctccctactcttatctcaagccaatcactttccttcagctccaaataccatcttctcttgtctacacaagaatattccagccgagcatggaggtgcgtacttgtggtcccagctacttgggaggctgaggcaggaggattgcttgagcctgagaggtggaggctgcagtgaactatgatcgtgccactgcactccagcctaggtgacagagcaagaccctgtctaaaatagaaaaaggaatattcatccaggagccacccctctctcctgcatcatcttcccgggttgtatgtcatgaccatcagaatctaaatgggctctaatatattaaaccctccccacctacagccctccagctactgctccattatcttattgtcctctgcagcaagggcccatgaaaggactggctgcaccatcagcctccaaaattctcttttcttctctcttgaagccactccagtcaggcctttgactatgccactccttgaaacacctccagtgagttctgcactgtgaaatccagcagccaatgctgaaatctcctcaccctgggaagaggagcaccctaggcatggcctcccacttctgccttcttgagatgctttcttccagggcttccaggaaaaaagaactcttgtgactttctcctgactcatttgatgttgcataataaattagccccaaaacgtagtagcttaaaacaacaaatgatacatattcattaggtcacaggttttttggggggatgggggtgtgatcagaaatttgggaacaacttagttgggtgttcctggctcagaacctctctggtgtcgcagtcaggatgtcagcaagaagtgcggtggtagggaggcttgatggagggccgtgcccaagacggtgcatcctcatgtggttgctcgcacaggcctcagtgctttgccatgtgagcctttcttcacggcaagggaactaacttcccaagtgtgactgatccaagagagggtgcggaaggaggaagtcatagtgccattaataacctagtctctgaaatcacaaaccattgcttctgccatattctactcatcggaagccagtcattgggtccagcccaatgggattcgcctccaacccttgaaggaaggtatattaaagaattcgtgcctgtattttaaaaccaccacagtacttgctctggccacaaattatttacattcctcccacatgcaaaaatacactcagtcccaccaaaggtctcccaaagtctcatcccattatggcgtcaggatgaggtccaggaactcatcatttaaaccaggtccaggtgtggaggaaattcctcaggtgtaattcctcaaatacaattctcagtatgaagacctgtgagctagagacaagttatctgccacacacacaaccccaatgtccaatgcagtacagtcataggaaaaccactacagatatttttgttcaaaagaggtggaagggggagacaaaaaaaaaaagtcactggtccttagaaaatcagaactttagctgggaaaatgttggaaattccttgattcagacactgctcaactcctacctagaaataattctcagtggtcgtggctccttcctctgtgctcgagtatgtcttctgagccacccttctctttccatgaaaggcagcccatatttacagcttcgtaacttcctcaggctgcttcctgccagtttaatttgggggatacaaagtgagatcccagattttatgctatttctgttcctttcagtccaatctggcagtgttttgtgactgtcattctcttaaaaaaaatgtggatctcctgtaaaacttattgtgactcactccattagacaaagaccatacccacaaatttctccaagagaagatctcttccacaccatgtgcttctgacaagaaagtgaggataatgtctttatacttcttagaagatctaatgttcgactgaaaaatctatgaagcacgcacccttaaattcatgaaagggccttttgcctgagacactatgtgaaataataattattatacattattgaaatcattataattttatataaattattatagtttattatatttttaatatattttataaattttttatatttttattttttatattttatttatatattttatattaatttttattaataattttaaataaattataattttatatattatgcatatattatcatgtatataattttcatatatatatatatttctttgaccctagttcctgacacagagctcctgagacccttataaatgggagtgctaagataatcttttgttctcatatttggtctttgacctctgctcctgacacagagctcctaagacctttctaatctcctgagtgataggagtgtctaacacagaggtcctacctcccttggaatttcctggcatcttttcctctaaagaggtgactcttagtgtgctcttggatgggggctggtcaccagaaggatcaatccatgattgaaagcttggaactttcaccccacctcccataccccagggaggggagggggctgaagactgcattaatcatcaatcaagctgacatgatgaagtctctgtaaaaatcacaaaagtaaggttcaggagcttctgagttggtgaacacattcatgtgctgggaggtatggtgcaccccagctccacagagaccagaagctcctgccctccagcccttccatacctgaaaacaatttggtttttcctactaaacacacaactttctgaggtcttaacaaaggattttacagcatagccttggtttcatctttagaccacatattcctgaacgtgccctggatttgattttagcatcatttactgtctggaggctgagaattttttaagtcatcaagtcccagctccctcatgttgaataatcctgcctagagtttacctctcacctctctcatttcacaatgagccacaagaagaaaccaggtagcactttcaagagtttgcctggaaatcctagctgtacaacccagctcatgagggacattttctactttccacattactgcagatgacagtgttgctaaactttctgccattgtgtaacaaagaacccccttcctttttaccaactaaatgatgctggaaaagtttcttaaggtctctaccccgagtcttcttattggtaaaaacagaactgataacacacatattaccaagctatttggatttctaagtagggtgatgtattcaaaaagcaccagacaaaaggagaacacccaacaaaggctgagttttagagggagtgaggtgtagaagaaagcagactcaactgtgacacagcagagaccatctgcctttccagagcttactgcagctgaaaagacagataatagtgtgtgggcagagggtgaacctggagacttgaaggaaacaggcccctcttcttggtggacagtagaggaaaataaaggaaaaaatcagggtgaggaaactgaccaaactgggctcaaaatccatgcatgctcactgacacctttctggcagcagtggccaggagcagacttcatccttgtgaggtgggtatggcaaccaaccctgcgagtagtgggatggggaaggggttgcctctgcacctatgtgcaattatgtggcagtctctgaccaccttcctggtttcctgctctgattgcaggggggacatatggtggaaaaccgtgatggagctcaggagcctggatacccaaaaagccacctgccaccttcaacaggtcacggaccttccctggacctcagtttcctcacctgtagagagagaaatattatatcacactgttgcaaggactaagataagcgatgatgatgatgaacacactttgtgaataataaaattatctgaatgttttattcctgttgtttcctaagtttccttcaaactctgtctgcatccgcacatttgatctctaggggaccagcttctctagtttgccctctttcctccatcataaccctttcttatcttcagttcacctgatgtcccctgtacgtctgggagctgccttagatgctgttataatcagggaagggcactgtacacaagcccagtgagtagaaaggctgtgggcgagcaaggcttggaaacaagacctgggtttgttttctcagctcagccctgtatgaactcggacagataggtcactgcccctctctgaacgtccgtttctttctctagaaaatgaagggggtggagatgagttctgaaaccccttccccatgaggataagtcaataagcatgaactcaacacctgcctgtgcccagctcagggaccaagcaccacaggacacaaacaaaaggagccagcctgggaacacagttgtgagtccataggtggcggggcccctgtgcaagattccagcacaggctgagggaaggggacagtggagggggagcaaagctgaaaatatgtggctggagagggatagaaaagcaggacactagtgggtaccagacagtgggggaaggagcccaacaaggatgaggaactttgctgtgaagtcatgttagtcaggatgccatgaccttccatgagcccgaaagagggcacacagtcccaggaaggaggcgaaaccctgccccatctctactcacccctaaggttctgggagcttcctggtatccagggaaaatttaggctcccagggtctgcggtctttttcttggaaaccccagtctccggcttcctgtttccagtttcgccttccttcctgggctcctctgggtaccaggctccataccctgccaaaggctagaaagtctgcggacagccggccgggcgtggtggctcatgcctgtaatcccagcactttgggaggccgaggcaggcagatcacctgaggttgggcgttcgagaccagcctgaccaacatggagaaaccctgtctctactaaaaatgcaaaattagccgggcgtggtggcacatgcctgtaatcccagctactagggaggctgaggcagcagaattgcttgaacctgggaggtggaggttgcagtgagccgagatcgcgccattgcactccagcctgggaaacaagagagaaactctgtctcaaaaaaagaaaaaagaaagtctggcgacagccaaggtttcagacagaccagagtttctgcttatggttgaagtgctgaacttgttgggtctaaatgtgaatatgcactgagtagtagagtctattaagaaactatttttaattgcattggctgtgatcatattaatttgctaagcagcaagagctcttgttttagaaatgtatgataaattatttaagggtggaatgtcaggatatctgcaatttatttaaaaatacttccacataaaaaaaaataccgtgagttaaaaatacagaagtggagtggagcacctggcccctgagctctgatgatgacagggcctgctataggcccatcctgttcctccatggaaattagacaaatgacccatcttgcagagagatcacaaaaaggcacacacacccccacccccagccccgggcctactgattacaaaaatgcaccctagccaatacctggtagaattccaaccctgctggcccaaacacccagggacttcctgtggttatgggataacagccaacacagccaccatcgaagcagagtccacagtctcagcgaggtgctcaaatcttggtgcagccctgaacttgacattggtcagcagatctccacaacagctgcacctagagttgcacacaccacaccagctttcctggtgtttttctcttttctttgtacattatatgtaaacatcatttttccaattctaagaatcccgacattcaataaagggaaatatgttagattcttgtatctactattttttccccaa

SEQ ID NO: 789 - DNA, 90925 bp, Human
  misc_feature (1)...(90925): n = A,T,C or G
ttgtgaagagtacagtccagtttctgttgtagaacgtccttgaagttggtcccggaatatttgtttaaagtgagttgggaaaccacattcacatgtcttttggttatgtgtgtatttgtcaaacagccagccttgtgctgcgtgctgtgatggggagcattactcaacagagcctggccctgaccttggggatgtagtttgggtttgtggggaaagcagctaccgccaggtgggctttacggacccctgtgtgtctcatgactagaggcactgacgcttggataaatacatactggatggatgcaggatgagtccgcattctagaagtgtgcagaggtacagaagtggccctgctccctgtccagcacccagtcatcagctttccctggcttcccgaggcaccctgacgttcacactccaaacacaaagtcttctctcaggaatctcgagtgagctgcagtctgggttctagccctgccctagcagggatctgctcagtgactgggctgctctcttcctgctttaggccaatgcgggggagaggagaccactgtgactctccccagtgcccttggagcgcagaatgaagtgaggggaggaggagggtcacgagccctggagcgctgggaagacaggctgtaggccgcaggccccgatcctgcctgggacgaggttcaacagaagtaggatggtttcatcatgacctggcaggaaaaccaccagacctggaattttgcttttacaactgtttaacttctgtttcatacaggatggaaaccggtgaattgtaatctcacataaccgagcaagatctagtagtcataagcactttgtcagagcaaagcagacaaggcaaagtgttggaaatgtcatcggatcttcacagaaccttagccaagcagcctttcaatgcgagaaacaaaataacatggatttttatctagtaatgaagtcaacaccattgtccaccctgggttaacacattcacatctcaaagcgaatggggctgcagacactcatgttagagagccttggaatgtcctgcctttttacgtttaattaaaattaaataaaatatacaaaattcagttcatcagttgttctagtggcattttaagggtttagtaccatatgtggctcatgagtaccatcctggacagcgtcgacctagagcagttccatccccgcgcagagttctgtttgacggcgccactctgcacttccagcagcctggggagcaggggtgcaggagagttccttctgtgtcacagacttggtcacacagtacagatctcagatcagcacttaaacacgactgccagctgtcaacggcgtgttctgtggaatgctgggatgcatcacaggtatgctggaagatgtatagaattttacttctgttattctggtaactcagagtcctgttcagtcagtttccacgtcaggttgctgtcctggttttaaagagaatgaacgcagccgaagttgaatcgaggcagtgatttcactcagtgcgttgggtctttccactcacctggccctccagaaccccagggccttgagtgcatgggctggtacaagagcccagtttttggctggggaggcacttcctatgggagggggacgcctgtctcagtgctgaggcaaccaccaccgaggaccctgggctggaagctgggctgagatgtctggtggtaggttctgaggcaggacaggggaccgactcaaatggatgatacgaacggcaggctggattcacgttgctcctgcacctccagcatctgctgaggacacctagaactgtggccctggccaaacctcagctccctattccatgaaagtgtgggtcaaagtgtgggtggtagagtggggctgacagtggcccctaagctcctagggtccagcccacaactgaggaagccacacggctggttgtgtacgagccggagtgtctctgtttggttgaaagtgccggtctgtgggtccttgctggtgtgtgtgcttctgtccccgcctcctggcctcctggctgaggggaagctgagtgggccacggcccatgtgtcgcactcgcctcggctcccacacagccgcctctgctccagcaaggatgtggctcttccacactctgctctgcatagccagtaagtcctctcacccgctgcttcgaggggctgctgtgccctcagctccagccaggtgtctgcagactacagccttgactgtctgtctctgatggggctcagttagagccagaggttagagagtggcagctcctccaggaaaggagtcttgctcggtgggtcagggccccaggcttgttgggaagggcggctgaggcttcgtgttgccagttctgtcagccagggcctttggactccagggctctgccattctgttcctcctccagccagcctccccccgccaccgaggccctctccccatggcacccacttggggcaggtccttgactctgtagtttgttctctgagtgtggaggctccgcctggcagagctcccttctgttacagagcaggggttgggctgatgagggtgaggaccctgtgagagagtgttgaccagagactgggggcaagtgtctgtatggtagagggtgtgagtgttggcagggagcctgcttcctgtgttgtcaggcccagggtaaaaactggaatgtggggtggggggaggcacttctgctgcctggggggtcccattttagcctttaactgtcccatggaagcctctgggcaagccaagccatgagtcctttcgggggccccctgtgatgagacagcacggtcaggtgagcccctggaggctgctaagattaagccggaggccagggtggtcctgcctagtgatctgagcagacttcccatgggtctcctgcccctgctcaggaggttggccggagaattggatgggcatcaagcttatgtggatgaaaggctcctggtagctgagttctccctgaaagatgggctgaggctgtgctgggaggggacttgggattagcatcccacctggggccagatcacccaggaagcaggccacaatgtgtagggtaccagcaaggaacacgtttttggacagattttaatattttatatttcattttattttattttattttttgagacagagtcttgctctgctgcccaggctggagcccaggctggatcttggctcaccataacttctgcctcccaggttcaagcagttctcctgcctcagcctcccgagtagctgggattacaggcgcctgccaccacgcctggctaatttttgtatttttagtagagacagggtctcaccatattggtcaggctggtctcctgccctcaggtgatcgacctgcctcggcctcccaaagtgttgggactacaggcatgagccaccttgcccggcctaatattttatatttcaaaaacatcagaatagtcaccatggaaaggtcaacagtttgttgaacttccttttattttacaatttagacttctctgtttttagttacatgtggggtgtggagagagtctcactctttttatggcttgtggctttgatctcccattaccaagaatatctggagcagatgcttagactagactcttgtctaccctctcccagtacagaggaggtgactggggcacagagcgggcagtgactacccaggcttgcaagcaactgataatagacacgaggctcaagcccaggcctctgtcctgcctcccagctccagaatactcctgtggctcatctgtctcctttagcctctgagaccaccacccatcacctcagtgccttttccagcaggtggcatcgatcaaacctcttttgaggcctaggcccttcccaagctgatgggcagcagagagcgatgatggagcagacttgccatgagaccacttagcccacagctcagctcagccacgggaaggggaccagagcagggcccccgcagctccggtgtgggtggcggaaacgaggctgctgcagttctgctccatgctgtgaggtcctgagactaggatgggccagtccaggagagtttcctggaggaggtgaggtggcgttgagtcttgggggctgaggagagtctgagaaagaaaatgtccaggagatgctgggaggaagaactccctcagactgtggctccaggcccagcaccctgtaccctgtgccgggttgggcctccttaggctggagagaatccaggactggcctggcctggccctgaccttccactctctccaggccagccactctggtgatgcctacttcttatttgtggcagcagacggaataatagcagttgtctaagggagattttagaagcattgggtgcagacagacactgaaaccctggaactgtccacaccctgaccaccagccccatcatgccctcttaccctgtggcctgctgtccccaagtcagtcttcacccctgactcattctgcagtcacatcaactcacttctccatcctgggtctcagaggttgagtttccacccttgcgtgaagaagcctgtcctgtcagcctacaacaccttacaggggtgaagaagaaggaaccagaagtccagggcccgctctgctggtggcacgcactcgggctgaggccaggggctgtgccggggcatcaccccgggcctgtgcgtgatagaaaacctcagtccttggggagtgggagactgtagcatctgaggtgggctctgaaggacggggaggtccttggcaagtacaggctgggggtgagcagaggggccttctgtgcaggggggataggagggaccaagccctggggtgtgaagagtctggtttgtaggaagatggaggcgaagtgtgagtgggagcaggagattgtctcctctggtgttgctttcccttccagccccgccccaaatcgggacatgctgggccctggaggtgcgggcagaggcgaggccacccctatcccagcccctgtgtgaagagaaggcaggttgtgcacacagtagcctccccggccccggcagggtgtcacagcacgggggtagggaaggggcactccaggcagaggggcagcccaagcaaaggtgaaatgcccccggaatgcagtgtgtgggggagagctggctgggggagtgtgggccgtgtgggagccccacatccctgcccttctctgggaggcctgcattcgtgtggcaggtgtggtataagtggaggaatgcgggcatccagtcccgagaggcccacggtggaggtggtgaggaacgtggggacctgagtgccggcctgggggagcttggagttcctgctgagggcagtggggagccacagaaggtcttgaccaggatggcgacagaattgtatgttgtgtgttagttggaatctgggggagaggggaggcagagaggcccgtgaggaggctgctgccttggccccatctgcggctgttgcggaaggcagacgtggggaggaggacacactcatgagaaacgtttagtttcctggccaggcacggtggctcacgcctgaaatcccagcactatgggaggccaaggcgggcagagcacttgtgatcaggagttcaagaccatcctggccaacacggtgaaaccccgtctctactaaaaatacaaaaatgagccaggcatggtggtgcgcacctgtaattccagctacttgggaggctgaggcaggagaattgcttgaacccaggaggcggaggttgcagtgagctgagatcacaccactgcactccagcctggaagacagagagagacaccgtctcaaaaaaaaaaaaaaggccaggcgcagtggctcacgcctgtaatcccagcactttaggaggccaaggtgggcagatcatgaggtcaggagatcgagaccatcctggctaacacagtgaaactccgtctctactaaaaacacaaaaaattagctgggcatggtggcgggtgcctgtagtcccagctactcgggaggctgaggcaggagaatggcgtgaacccgggaggcggagcttgcagtgagccgagattgcgccactgcactccagcctgggcgacagagcgagactccgtctcaaaaaaaaaaaaaaaatatatatatatatatatatatatttagtttccagcacacagtagtgctcaaggcctgttggcctttcttgttattagggagatgaagggtgagggagagagatgggctcagctgactgtgaggtttggggtggagttgatgaggctccgtgtagaagatcgaggtggggggactgcggctggctgcagatggctctgaggcacagtgctcccacgaggccccgctgggtgttctgggcggggtgtcgggacccctgcatctagccccacttcttcagctcctggtatcagtgtgggcaaatcatgccccatgggcctcggtttcctaaattgggaatcgtggtacttattgtactgtgagaatgtgagttgaaattgcccggagtgctgggggagacagagggttgaggggagacagtggtggctgacaggatggagggggatctcggtctgactcagcaggcctccgtggctggggacagctcagagaggtggtcctgtgggtagtgtggtgacagacactggtgtagctatgtctgtaagtcagacaacacgggaggggggattgggagggagggccagccctcgcctgtggttataactctctccaacctcagcctccacgtgctgagcctcctgcgtcagacctggggccgcgtatcgccccatttgatctgcacagccccatgtcccagaggggagacggaagcgaggtgccaagcccagggtccttcagtgactccaaggcagtgaggatttgaactcaagaccatctaccaagacaatgctgttttctgagtcctggtgggaaatgcaacaggaggtggtttcctgatggaggcgcagctcaaaggcaaactgttgggcctggggcgagtccagtctgaggaaacaagctgagccaggcctggcagacctgggcaccagctggctctcagggaaagcccagcaaatacagcgaactaccccaccacacacacacacacacacacacacacacacacacacacggatgcacacacacacacacggatgcacacacatggatgcacacacacacggatgcacacacacagggatgcacacacacggatgcatacacagggatgcacaaacacggatgcacacacagatgcacacacggatgcacacgcacacacgcgcacatggatgcacacacggatgcacacacacagatgcacacacggatgcacacacgcacacacagggatgcacacacggatgcacacacacggatgcacacacacggatgcgcatacacagatgcacacacacggatgcacacgcacacggatgcacatggatgcacacacacggatgcacacatgcacacacagggatgcacacggatgcacacaagcacacacggatgcacacacatgcacacacacacgtacacagtctcatgccaccgtgcctctgcggcaggctcttgctgacctagttaccagccctgtaagcagagccctgctccagctcagtgagccgccgcacggcaggagcagtgcccagcttcttgaggccatttgtgaccctggcctctctctgtttaccaacccctcggtgcctccagctattactaaaggctttgaaatcgggcataaacacagaatctgagccccagacacaaatattcaatcttccgacgggccatgcacaaaccacacccctctctgagcctcagcacctagcgtggtgcctggaaggcaacaggtgctctgggggagcggaaccctcagttgaacaagatctctgttgaacaaagtgaacacaggggtggggtggcgtgaggaaagggaatatctggcccactctgacctttttagagcaccttttttgggtgggcctggccctgcgctgagctgggctctgtggctgggggtgttgtgtgtgactcagatcacatcacagttcagggcagacaaactgaatcacagatcaccctgatccagacagaatttggtcacagccagacagaccacaggatgctgagggggctcagggtttggtcagagccagacagaccacagggtgctgagggggctcagggacccgggagttactctgactgagtctggattggctcctggctcctggctggctgagcagggccacaaaagacgggctttgcagacagaggtggagagtgctgagcaggcctgctgggtggagggagccgctgtgtcgaggcctggaggcaggagtgtgcagagggtgcgccgggcagagcgggggggtgccacggacgcccaggagaggagactggactttgctctgcggcctccactcgtgccttttcagttataccgacagtgaaacggggggaagaaggccccccacccacccctcgtaacatgttggcagctcgcactttttaattctcctctaggcagtttgctgacgtcctgttttttccccagannnnnnnnnnnnnnnnnnnnatcagctgggcgtggtggcgggcacctggagtcccagctactcaggaggttgaggcaagagaaaggagtgaaccgtggagtttgctctgcggcctccactcgtgccttttcagttataccgacagtgaaacggggggaagaaggccccccacccacccctcgtaacatgttggcagctcgcactttttaattctcctctaggcagtttgctgacgtcctgttttttccccagagtgactgaccaggaggcacagggctcaacgtgacgtgggccccggggccggagcccagactccctgctgggcatcctttatctcagttctggattcgtgggggagcagcgggaacagtacggccttcttccctgcctaggggtcttgatctggaacctttgagagtctatgtaggctgtaagtggccactctcccagcacctaccgagggtgggccaccatgccaggccctgagataatgtggcgatcgaggcagatgcagtgtgtgcccccttggactcactggtggcagggggcagtcactggcaatagggaaacaaggaaggccaagcacagtggctcactcctgtaatcccagcacttagggaggccaagactggaggatcacttgagcccaggaatttgagtccagcctggacaacatagcaagacccccatctctacaaaaaatttaaaaaaaaattagaggccaggcacggtggctcacgcctgtaattccagcactttaggaggccgaggcgggcggatcacaaggtcaggagttcaagatcagcctgaccaacatggcaaaaccccgtctctactaaaaatacaaaaattagtccggtgtggtggcaggtgcctgtaatcccagctacttgggaggcttaggcaggagaatcgcttgaacccaggaggcggaggttgcaatgagccgagatcgtgccattgcactccagcctgggcgacaatagcaagactccatctcaaaaaaaaaaaaaaaaaaaaaggatgaagaggaagccaggagacaggctgaggacagagcacttcaatcaggcaaggggaggattttgtacacatgtgcactcaggggatcaggaagggctccaatgcttccatcagattctcaaagggggccaggtgcagtggctcacacctgtaatcccagcactttgggaggccaaggtggtggatcacgaggccaggagttcgagaccatcccggctaacacggtgaaaccacatctctactaaaaatacaaaaattagccaggagtgctggcatgtgcctgtagtcccagctactccagagacccagtattttgagtcctggcctacactcggtaggtgctgggagagtggccacttacagcctacatagactctcaaaggttccagatcaagacccctaggcagggaagaaggctgtactgttcctgctgctcccccacgaatccagagctgagataagggatgcccagtagggagtctgggctccggccctagggcccacgtgagacaggagaatcacttgaactgaggaggtgggggttgcggtgagccaagatcacaccattgcagtccagcctgggtgacagagtgagactccaactcaaaatgaagaaaaaaaggccgggcatgatggctcacacctgtaatcccagcactttggaggctgaggcaggtggatcaggacgtcaggagatggagaccagcctggccaatatggcgaaaccccatctctactaaaaatacaaaaaattagctgggcatggtgatgggcacctgttttcccagctactcaggaggctgaggcaggagaatcgcttgaacccgggaggcggaggttgcagtgagacgaaagttgtgccactgcattccagcctgggcgacagagtgagactctgtctaaaaaaaaaagaaaaaagaaaaagattctcaaagggatccattacccccaaacaagaacgtctggtctggttatgtttcctgtgttttctactttggggcattggcagggaggacacaaatcacaggtctgcaaaagctggggtgcagggtttcttcattgtgttctcacaaaggacccttagggacagttttttctctgatttgaataaccagactggttgtgctttgcctggaagtgttttgttttttgaattttgtggacaccgcatggcattaactgatctttttcatgttgatatcaccttcaagaaagcttcattcattcatgtatgcgttgaatcaacaaatgattttattaagccaaaggattttaggaacacttctgtgagccagcgctgtgttcagagccaacagtggggcacgtgatagaaagtgctggcactgcgtgatctacatgttagctgttggcctccttcctggcttgttgtatccccctctttttttaaaccatcattttccttctgttcttttttgcctgccccattattttaagcgagttttatcttacctgtattatgtatttttatgaatcaccacaaatcattccaggcgaggcagagatgtgaagaaaaaggaataaaatatagatatcaggccgggcgcggtggctcacgcgtgtaatcccagcactttgggaggccaaggcgggcggatcacctgaggagttcaataccagcctgggcaatatggtgaaaccccacctctactaaaaatacaaaaattatccaggtgtggtggtgcgtgcctataatcccagctactcaggaggccgaggcaggagaatcgcttgaacccgggaggcagaggctgcagtgagccgagatcgcgccactgccctccagcctgggcaacagggccagactccatctcaaaaaataaatacataaataaaataaaattaaatatagatatctactttgtgccagactcagggaaatggccttaaatgcagggatgagagatccagagcctggcctcagagccatctccccaggttcctcctcctcctcaagtctggaaggttgatttttggataataaaattttaagcatgtacacaggtaaacgagataactataacaaagccaatatgtccatcaagcggatgacacaatgatcaagatcctgccacacaagctgaatgtattttgtgttccccttttcatttttgttgtcaaggtatttaaagcctggctgctcaaaatgtgacctgaggaccagcagtgagagcatcgtctgggagcttgttggaacagactcccagccccattctgattcattatctgctgagtcagaatctgcattttaacaagatctccgatgactcatttgcacgctaatgtttcagaaacagtattttaaaccccaaacatcgtgtcatttcactcccaaaaaacatggacattttcatttctaaagaacatgaagggccgggcgtggtggctcacacctgtaatcccagcactttgggaggccgaggctggtggatcacctgaggtcaggagtttgaaatcagcctggccaacatggcgaaaccccatctctactaaaagtacaaaaattagccaggcatgttggcacacccctgtaatcccagctactcaggaggctgaggcaggagaatcacttgaatccgggagacagaggttgtagtgagctgagatcgcaccactgcactccagcctgggcaacagagtacgactcagtctcaataataaagaacgtggacattttcttaaatagccacaatgttcttaccacctaactaaattaattctttggtatcatctaataccaaatacttagtccatatacaaatctctctgtctcaaaatgtcttttttttttttttttttgagacagagtctcgctctgtcgcccaggctggagtgcagtggcgcgatctctgctcactgcaagctctgcctcctgggttcacgccattctcctgcctcagcctcccaagtagctgggactagaggcgcccaccaccacgcctggctaatttttttgtagttttagtagagaaggggtttcaccgtgttagccaggacggtctcgatctcctgacctcgtgatctgcctgcctcggcctcccaaagtgctgggattacaggcgtgagccaccatgcccggcctccaaatgtctttttaacagttggtttgttcaaagcaagatccaaacaaggtccgcacatgacatgcggttgctgtggctctccgtctggagtgcacccccatccccattttctgctttcatgcctttgatttatggcagagtttggtcacgtgtgttgcagaatatctatgttcaggatttgtgtgtttgcttcctcttggtgtgatttgtctttttattccccaaactgcctgaaaactggaagtttaacgtcaggtttcagttctgtggcgagcacactctaagcagttgtgaggattttgccccacttcctgcagttatttcacctctttttcttttgtgtgtgtgtgtgtgtgtgtttgtttgagacggagtcttgctctatcaccaggctggagtgcagtggtgcgatctcggctcactgcaacctccgcctcccaggttcaagcgagtctcctgcctcagcctcccaagcagctaggactacaggcatgcgccaccacgcccagctaatttttgtatttttagtagagatagggtttcactgtgttggctgggctggtcttgaactcctgacctcaggtgatccacccatgtcggcctcccaaaatgctgggattacaggcctgagccactgtgcctggcccttctttttcttttctttgctgaagtgttttaaagccttggtactcagaatgtggtctgaagacctgcagtgtgggtgtcccttagaatcttgttggaaatgtagtcttgggcccttacatccttcctagagtgtcacaccaagaaggacatgcctgagaggcccactcctagggatgctaagattgactagtgggctcaggtggtgtcagcctaattgtaaagttagtctatcagactctcatttagaagctttacctgttgatgatcctggcctgaattaattattgtatttcattagggctcacaaaatagtttggttctattattcttcctacatttattagtaataatttatccataaaaaagacgtttttcatgccatttttataagggccagatgaacaaatgaaaaataaatttaaggctgggtgaggtggctcacgcctgaaatcccagcatttgagaggccaagtgggggcagattacttgagatcaggagttcaagaccagcctggccaacagagtgaaactccatctctaccaaaaatacaaaattgatctgggtgtggtggcacatgcctgcaatcccagctacaggggaggttgaggcaggagaatcgcttgaacctgggaggcagaggttgcagtgagccgagattgcaccactgcactccagcctgggtgacagagcgagactccatctcaaaaaacaaaaaacaaaaaaaaagaaggaaagagagagagggaagggagggagggagggaggggggaggaaggaaggaaggaaggaaaacttaaaagacaagaagtactttttctcattaaccaggatgatttgatggccctgaaatgcacttcatgtaggaaaggcaagaaaaatgcttaatacttttcctaacagtcagttttcagagtaaagagatggtgccctttttacttccattggtagcaaattttctttttcgtttcttttttttggagacagtcttgctttgtcactcaggctggagtgaagtgtgatcaccccagtgcactccaggctgggcaaaagagtgacagctaatctccaaaagcaaaaaagcaaagaaaacatactgtgtacaacctggggggctaaaaaaattttttttgaacttcattaagctgaagaacatctgtctagcaaaaaaaaagnnnnnnnnnnnnnnnnnnnnttttgtttttatttttctctctcttgtaaatatcatgaacttatgaaagttttatatattcagtgtgtttcacatacttgtaattcttattctaaaaaatattttaattataattatttttaaataattattttaataattattatttttaaataattattttaataattattatttttaaataattattttaataattattatttttaaataattattttaataattattatttttaaataattattttaataattattatttttaaataattattttaataattattatttttaaataattattttaataattattatttttaaataattattttaataattattatttttaatgtagactttttaaaagtacaacatacagaaaaatggacaaatttagatcagtaaatgttcatattaagtcacacccgtatcaagaaacagaacaggctgggcacagtggctcacacctgtaatctcagcactttgggagcccaaggtgggaggatcacctgaacctaggagttcaagaccagcttgaacaacacagtgaaacctcgcctctaccaaaaaaaaaaaaaaaaaaaaaaaaattagtcaggtctggtggcacaggcctatagtcccagctactcgaaaggctgaggcaggaaaaccacttgagcccaggaagttgaggctgcagtgaactgtgatcacaccactgcactccaggctgggcaaaagagtgacagccagtctcaaaaagcaaaaaagaaagaaaacatactgtgtacaaccttgggggctaaaaaaattttttttgaacttcattaaacttaagaacatctgtttatcaaaaaaaaaaaaaagtaagtgagtgaaaaggcaaaccacagaataagaaaataattgcaacacaaattgataaaagattaacttcagaatatgtaaagaatttctacaaatcaataagaaaaaggcatgtccacaaacagaaaaaggacatttcacaaaagagattatcaaaatagtcaggaatcttgtaaggagacttcagacgtcagagaaaggcaaattaaaaccaggtgtggtggctcacacctgtaatcccagcactttgggaggccaagacgggtggatcacctgaggtcaggagttcgagagcagcctggccaacatggcgaaaagcccatctctactaaaaatacaaaaattacccgggcgtggtggcgggcatctgtaattccaggtactcaggaggctgaggcaggagaatcacttgaactcgagaggtggagattgcagtgagctgagattgtgccatggcactccagcctgggcgacggagcaaaactccctctcaaaaaaaaaaaaaaagagaaaaccatttgtcagtatccactaaagctgaacatatgcttaacaggatccagaagttccacggttagacatatgcccaacaggaatgtgttcatatggtcatgaagacgtctgcaagacactcatagcaggccagacacagtggctcacacctggaaacccagggctttggtatgccagggcgggaggattgcttaaggccggtgtatgaaatcagcctgggcaacatagctagaccccaccgctttaattcttcatcagattaaagaaattcacagccgggcatggtggctcatgcctgtaatcccagcactttgggaggctgaggtgggcggatcacctgaggtcaggagttcaagaccagcctggccaacatggggaaaccctgtctctaataaaaatacaaaacttagccgggtgtggtggcacatgcctgtaatcccagctacttgggaggctgaggcaggagaatcgcttgaaccagggaggcggaggttgtagtgagccgagatcacaccactgcactccagcctgggcgacagagtgagactccatctcaaaaaaaaaaggaaaaaaaaaattccctctgattcctggtttgctaggactttttatcagaaattagtcttggattttatcagatgccattttctgcatctatcataatcatatgatttttaatcctttatttccctgttgtaaggagtaaactgattattttaaatgtcaaaccactcttccatttccgaaatgaactctgcttgttttgatgtatcatgctttttttttttttttttttttgagaggagtctcgctctgtcaccaggctggagtgcagtggcgcaatcttggctgactgcaacctccgcctcccgggttcaagtgatcctcctgcctcagcctcccgagtagctgggactacaggtgtgcgccaccacgcccagctaatttttgcatttttagtagagatggagtttcaccatgttggccaggatagtctcaatctcttgacctcgtgatccgctggccttggcctcccaaagtgctgggattacaggcatgagccactgcacccggccgtattatgctttttataattccctggatttgatttactggaattttgtgcagcatttttgtatttatgttcgagagaaacggttgtttcaattttcctttcatttattgtgcttgctggattttaatatcaatgttatactggcttcataaaatgactgaaaaatgttttctcattttctattctctaaaacagtttatataaacttggcattatttctctttaaatgtttggaaaaattcgtcagtgaagctatctgggcgtagagatctccctaagatttttagtcatgagtaaaatatcttactcaggtgatacatttctttttttgttagttttggtgcatttctatttcaaggaatttgttcatttcacccagattgtcaagtttactggcataaggttggatataacatcctcttacttttttttttttttttttttgagatggagtctctctctgtcacccaggctggagtgcagtggcgcgatctcggctcactgcaagctccgcctcccgggttcacgccattctcctgcctcagcctcccgagtagctgggactacaggcgcccgccaccacgcccggctaattttttgtattttcagtagagacggggtttcaccgtgttagccaggacggtctcgatctcctggcctcgtgatccgcccgcctcggcctcccaaagttctgggattacaggagtcagccacctcgcctggcccctctaaaaaaaaaatgtcttaggatctattattgatgtcccccctttctatttggggggggggtgggtgattggggtgttctctttggggggggttgttcagtattgctagtgatttatcattttaaaaatctttaaaaaaaacttcagcatcattagttttctctactgtaagttggtttgctgtttcattgatacgtgttcatatctttattccttcccgtacttcctttaggtctgatttgctattccactgtaattttatctttcaccctgggttatttagaaatgcattgcttaattttcacgaggttcagatttttctagttttccttccttccttccttccttccttccttccttccttccttccttccttccttccttccttcctccttccttccttccttcctttctttcttctttcccaagtctcactctgtgcctaggctggagtgcaatggcacgatctcggctcactgcaacctccacctccctggttcaagtgattctcctgtctcagcctcccaagtggttgggattacaggtggctgtcagcatgcctgcctgatttttgtgtttttagtagagatggggcttcaccatgttggccagggtggttttgaactcctgacctcaagtgatccgcctgcctcggcctcccaaagtgctggggttgcaggcatgagccaccatgtccggccatcttttcttccctttctttcttttttcttttttttacatggggtcttgttctgtcacccaggctggagtgcagtgatacaatcttggctcactgcaacctccacctcctgggctcaagcagtcctcccacctcagcctcctgagtagctgggaccataggtgcatgccaccattcctggctaattttttgtatttttggtagagatggagtttggtatttttgttagataccagccatgttgcccaggctggtcttgaactcctgagcttaagcaatctgcctgcctcagtcttccacagggctaggatgacaggcacgagccactgtgctggacctctagttttctttttgttattggtttagattctagtatagtcagagaacatattctgagttatttcaattcattgatatttattgaggctttagctttgtgatctagcatatggtcaattttggtaaatgtttcacgtgtacttgaaaataatgtttctgagggtgcggtggctcacgcctgtaatcccagcactttaggaggctgaggtgggtggatcacgaggtcaagagattgagaccatcctggccaacatggtgaaaccccgtctctactaaaaatacaaaaattaggcgggcatggtggcgcgtgcctgtagttccagctactcgggaggctgaggcagaagaatcgcttgaacctgggaagcggaggttgcagtcagccaagattgcaccactgcactccagcctggtgacagagccagactccgtctcaaaaaaaaaagaaaaatgtttctttttccattgttgggtacagagttttgtctgtcaggtcaactttgctaattatgttgttcatatcttctatatccttgctcaatttttggtctgcttttatttttatttttttattttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcagcctcccaagtggttgggattacaggtggctgtcagcatgcctgcctgatttttgtgtttttagtagagatggggcttcaccgtgttagccagggtggttttgatctcctgacctcaagtgatccgcccgcctcggcctcccaaagtgctgggattacaggcgtgagccgccgcgccccgctggtctgcttttatagttgacgtaaaaggcttaattaaagtgttaaagtctcccactttcattgtagtgttttgtatttttccttttaattcagtcaatttttgcttttatattttgaaatgatgttattggataaatacagatttaaaattgtcacatcttcctagtgaatcaaaaacaacatatttgtgtgcatatatctccttcccttccttatacagaagctagtgtcgtttatacacttgtccttcatgtagtgattttaatttcttcctgaaatctactgctgagtaaacagccattaattggaaaaaatatttgcatcaatttcattaaaaaaattgtgatgcattccagccaaccaaagatactcaaatgacttttactgttaggaaaatgtattaattgaccaataaaacaagtttagataaataaaaacaatactttgaatataaaaatacagtttccgtataaaatgtattgtcatgaaggtttattggcctcattaaaaggagaagacaagatttgacagtgggggctaggcgcggtggctcacgcctgtaatcccagcactttgggaggctgaggcgggcggatctcttgaggtcaggacgagtatgagaccagcctggccaacatggtgaaacctcgtctctactaataatacaaaacttagctgggcatggtggcgggcgcctgtaatcccagctactccggagactgaggcaggagaattgcttgaacccaagagccagaggttgcggtgagccaagatcgcgccaccgcactccagcttgggcgacagagtgagactccatctcaaaaaaataaaaataaaaaataaagtcatagcaaaagttacagagaaacaccttgagggcaaaataaatactgaacccaaaagcacttccaaacacatggaaataggctgtgcgctcatcgacttcagaatcatagaatcttcagccatctcaatcgacatacatcagcaaaagcaggcatatgggatttatccaaacatgacatgcaacgcagatttgttccatatgatattgttggactagaaactgttacatagtaagtaaatgggtgagtgtgtcttcccgtgagagtgcgatgtcaaatgtcattccttatatcgtgtttactcagtgtatttagagacgaaaaagtcactaaaccaaaaaaaggagtgttgccaagaagttgtatagcttttcaagagtgtttatggcaaaagtcgttaattgaacagtaattgaacaggtaaatctgtaaactggaattcaccttgcttttttcccatgcaaatgtagattagagatgggagcagtggctcacacctgtaatcccagcacgttgaacggctgaatcacctgagatcaggagtttgagaccagcctggccaacacggtgaaaacctatctctactaaaaatacaaaaattagctgggggtggtggtgtgtacctgtaatcccggctacttgggaggctgaggcaggagaatcgcttgatcctgggaggcgaaggtgtcagtgagctgagattgcaccattgtactctagctcgggcgacaagagcgaaactccatctcaaaaaaaaaaaagtacacacacacacacacagagatttaagcaatggagtggcatggtcagaccatgctttgttttttttttttttttttttttttgaggccgagtctcactctctcacccgggctggagtgcaatggcgcgatgtcagttcaccgcaacctgtgcctcccaggttcaagcgattctcccttgtcagcctcccgagtagctgggattataggcacccgccaccatgcccggctaatttttgtatttttagtagagacagggtttcaccacattggtcaggctggtctcaaactcctgacctcaggtgatccaccgcctcagcctcccaaaatgttgggattataggcatgagccaccgcacccggcccagaccatgcttttaaaaaatctttctagcatctgatgtggagaggatgtatccagaagtacaagtcttgaaagaggccaggagactaacgtgtccaagcaaaagacgatgaggtcagtggggcagagctgagtcctgacagaggcccaaatgtgcatgtgaattctgaggatgataaaggtagcatttccaaactatgggttaagaggagctactcaacaaataatgatgagacatttcaactgtgggaaaaaagtaaagttgtatccctatttcactccaaatgtaaaaataaaatccagatggacaaaaggttcgaacataagaaattaaagaagagaccgggccttggctcacgcctgtaatcccagcactttgggaggctgaggcgggcggatcacctgaggtcaggagttcaagaccatcctggccaacgtggtgaaaccccgtctctactaaaatacaatattagccgggcatgatggcgggtgcctgtaatcccagctatttgggaggcttaagaggctcagatgggagaatcccttgaacccgggagatggtggttgcagtgagccgagatagcgccactgcactccagcctgggcggctcagcgagactttatctcaaaaaaaaaagaaagaaagaaaaaagaaatgaaagaagaaaaaaaatatagaaggaaacatgagtggatgaaaagaaatagcctgagtggaggagcatgacccgaagctgaagtcataaaggaaaaacaatatgacaacatcaaaaaacgtagttgtgggggaaaacagcatatgcaagacaaacagctgcgtgagaagcggcatctataacacattgcctgtttctcttggatagagaaaagctcttacaaataaataagaaagtaatatcgtttcatgaaaatgaataatgtacatgagtaggcagtaaacaaacttacaaaaagagacttgacctcactcataatttaaaaatagttttggggctgagcttgttggctgacgcctataatcccagcacttggggaggctgagatggcaggattacttgagcccaggagttggagaccagcctgggcaacatagtgagacaccatctctacaaaaaattttttaaaaattagccaggcctgctggtgcgcatctgtggtcccagctacttgagaggctgaggcgggaggatggattgagccctggaggtaaagactgtagggaaccatgatcatgccactgcactccagccagggcaacagagtgagatcttgtctcaataaaataaaaagtaaaaaatatttgggaggctgaggcgggcggatcatctgaagtcgggagttcgagaccagcttaaccaaaatggagaaactccgtctctactgaaaatacaaaaattggccgggtgcagtggctcacgcctgtaatcccagcactttgggaggccgaggtgggcggatcagctgaggtcaggagttcgaaactagcctgaccaacatggagaaaccccatctctactaaaaatacaaaattaggccaggcgcggtggctcacgcctgtaatcccagcactttgggaggccgaggtgggcggatcacgaggtcaggagatcgagaccaacctggcttaacacggtgaaaccccctctctactaaaaatacaaaaaattagccgggcaggcgcctgtagtcacagctactcaggaggctgaggcaggagaatggtgtgaacctgggaggcaaagcttgcagtgagctgagatctcgcctctgcgctccagcctgggtgacagagtgtgactccatttccaaaaaaaaaaaaaaaacaaataaacaaacaaacaaaaaaaccaaaaattagccgggcatggtggcacatgcctgtaatcccagctactcgggaggctgaggcaggagaatcgcttgaacctgggaggcagaggttgcggtgagccgagatcgtgccactgcactccagcctgggcaacaagagcgaaactccatcttaaaaaaataataataattttggaacaagatgatgatatactcttaaaacaaggatgaaaatgtcttcacagtcagtccaggcaacactgggggagataaaccttctcccatgctgtcgttggagtatgaattggcaaaacctctttgggaggtaatctatcgatatctatttttccccaaaaaattttaaatgaaaaatttcaaatatatagaaaagttgaaaaattatatggtggacaaccacatcactacacttaaatttgacaattgtcaacacttttgagtgtttcttttatcacgtatatctatctacccatccagcaagccatcttatattttgatgcattttaaagtaaattgcacgctggatgtggtggctcacacctgtaatcccagcactttgggaggccaaggcaggtggatcacttgaggtcaggagttcgaaaccagctcggtcaacattgtgaaaccctgtctctactaaaaatacaaaaaattagccgggcatggtggcaggcgcctgtaatcccagctatgtgggaggctgagacaggagaatcgcttgaacccgggacacagaagttgtagtgagccaagattgcaccactgcactccagcctgggcgacagagcaagaccccatctcaaaaaaaaaaaagaaattaataaaaataaattgctgacttaagtataattcaactctaaacatttcagcatacatatcaacaaaatgtgtttgtgcttcttctttaaggtaatatttacatacagtgacatgcacaaattctaagtggaccattcattgcgtgtgttctgacacatgcacaccttggtaattcaaacacctatcaagatatagaatattttcatcattccagaaagttccttctagtcccttcccagttagtcccatcctctcaagcatttttttttttttactataggttagttttgctggttctagaacctcatataaatggagttatacaatatgatttttattgccttagcttaacaaatctgctgtgctctgtttgaattccctttccctacatcagggtcataaaattcctccagaaagaaagctgagggtaacgacagggctcgtgttatttgtccatgttttctagagatcactgtcctgctctgcccattgtcaaatgtctgaaaacattttataggttttgtccagtattctagttgtttatggtgaaagaattagtccagtaccaatgatttcttcatggaaaggccaaataagggacactttgagaaccaatatagtgataacagattataaccattgaataaaatagaattcatgagcctattctgctgtaaataaaaaaaatcacacataaatgagaagaaagaaggaagacctaaggcttctgtcactcagcataatgatatttgttgttgttgttttgagacggagtcttgctctgttgctcaggctggagtgcagcggtgcaatctcggctcactgcaacctctgcctcccaggtttaagcaattctcctgcctcagccttctgagtagctgggattacaggaacgtgccaccgcgcccagctaatttttgcgtttttcgtagagacagggtttcatcatgttggccaggctggtctcgaactcctgacctcaagtgatccagccgcctcggcctcccaaagtgctgggattacaggcatgagccactggcgcgcggccagcataatgatttttgggattcatcacgctgctgtatctgttgttgactcctctttactcctgagtaggattctactgtaggaatataccacagtgggcttttccagtctcctgttgatggacatttgggttgtttgcagtttggggctcttccgaataaagctggtataaaacattcttgtgcaggcagttttggggatacgttttctcgtgggtcgcttgaagggggtacatagaacatacacaggccctcttcctggggctcacagtctactgtaacttcagtacaagacgcagtgacgtgagtacacgctgtgtgtcaggtgcagaaatgacagtaagaggcgtgaggaggtgggaagtgcttctttggggagagctaggggcggcttcttggaggaggggggctcgggtactggtacagcttggtttagtaggaggatcagaggctctgggtcagatacacctgcgtctagtctttctctctcacacacacataaagatccctgggcagtctcacttttctcagctgtaaaacggggttcatgacaccacaggatttgctggaataacgggagtaaaaggcctctttcattaaacgctcctcttttccctacaggcctggccctgctggccgctttcaatgtggatgtggcccggccctggctcacgcccaagggaggtgcccctttcgtgctcagctcccttctgcaccaagaccccagcaccaaccagacctggtgagtagggccggtgggcaagaggccttcagactgaggggcttccaggcaatctgagatgggccccagagacggccatggcagcccaccccaccccaccgtcaggagaggaactcctttctctttcagaagggcatgcaggagaaagagagaaggtgtgagagaggctgtgggcatcgggctggtctgtggggtccacggaaccccagcctcacgcctcactgggcctctccctgctccattgcccagggggagggtggacttaaagacaattttagtggccgggcacggtggctcacgcctgtaatcccagcactttgggaggccgaggcgggcggatcacgaggtcaggagattgagaccatcctggctaacacggtgaaaccctgtctctactaaaaaatagaaaaaattagccaggcgaggaggcgggcgcctgtagtcccagctactcaggaggctgaggcaggagaatggcgtgaacccgggaggcggagcttgcagtgaaccgagatggcgccactgcactccagcctgggcgacagagcgagactccgtctcaaaaaaaaaaaaaaaagacaattttaaaataaagcatattaaggctcttttgttccttatggaagtaacacatgttcaatatagaacatttggaaacaaaaaataacaaagaaaaaactgggcctggcaccgtggctcacgcctgtaatctcaacacttagggaggctgaagctggaggatttcttgaggccaggagttcaagaccaccctgggcaacatagtgagacccccccaactcaaaaaaaaccaaaaactgtctgggcatggtggtgcctgcctgtagtctcagctacttgggaggctgaggcaggaggaccacttgggcccggaggccgaggctgtagggagccgtgattgcaccactgcactccggcctgtctccagaacaaaaaccctgaaactatgaggaacaagcgtgtactggtaagaggcaggctgtggctctggcagccagggttcagtggcagcttcaccgtggatttgccgcatagcctgagcaaggtgctcgggcctgagcttcagtttcccttctctgcagtcagcgtggggaactacctacttcacaggattgtcgcaaagactatttgagataatgcatgtaaagggcttagcacaggttctgccgggcgcggtggctcacgcctgtaatcccagcactttgggaggccgaggcgggcggatcatttgaggtcaggagttggagaccagcctggccaacatggtgaaaccccgtctctactaaaaatacaaaaattatctgggcgtggtggtacacgcgcgtagtcccagctactcgggaggctgaggcaggagaattgcttgaacctgggaggtggaggttgcagtgagccaagatcgtgccattgcactacagcctgggcgacagagcaagactccgtctcaaaaaaaaaaaaaaaaaaaaagggcttagcacaatttctggccacattaatgctcaataaacattactttacattttttaaatatcatctatacccacctattagataagcaaaatgtaaaatctgccaacattgctggtaaggttgcggtgaaacagggacgtgtgggagtgtgaattgcgatcaccaccttggagagcaattttgccgtatctggtaaagctgaggatgcacgtggcctctgacacttccactccccgatcccagctctagagaaattctcagacacatataaaaatgtttgtgtgccgggcgcagtggctcacacctgtaatcccagcactttgggaggccgaggccggtggatcacctgaggtcaggaattcgagacctaggctggccaacctggcgaaaccccgtctccactaaagatacaaaaaaaaaaaaaattagctgggtgtggtggcgggcgcctgtaatcccaggttcttgggaggctgaggcaggagaattgcttgaacccaggaggtggaggctgcagtgagccgagatcgtgccattgcactccagcctgggtgacggagcgagactctgtctcagaaaaagaaaagcaagcaaaaaatgtttgtggtagcattgtttggaatcatgaaagactggcaatattcctcttaggaaaatgggaaaaatactgatatgactcatgcaatgcaatactaaaagcagatcccctgaatgaagccagtgcaatggttgtttacctggatccatctggaaacataccgtgagttgaaaaaggcaagttgtagaatttaatatacaaaggttggcaggtgcagtggctcacctgtaatcctagcactttgggaggtcaaggcgggtggatcacatgagcccaggagttcgagaccagcctgggtaacacggtgagaccctgtctacaaaaaatataaaaaaatcagccggatatggtggtttaagcctgtagtccgtcccagctattgggaggctgaagtgagagacctgcctgagcccgggggcgggtgggtcgaggctgcagtgagccgcgattgtgccactgcacttcagcctgggtgacagaacgagaccctgtctcaaaaaaaaaagaagcaagtaagtaaaatatgcattccctcagatggcgatggtggccgcgtgctgatgtaggagtgtgtctgcagttaggagaagctctggtggaaagggtcatgagatccgaggctcatttgaatttcccatgtgtcaccaaaatgacttttatttatttctttacctattatttatttattggagacagagtcttgctctgtcacccaggctggagtgcagtggtgtaatctcagctcactgcaacctccgcctcctgggttcaagtgattctcctgcctcagcctcctgagtagctgggattacaggcgcccgccaccacgcccagctaattttttgtatttttagtagaaacagggtttcgccacgttggccaggatggtcttgaactcctgacctcaaatgatctgcccacttcggcctcccaaagtgctgggattacaggcatgagccaccgcacctggccccaaaatgacttctagtgctgtgttgttttaaagccagatctggtcaaggtttatgtattacgtattgctgttatgtctctgtcattgatttcaatccaaagcagtgatttctcccccatttttttctgggtggtcatagggcttttcttgtgcatactctcccactgagcgggcccagcctaggatggttacctcctcatcccaccccagcccaccagattgctttgctcctggtcagtggtcaagggtttccttcacacccagcacacaggagcaagtgagcccagggttcaaacaggcactggggcagagccaggtgaggagccagggttcctggctgggcagggcgggagctttgcttgaataggatgggtgggcagtggtggctcccgaagcagcctcataggccctgggacttgggccttgaccctgacagccaggcagacttggatcctgtgatactgtgaaatgtatatttgacattccaagactgaatatatattttacaatataacaaataaaaatatatttggtctcaaaataaacatttggtcccattatctggcatacatgcctaaaatctctggaatctccaaagtaataaatgtctttttctttgttaatgagttgacgggggaccggcagcccccagatagcttcaaaatgggggctggtcactggagagaaccaggcacgatcagagggttgggactttcagccccacacccctcttctgggagagaagggctgaaggtttagttgatcaccagcggccagtgattcaatgagtcatgcctatgtaatgaggcctccataaaactcaaaaggacagggtttggggagcttctgggtagcagaacatgtggaagtttctggagggtggcccccgagagggcatggaagctttgcccctcacccccactttgcccctcacccccactttgccttatgcatctcctcatctgtatcctttgtaatatcttttttttttctttttgaggcagagtcttgctctgccacccaggctggagtgtggtggcatgctctcggctcactgcaaccactgggttcaagcgattctcctgcctcagcctccctagtagctgagattacaggcgcctgccaccacgcccatctgagttttgtatttttagtagagacggggtttcaccaatgttggccaggctggtctcgaactcctgacctcgtgatccgcccgcctcggcctctcaaagtgctgggattacaggcgtgagccaaggcacctggcctgtaatatcctttataataaaccagtaaatgtcggtaagtgcttctctgagttctctgagccactctagcaaattaagcccaaggaaagggtcccagaaaccctgatatggttgtttggtcgaaagcacaggtgaaataaccggcggctggtgatgggcctcggaagttaggagcagtcttgtgggactgagacctcgacctgtgagggctgatgctacctccaggtggagcatgtcggaattgagttgaacgtgaggaccttcagctggagctggttgccgaaggactgcttgccccgtgtggagggaaaaccccacccacctggggtcactggactgttctgtgttgtgagagctgcaggggagacagagctcgacgtttcctacatcattagagagtcctttctggatcctggtttcatcggtgcagtcaaaagtctggtcactgccaggcgcggtggctcacgcctgtaatcccagcactttgggaggctgaggcgggcagatcatttgaggtcaggagtttgagatcagcctggccaatatgctgaagccttgtccctactaaaaatacaaaaattatctgggcgtggtggcgcgcacctgtagtcccagctgcttgggaggctgaggcaggagaatggcatgaacgcgggaggcggagcttgcagtgagccgagatcgcgccactgcactccagcctgggcgacagtgagactccgtctcaaaaaaaaaaaaaaaagtctgctcaccattagatttaagtggtaaggatggggccaattcattcattcattcattcattcattcagcaagtatggatggagcacttactcagtgccaggcaatatttggggaataagagggagacatggtcactgccttcatggagctcccgggctcatgagggaaacacaagctagacgatgacaagagtgacaatgaccccaccgaataacagctctgttgggggacgtccgaggtacgggggggcgcatcgaggcaggtgtgttcatcagcgtctactaggatttgcagggtgactgggaattagcatgagaaggaacgggaaggggatggcaggcacagagaacagcttgatcagaagcctggaggccggctgagtaaggtcaggaaactgagaaaatcacgtgtggctaaagctgacagtgatgaaaagtaagctgggagagtgtggtggtgcctcgtcacccaggcactgagggtttggaggaactagagggtctgaagccgggaggggtggtgaggttttcagggagttttgtgttgcacgaagatgaattaaaggtcaagattgtgtttggtttgggtaaaattttatcaacatgtgccatacagaagaatgcacacccggctgggcgcgggggctcacgcctgtcatcccagcactttgggaggccaaggcgggcgggtcacctgaggtcaggagttccagaccagcctggccaacatggtgaaaccccgtctccactaaaaatataaaaattagccgggtgtggtggtgggcgcttgtaatcccagctacttaggagaggcaggagaattgcttgaacccgggaggtggaggttacagtgagccaagaccgcagcattgcactccagcctgggcaataagaatgaaactctgtctctccaaaaaaaaaaaaaaagagagagagaaaaatgcacacctcataagcatgcagcgcagtgaacatccgcagagtgaagcactgtgtaagcagcatgcagatcaagggcacgtgagctgcggcgcctaggccccctctaagccccgcactcccttccagacacatctgctgccaagagtaacccccagctgactttcatctccgtggattagcctcgcctggttttgcatttagtatcaacgaggcatacggtgtgtgccccgctacgtcgggctcctctctctccacataaggcctgtgaatttcatccatcctgttgccccaggcggtacttcttctggttgccagggttacattgtgtcgacagtactgatgattggcatttgggctgttttcttgggctgtgatgaatagcactgatgtgcacctccttttgatggatgaatgttcttttttttttttaatccctcagagttgatcccaaagaatgtactcatttttggggagggcatatgtgctcaggagtgggattgctgggtcagaagttatgcaattggttctgcattcagttttccatactgtttgtagggtgtgagcaggtttcagtcagcgttttctgtaactgtctcctgcctagttccctcccaccaatacccagcgaccccacgcctcagctccaggtcccaccgacattcacagtccctctctcagaagcctaaaggccagggtgcaggagagagtttggagcccgtgtcgcagagggctctgagtccaccaggggctgggggagggcccagcggggctccctgaacacctgctgaagcagagaggggctcccaggcttgaacacgctggggaggaggatgtggtgggaggcacttctgggttcctgctgcagagagtggggcctgagaccacgggcctgctgcatggggcaggaagtgcgctggctggccaactcgggcctagaaaaaggcaggggctgtgctcctgcttgagaatgacgtgtgcctctcactcacattgtctctcttaaaatgtaagagaccagggctggcagcatcatgggttttggttgccacagaaggtatgggtgggacagacagcagacatggaaatagaccctgagggctgggcatgggggctcacacccgtaatcccagcactttgggaggctgaggccggcagatcacttgaggtcaggagttcgagaccagcctggccaacatggtgaaaacccatctctactaaagataccaaaaaaaaaaaaatttagctgggcatggtggcaggtgcctgtaattccagctactcaggaggctgaggcaggagaatcacttgaacccaggaggcagaggttgcagtgagccaagatcatgccattgcactccagcctgggcgacagagtgagactccatctcaaaaaaaagaaaaaaaaaaaaaagaaagaaagaaataaaccctgagaacaggacaggttagagctgggtgaaggcaagatgtgagcttcaagtcagtgaccagttaaaaagattgttaaacatttaaatacaaaatactaaataaggtcaggcatggtggctcgtgcctgtagtctcagcactttggaaggccaaggcaggcagatcacctgagctcaggagttcaagagcagcctggccaacatggtgaaaccccatctctaataaaaatacaaaaattaaccgggtgtggtggtggcacatgcctgtaatcccagctactcaggaggcagaggctaaggcaggagaatcacttgaaccagggaggcggaggttgcagtgagccgagatcacgccactgcactccagcctgggagacagagtgagactccatctcaaaaagcaaacaaacaacgaaaaacatactaaagcaataaataaaggcaggagatggacaagggttgctgggctgtacccagctcagggtgtaacagggcccctgtggctgcgagctgatggccagtcctctgtcagagctggtgggtcaatggtttgtcagccacgtggtcaacaaacctgcaaactcccggcagtgggggataaaaggtgtgggaagcagaggcagctcagagggccccaggccatgtcattgcatgatggcggcatgaatggcagtcttgggatctgcagtgcgcaccctgcacagctgttcatgatggcctcctgggaacgcgcagtccaggtgggaagaaagggtgggggtggggtgctatagtcagggctgctgcagggcctggaggggatcaggctgcacttcctttgggaaggcttcctgaggagctggggtttgggatgattgctctgcagcaggagggatctcaggcagaggaaacagtccgggcagaggactgaggaggagagagactggaggcgggtccaggcctgcacctaccccaccaaaacggggtctgcggtggagcccagttttgaccccacccttcctgggggagcagggaaggagatgctgggtctagggctgaggtcggggctggggagagaggcagggttgctaaggaagcaacctaatttgggggctcagctgcagagccggaacagaggagcagctctctgctgcacccagccctccgcccctcagccctgccccagatgagccccctcagctgttgcctgggctgttgttcaatagtcactcaacacttactgagcccttgttctgtgccaggcattgctccagaccctgggaataacacagtgaagaagatagacaagatccttcgggagcctactgtctcgtggggagacagataataggcactatcagatgatggcaggttctgagaaggaaatcaaacagggtgatgtgaagcagagtaactgggttgtgaggcacggctgggtagagaaagcatttatgaggaggtgacaggcgaggctggggaaggagaataagccaaccttggggagagtggaaggtgagggctctgggaataggaaacagcgcggtggagggaacagtgccgtggagggaacagcgccgtggagggcctgaggcaggaaatgctggcgctggtcacccaggaactggggctgccactgacagaagggacattggtgtaaactacatgagtgggccaggtgctgtggctcatgcctgaaactcactgtaactcactaggctcactcccagcagtttgggaggccaaggcaggaagattacctgagcccaggagttcgagactagcctgggcaacatggcaaaaccccatctctacaaaacataagaaaatttgccaggtgtgatggcacgcatctgtggtcccagttacttgggagactgaggtgggaggatcgcttgagcctgggaggtcaaggctgcagtgaaccgtgatcatgccactgtacttcaacttaggtgacagaaggagactctgtcttaaaaaaaaaattacatgagtaaattaaaaaccaaataagtgggccaggcacagtggctcacttctattaatatagaagttttcttgtagttttggaggccagaagtctgaaaaggtgtcagcagggctgggtcccttctagaagctctgggggagaatctgttttcttgccttatttggcttctagaagctgcctgcattccttggctcacggcctcctcctcctcaagcctgcagcatagtaagctttgcatctttctctgacactttggaagaccaaggtgggagtgcttgagcccaggatcagcttgggcaacacagtgagacttcatctctatagacaaattaacaaaattagctgggcaaggtaactcgctcctgtaggcccagcaacttgtgaggctgaggtaggaggattgctgagcccgggaggtcaaggctgcagtgagctgtgatcacactactgcactccagcctggacaacagagcaagacactacctaaaaaacaaacaaaccccacaaaataacaggaggctattaccatcaacaaggccggacgatgatggaaggagcatctggagaagagttgctttctagaaataatttggagagtcaggcacggtggctcatgcttgtaattccagcactttgggaggctgaggtgggtggatcacctgaggtcaggatatcaagaccagcctggccaacatggtgaaaccctgtctctactaaaaatacaaaaattggccgggtgtggtggctcacacctgtaatcccagcaatttgggaggccgaagtgagtggatcacctgaggtcaggagttcaagaccagcctggccaacatggtgaaaaccccatctgtactaaaaatacgaaaattagctggtcatggtggcgggcgcctgtaatcgcagcactttgggaggccaaggcaggagaatcgcctgaacccaggaggtggaggttacagtgagccgagatcgtgccattgcactccagcctgggcgacaagagtgaaactccatctcaaaaaaagaaaaaaaaaaaaaagaatttggagagagaaccaacagggttggcaggtggattggatgtagggcatgagtgaaaacacgacgaagtgaggatgcctcctgggttttgccttgagaacttagtggttgctggtgccatttgctgtggcggggaagatgagaagaagcaggcttgacaggaaagaccacaggttctgtttgtttcctatcgacgctgtaacaagttaccacaaatgtagtggcttacaacaacacaggtttattattattattattattattattattattattattattttgcactctttcacccaggctggagtgcagtggtgagatctcagctcactgcaacttccacctcccaggttcaagtgattctcctgcctcagcctcccgagtagctgggattacaggctttcaccactatgcccagctaatgtttgtatttttagtagagacggggtttcaccctgttggccaggctggtcttgaactcctgacctcaggtgatccgcctgcctcggcctcccaaagtgctgggatgacaggtgtgagacactgagcccagctgcaagtttattatcttgtagttttggaggtcagaagtctgaaaagctatcagcagggctgggtcccttctagaagctctgggggagaatctgttttcttgcctttttaggcttctagaagctgcttgcattccttggctgacgggctcctcctcctccttaggcctgcagcatagcaagcttcacatctttctccgactctgattctcctgcctccctcctagaaggacttttgtgattacactggggctttacagcccagccaggacagccctgggggcttctgggatgggagaggcctccttgggaggctcccagcattccctgcagtctcgccacttctcccctctgcctgcctcaacgtccccctgagtccctgcggctcgcccatgccaccgttttcggggcctccctcatagaaggacccttgtgatttcactgagcccacctagataatccaggataacccccccatctcatgatccttaatttattaactcacatctacgaagtcccttttgccataaaaggcaacatattcacaggttctggggattaggacgtggccttctttggggggccattattctgcctacgatagcagatggagaggtgggaatttcagccgttataggtgtattgaagccatgggcttggaagggatcactagggagagtgtgccggcaaggaagacagtgacccagcccccagatcctggtggcagatagaggtcagaccgcgaaggcaccagcgaagccttgaggaatgaggagagagtaggcagaaatctagaaaaaagtgttcgaaggagatggttactcatgtttggggcttctgagaggttgaggaagatgaggacagagagcggtccgttggatgtggcattgtgggggcccctggtgaccttcacaggaactgactcagagggtgggaagtcagcttggggtgggttcagttgtgggtgggcggatggacgcacaggtgcagactttcttattattctgtaagccatgccgatacgtgaatatatttcataatgtattaaaatgtagagtgataggagttgaggaagtggagacggtatctcatttctgccccaccttcctgtgctctttagtctgtcccaacccactgtagccacatcatgacctttttttttttttttttttttttgagacagagtctcgctctgtcacccaggctggagttcagtggcgtgatctcggctcactgcaacctctgcctcctgggttcacaccattctcctgcctcaggctcccgagtagctgggactacaggcacccgccaccacgcccggctaattttttgtatttttagtagagacggggtttcaccatgttagccaggatggtctcgatctcctgacctcgtgatctgcctgcctcggcctcccaaagtgctgggattacaggcgtgagccaccgcgcccggcctcatcatgagcttttgaaagcacagctaatcatgtgcttcccctttataaagtcctccatgacttctactgccctctgcagaaagaccttggacttggttcactgttaaccaccaagcccctcgtcccctccccaccatcccctatgacaacccccggagctcactgtctgtctcaggacagcccagttctcctgggtaacgtggatggtgagaatgttgaggctgtccctggaatctgccgtctccctggactgggcctgggtgggggcaagaagtttgcagtcaggaggcgcagctcttgaggctgccttaatcaggctgaggcagccacccccaaacctccagttcttttatttatttatttatttatgagacgaagtcacactctgtcccccaggctggagtgcagtggcgtgatctccgctcactgcaacctctgcctcccaggttcaagcaattctcctgcctcagcctcctgagtagctgggactacaggcacacgccaccatgcccggctaatttttgtatttttagtagacacggggtttcaccatattgatcaggctggtctcaaagtcctgaccccagatgatccacctgcctcagcctcccaaagtgctgggattacaggcgtgagccgccgcgcccggcctccaaacctccagttctgactgacccacaggataggggcaccagcgtactcttctcaggaactaaggccaggcagggcaggccccctgggtggcccacgaggaagccagcactgcccccaacagaaccaaccccaacgctggtggttttctggcctccccatccctgtccccataagagagcagagtttttattaaccatcagtatcaccccttctttgtcagggtgggcagcaggcagagaggggttgcatttaaccatttcctgcctggtgctgtgtagaagcagaggttgggcaaatgtcttccccataatccagagtctgggctaggaatctgccggccagacagggagcttgtgagtgcaggcaactggaatgggaagggtgctgggcaggcagggagaagacgaggaacatcagccagctcagctttgcaacctcccctcccactcaggctcctggtcaccagccccagaaccaagaggacaccagggcccctccatcgatgttcccttgtccaggatgaaatcctttgccatcctgtaggtaagtcagccccaactccagggaatgctccccaggaccccctttctagcaaaatccccctcatctaaactcaaaccattccaaccccagccctgcctcatccagcccgttcacccctagactccagcataacccacagcaagattccatcccaatgcccagtcccaccccaacccaatcctaatccccagccacctttcctgacacagtcctagcaacagaaatgatacctacagcgtattgcgtgcccaccctgtgcccggcagtcctctgagtcattctgttttcatcctcaaaaccgcgccatttataagagaggaagctacagttcagagaatgtaggtcttttggttgccagtatgacaaagttcacacttttagtgttggtggctgattcgaaactctagcccttcctgatgcaagtcatcacacctcagtgcaattcaccccctacatattcagtctaactgtggccaccctagtaactagcatggggcctgacatatattaggtactcaataaatgccatttgaatgaatgaatgaatgaatgaatgaatgaacctgattcactcattaaactctatccatcctacccagtcaaactcaggtcacagatttactgacaacctcttggctatatatatataaataaatagaatccttgtcttgtctgaggctgggcgccgtggctcacgcctgtaatcttagcacactgggaggccaaggcgggtagatcatttgaggtccagagttcgagaccagcctggccaatatgatgaaaccccatctctaccaaaaatacaaaaatcagccaggcgtggtggtgcatgcctacaatcccagctatttgggaggctgaggcagaagaatcgcttgaacccaggaggtggaggttacagtgagctgacattgcaccactggactccagcctgggcaacagagcaagactgtttaaaaaaaaaaaatcctgccaggcacggtggctcatgcctgtaatcccaacactttgggaggctgaggtgggccgatcatgggtcaggagatcgagaccatcctagctaacacggtgaaatcccgtctctactaaaaatacaaaaagaaattagccaggtgtggtgacgggcacacgtagtcccagctactcaggaggctgaggcaggagaatggcgtgaacctgggaggcggagcttgcagtgagccgagattgcgccactgcactccagcctgggcgacagagcaagactctgtctcaaaaaaaaaaaaaaaaaaaaaaaaaatccttgtctgagaggcactgagttgaacagactcaatctcagtccagcagggttgactgagtgattccatgactgaaaaataagacagtatcctgaggctgacagtggggaggacgaggaaggagctaccatttctgcccctgaggctgggggcagtaagattccccaggatgggtctgtgaggctggggggttccttggtccacacagccagtcccacggtatcttgcacattccttggcacttacatacccaccaggcagtgcttctccacccacctgcccgaccaaacccactgaggaaaagcagcaggcatccgctgttgctggacgcccatcaccacgctcacaaggctgggcacagagcagacgtcaatgggcacgtgttgaaagggtcagcaaatgagccccggggatgggcactcggccctgaacgtgtccagtcctgaccttgaaggcccccgctctagctttctagaggcttctctgagtggccaacagttcctcatgggggcctgaccaaggtggctctgtgccctctgaccttggcttcgggtctctgcctcccagagtcccctcctcctcctcacctgggcttaactttttcagagcatgtccccatccccaaggggaggcaccggggagtgaccgttgtccggagccaccacggtgttttggtgagtgcaggagcgagaggagggagggccttagggaggctggtgctagccctcgtggttgaccctggtgttgagaccagttctgactgccatgctgttcccgaggctgagtctagcgtctccctggtgccaaccccagggctgactgtagctctgaccaccctgataccagggctgacctaggtattccctgtgacccagcacactcctgcaggtgtcggcctcggccttgatgccaacactgactcctacacccggtgaggggtgggccagctcttcctgtgccccctgcctggttgagccactgagttctggaatgggggtgagaatgtggctgtggctcgggaatcgggaggtgacctggtgtttccccaccctctcttccctcccacagatatgcattcaagtgctggtccggcggcctcacagcctcagctcagaactcacaggcacctgtagcctcctgggccctgacctccgtccccaggctcaggccaacttcttcgaccttggtaaggattggacattcactggccttggatagctctaaagagatctccttggtctccaagaaaaggcaccagctcacggcagatgcagtgggacgcaggcccacagtggagcaaggcagggttgaggcatcacgtgaaaggaatcagggcagaaccatgtgtgagcgtgctcaggcgaggatggagcctttctgactctgagctcttccatgtgtgtttttaaagaaaatctcctggatccagatgcacgtgtggacactggagactgctacagcaacaaagaaggcggtggagaagacgatgtgaacacagccaggcagcgccgggctctggagaaggaggaggaggaagacaaggaggaggaggaagacgaggaggaggaggaagctggtgagaagaggcagatctgggttgctctgagtctatcagagccaattcctaggctggtggcctccaagggtgaggggtgcctcagtctgagagatggggagcagtggctggactttacagacctgacctgtaccagctccacccactctttcttataagtggggaaactgaggctcagagagtggtagtgatgggaatggctcacacagcacacaaagcctgaccaggttctagctctctttttgaagggggagacaaaagcttctctcttggggccaggtgaggtggctcatgcctgtaatcccagcattttgggaggctgaagtgggcggatcacttgaggtcaggagttcaagaccagcctggccaacatggtgaaaccccaactctactagaaaattcaaaaattagccaggcatggtggtgtgcattatagtcccagctacttgggaggctaaggcaggaggattgcttgaacccgggaggcggaggctgcagtaagctgagatcccaccactgccctccagcctgggcaacagagtgaagctctgtctcaaaaaaaaaaaaaaaaaaaaaaaaaaagcttccctcttgggagcttctccaacttcttccctgaactgagctggttgtcagggctgcagtgggggtgcatgccctacacatgctacccttacatctgcctcacatcccatgcccactcctgacctgtttgtcttggccaggcaccgagattgccatcatcctggatggctcaggaagcattgatcccccagactttcagagagccaaagacttcatctccaacatgatgaggaacttctatgaaaagtgttttgaggtgggcttccctaagagctggttaacacttatctattgctgagaatcaccctacctcagaacaacaatcaccacatttgctcacaattctatgggtcacatacttgggctgggctcagctggatgattcttctgtccatcttgcctggagttaccctggagctgcaggcgtctggttgcttgactggggctggatggcctaagatgacctcacttacttgtctggaccatgtgtctttagcaggccagcccaactttttcgtggcagcaacattctaagagggccagatccaatgcatgcaagtatttttcaagtctctaattacatcacatttgctgatgtcttattggccaaagccagtcacatgaccaatcccatcgtcagtatggagggcactacacagggagctggggagaagtctgtgattcactgggggcctttactatcgcacccttctccacccctactcgcttagagattttgctctgccttagcatctctttctgcccagggataaggtagaaggagtggatttttctgctgcttccagcgggagacatttcaggggcagaggtggcaattcttccaacctcctgccctcctgcccatcccctgcagtgcaactttgccttggtgcagtatggaggagtgatccagactgagtttgaccttcgggacagccaggatgtgatggcctccctcgccagagtccagaacatcactcaagtggggagtgtcaccaagactgcctcagccatgcaacacgtcttgtgagtgtgggggctgcaggaattattctggccatgcccagagtctctgtggcatcactcatggaggaagtggctggccagaaccgcaggagaagagaattagggctccagcctttccctggccgagagagaacgtgagggatgacacctcaaggctgtcctccaaaaagtcttccaaagacttcctcttgtgagatgcaggagagcagagtgctcagtggacaggctggctgggttcaaatctcagctctggttttttttttttgttttttttttttgagatggagtcttgctctgtcacccaggctggagtgcagtggcacgatctcagctcactgcaagctccgcctcccaggttcacaccattctcctgcctcagcctcccgagtagctgggactacaggcggccaccaccacgcccagttaattttttatatttctaatagaggtggggtttcaccatgttagccaggatggtctcgatctcctgacctcgtgatccgcccgcctcggcctcccaaagtgctgggattacaggcgtgagccaccgcgcccggcctcagctctggtttgtatctgtgtgaccccgggcaaactgaaggaccttgtgacctgtgcttcagtttcctcactttaaaaatgagaaaaataggctgagcgtggtagctcatgcttgtaatcccagcactttgggaggccaacacaggtggatcacctgaggtcaggagttcaagaccagcctggccaacatggtgaaaccccgtctctactcaaaatacaaagttagctgggtgtggtggcaggtgcctgtaatcccagctactcgggaggctgaggcagggagaattgcttgaactcgggaggcagaggttgcagtgagctgagatcgtgctattgcactccagcctgggtgacagagcgagactccatctatctcaataataataataataaaaataaataaataaaatgagaataataatagtactcacagcttggagcagtggcttgtgcctatagttccagctactcaggaagctgaggcaggaggattgcttgagcccagaagttcaaggatgcagtgagccatgatcacaccactgcactccagcctgggtgacagagtgagacgccgtctctaaaaaagaaagaaaaataatagcacttgcctgatagattttgtgacggttggatggcttaaaatatacagtgtttacaacagtgcctggcacatgataagtgccatgtgagtattatctatcgttttaatatcatgagtcttcctgtacgcacacaagaggaatggactgccaggcagtaccttcctgctgggagcaggtgagaagcaagaacacctgtgttgcagccctccctctgcccagcctcgctgcgtgacttaagggggcatcacccccttctctgggtctttcgggaggattgtgaaccctcccaattctaatacaggtcagagaataaagtctctcctggagctcggtcatccttctggcaaagctctcttcttcatttactctcccctgcttagagacagcatcttcacctcaagccacggctccaggagaaaggcatccaaggtcatggtggtgctcaccgatggtggcatattcgaggaccccctcaaccttacgacagtcatcaactcccccaaaatgcagggtgttgagcgctttgccattggggtaagagccaggagccgggagacacctcctgaacctgcacagcctggggtggggagaagccagggttgtcgatgggggcttttctgtaagcagcttatccagaccctgttctatttgcaaatgctcctcttctcttcatgctctgtcatcccagagagggctcatttccccatggtggtcacagcttactggccaaatagtggtgggagagccacaggaaacacaccaaggagggttcctggaggaccgtggtgccaagctgagtcctgccagacaaatgggagtagctggcctagggcacaggggaggcagagaggggccctgcaggcagagggaacagcatgtgcagaggtgaggaggagcttggtgtattcaggagaacaggtgtactttggtaaaactggaattttgcccagagtatgggtagaacagggagcagggaaaggaggagaaaggaaggaaggagacaggtaatggagggccccagaggccagatggaggggctcagctctctccctgggcctggggaatccacgcagcgctgactcgctgacccaggctgtctgtgcaggtgggagaagaatttaagagtgctaggactgcgagggaactgaacctgatcgcctcagacccggatgagacccatgctttcaaggtgaccaactacatggcgctggatgggctgctgagcaaactgcggtacaacatcatcagcatggaaggtgagggctccgggacccaggccaccgcaggaggcccgagcctatgctccagcccggcctctgtcccatcttcatgtggtttctctgagcaactcccatcatctccctgaacctcagctcttccatgtctaaaaaggcaatggccgggtgtggtggctcatgcctgttatcccaacactttgggagacagaggcaggtggattgcttgaggccaggagtttgagacccgcctgggcaacatggcaaaaccccatctctactaaaacaaaaagtagctggggccaggtgtggtggctcacgcccataatcccaacactctgggaggccaaggccggtggatcacctgaggtctggagttcaagaccagcctggccaacatggtgaaatcctgtttctactaaaaatacaaaaaaatgtagccaggcgtggtggtgcatgcctgtgatcccagctactcaggagcccgagacagaagaatcactcgaacccaggaggcagaggttgcagtgagccaagatcgcgccactgcactccaggatgggtgacagagcgaggctccatctcaaaaaaaaaaaaaaaaaaattagccaggcgtggtggcgcatgacctctattcccagctacttgggaagctaaggcaccaggtcacttgaccttgggaggcacaagttgcagtgagctgatattgagccatggcactccagcctgagcaacagagtgagacactgtctcaaaaaaaaaaaaaaaaaaaaaaaaaaggcaacaatatccccaggcctccttgcgtcccagaatctccatgaagctctgatgaactgagctggtgctggagaaacaaggatggctggggcatagtcccttctcccaggagctcacagacgaggaaactgaggcctagaaagagtgaactgcccagatagtagttgctcaaggagaacctgggtctctaccctcagccgggttctcttcctgttacaccaagcatggttccttctgggagtgaggccaagctggactgtcccctgactcagtttctcccttcacctcggcccacagcagtctcactgggcttcttggcttgcaggcacggttggagacgcccttcactaccagctggcacagattggcttcagtgctcagatcctggatgaggtacgtggctgactcagcaccaggcaggcttgcccattggtgaggggcccaggacacctaggattcagggactcctgcctcccatccagggctctgccctacctgtggtgattcctgtaaaagagcgattttattttaattaattaatttatttatttattttgagacggagtcttgctctgtcgcccagtctggagtgcagcggtgcaatctcggctcactgcaacaaaagggtggccatattgatgacaggaggtcgcttttttctgtgtgctcaaacatccagttgttcccctgaatacagaccaggcaacaggactcggcctgggtcagcttatcaaccaagctgcttgcttctcccggaggagggagtgcaagggcacgaggcaggagcccagtgttggccatctcaccttcccgcctgcatctctggccaggcgggcactagaccaccgaacgcccccctgctcccagccaggttagccgcgctggcccggagacccgcggccaccgtggcccggccttgggtccctcccactcatctgggccccatccccgtccccttcagcggcaggtgctgctcggcgccgtcggggcctttgactggtccggaggggcgttgctctacgacacacgcagccgccggggccgcttcctgaaccagacagcggcggcggcggcagacgcggaggctgcgcagtacagctacctgggtgagggcggggccacctgatgagggcggggccacctgatgagggcggggccacctgatgagggcggggcctggaggctccctgggcgagggtggggcctgagggctacgtgggcgagggcggggcctacctgggcgagggtggggcctgggggctacctgggtgagggcggggcctggaggctacctgggcgagggtggggcctgggggctacctgggtgagggcggggcatggaggccacgtgggcgagggtggggcctgggggctacctgggagagggcggggcctggaagttacgtgaggagggtggggcctggagaccacctgggtgagggcggggcctagaggccacctgggcgagggcggggccgagatggggacaccgaggctgcgcattaggctgcacttgaggtttccggatgggggcgggacctggtcagtcacatgggccgaggggcgggtcctggttagggaccctgaggctgagtactacagcctcctgggtaggtacaaggcctgtcaggtacaccaggcacagcagccacccaggggagggcggggcctctccattaataatagtggtgcagtagctcacgcctgtaatcccaggaggccgatgcgggcggatcatctgaggtctggagaccagcccggccaacatggcaaaaccctgtctctactaaaaatacaaaaattagctaggcgtggtggcggatgcctgtagtcccacgtactcggaaggctgaggcacaagaatcgcttgaacccgggagggggaggttgcaatgagccaagactgtgccactgcactccagcgtgggcgacagactgagactctgtctcaaaaataaataaataaataaataaaaataataatagtggtgggcgtcctctcacccctcttctccgtcctcctagggtgtgtgtgggagcgtgggtagtgaatgtgtgcgaacgagtatttcgagcaaagctgcatacgtgacagacagcgtgtgcatcatatctgtgtgatggggatgtgtgtgactggcaaagtgagagtgctcgctgatgccgatttttaacatagtgagaaagacagtctctcctattttgcccccctccccaggccactttgaaggcctgactgggaaggtgccggggccaagagagaggccaggtgggagcacacggtgtgttcacagccacaccacccttgccccaggttacgctgtggccgtgctgcacaagacctgcagcctctcctacgtcgcgggggctccacggtacaaacatcatggggccgtgtttgagctccagaaggagggcagagaggccagcttcctgccagtgctggagggagagcaggtacctgctggggaaagcctccaccccttatgaccgatggggaatctggaggcccccaagggaaaggagtgggtcccacggtgcacagtgggccagggcccgggctgggtgaaactcaggctcctgagtggagctcgagggctctgcttcagctctgcatgtctgattgctaggcagtttcctccgctgtggggcctgggctgctcctccactcttctgttactctcagtgagcaaattgatatgtaacgacccaaattgggtggtccaggaagcacgcgggcaggggtgtagccttgctgaggggtgcaggagcggggctcctggtgagctgagttcctcccgggctgtagatggggtcctattttggctctgagctgtgccctgtggacattgacatggatggaagcacggacttcttgctggtggctgctccattttaccacgttcatggagaagaaggcagagtctacgtgtaccgtctcagcgagcaggtgggagagtctccatcttcatgagcttgctgaggctgtggcactcagcctgacacagaggtgatggaggctgggagtgccctggccctgcctggcaccagtgggcagtgatggggaggtgctcaggctggatggcggctgggcggggcagcggcatcgctctccgcacccactttcttacccaagggtgatcgttgatgataatatctctaatatccctttttttgtggttgttgtttttgagatggagttttgctctcgttgcccaggctgcaatgcaatggcaggatcttggctcaccgcaacctctgcctccggggttcaagcaattctcctgcctcagcctaccaagtagctgggattacaggcatgggccacacacccggctaattttgtatttttggtagagacagggtttctccatgttggtcaggctggtcttgaactcccgacctcaggtgatccacccacctcggcctcccaaagtgttgggattacaggcgtaagccacctcgcccagcatttttttttttttttccgagactgagtctcactctgttgtccaggctggagtgcaatggtgcaatctcaacttactgcaacctctacctcctgggttgattctcctgcctcagcctcccaagtagctgggattacaggcatgtgccactacacccggctaatttttgtaattttagtagagatggggttccgccatgttaaccaggctggtctcgaactcctgacctcaggtgatccacctaccttggcctcccaaagtgatgagattatgggcgtgagtcaccgcgcccagctgataacatctcttacagctgcatggttggcaaagcccgtttagtccaggatctcacttgtttctcatagtaactatgggaggtagctgccactctcatcttacgggtgaggaagctggggctcggcgagcctcagtgatgccgagacttgctcaagtgtacctggcatgtgtgtggcagagccacgagtgaaacccaggcctcccatttgcagcaatgcacccctgcccatggaactagaggggggcgggctctgactcctgaacttccaggtaggaggaccccagctttcccctggtgctcactgtatggccttgggaaggtccctggccagtgagcgtgcatcctgggtggcaacggagtgggcacccaccagcccagcgagcgtgcatcctgggtggcaacggagtgggcacccaccggcccagtgagcgtgcatcctgggtggcaatggagtgggaacccaccggcccagcgagcgtgcatcctgggtggcaatggagtgggcacccaccggcccagtgagcgtgcatcggggtggcaatggagtgggcacctagcaccccttcttgagggctgagctgtttgtttgctttacaggatggttctttctccttggcacgcatactgagtgggcaccccgggttcaccaatgcccgctttggctttgccatggcggctatgggggatctcagtcaggataagctcacagatgtggccatcggggcccccctggaaggttttggggcagatgatggtgccagcttcggcagtgtgtatatctacaatggacactgggacggcctctccgccagcccctcgcaggtgacccatggggccctctccttcctctcctctggggctctgacctctctcagatatgatgacccaagccccaagtcggcttcagtcctaagtgctgggcaggtctcgggggttgggaatgcccagtgaaagaaagaagtcccccaggctagggggagcttccagaccagggcctcacctcagccccttcaggttggggggaggttccagaccagggcttcacctcggccccttcaggttcgggggaggttgtggcggtacctgtctccttccctggcctataccccctccttccacccacctgcctcgggtccctgcttcctctctttctgtccctcgctcctgtctcccacccagcacctccgcgccttatctctcattccccagggctcccttgccagcctctcacactgcatgtattaacaggcacttccacccacctccagctcctcatgagcacctccacctggatggcccccaggcatctcactcccacacggcccatctgagagcacctgcttcccctagaactgatgctcctctgagacctcatccccctccacaccccacaccggaaacctcagacagtcctcagcacgctcacagcctgcacagcctgtcagttcccacgtcctcatgattctagctgtctcccaactccagccccttctctctatccccacccctgcggtcccagctcaggccttgccatcccactcccagcccacccagcttcctcctcctctccatcttccaccccatgtcttcagtgccatttctaaagtgttatcctgattatgtcacttcaaaacaacagaacctttgttgacaccccccatccccaagccccacatcaagcctccttgtaccccaatcccctgtggtccaccccgtccctggccctggctgcttctcagaaggccctgctctttccccatgcctcactctttcccttactctcccctgtcaagtcccacctgccctacgaggctccatccaaatgccacttcctctgggaaagcttgctccctctttcctggttctagactcggggctccctggggctggatggtgcctgcgatgctgatcgggatagatcatgaaaggactccccgccccgtttccctcccttccctcgccccacgccttgtgtttctgcctccacagcggatcagagcctccacggtggccccaggactccagtacttcggcatgtccatggctggtggctttgatattagtggcgacggccttgccgacatcaccgtgggcactctgggccaggcggttgtgttccggtagggttctgtcctgctttctggggtcccaggcccagcctcacccatttgccctgctctaaatagctccatgcagacattaggcactgagggagggagccagcaccgtggttgtgggcacaggctctggagtctgcccgtctgggtttgaacctcagctctcagccctctcagcctttgggcaggttatttaactctaagaccttacctaggaattataagagcacctacctcccagagctatgaggatcatgcaagcgaatatatacaaagtatttagcacagtgctcagcgatggctgtgattgcagagttttttgttttttgttttttttctgaggcggagtcttcctcttttgcccaggctggagtgcagtggtgtaatcttggttcactgcaacctccgcctcccaggttcaagcaattcttctgcctcagcctcctgaggagctgggattacaggtgtctgccaccacgcccggctaatttttgtatttttagtagagacagggtttcaccatgttggccaggctggtcttgaactcctgacctcgtgatccacccatcttggcttcccaaagtgctgggattacaggcatgagccactatgcctggccaagaattgcagagtttttgtgccccatccctcagtgaatgatcaagtcccgtggctgtaaatgagctcatggagcgcccgtctgtcccgtcctctccaagctgcagacttgctgtctacccagcacctccctgagctgctgctcacagtcatcccgaagtgaacacgtctaaaaacagagcttttgctgggcgcagtggctcacacctgtaatcccagcactttgggaggcccaggcgggtggatcacaaggtcaggagatggagaccatcctggctaacacggtgaaacctcatctctactaaaaatacaaaaaattagccgggcatggtggcgggcgcctatagtcccagcgactcgggaggctgaggcaggagaatggtgaacccgggaggcggagcttgcagtgagcggagatcgcgccactgcactccagcctgggcgacagagcgagactccgtctccaaaaaaaaaaaaagaaaaacagagcttttatctccccccacccttcattcccccaaatctatcctgccctcaggctttctgtctcagcaaatggcatcatcatccacccagcaattcaggatgaaaacgtaggcgtcatctttgatgcctcttttccttcctctccaccacatcaacaagtcttagttggctctgcctccagaccagtgcaggcactgtcttcactccctggacactgctgccacagcctttcctgcttccagcccctgcgctccattctccacacagcagcagccctatcccttcactctgctgcctgaaactcctccacggctcctatttagagtaaaatcccaattcctcaccatggctttacagggctcttcgtggcctggcccttcccgcccctccattcccatctcctcctcccatcctctgtctcactaattagattccaggcatgctgacctttgtgctcctcaaacaaaccaaaagtgttcctgccacaggcccttggcactggctgtgctttcttcctggagtgctcttccccagatcctcacacagctggctctttcttgttaacaaatctcaaccgaaatgcctcctcatcagccacgccatctgtgaccacccagtctcagtagccctcggtccttattaccgtatttttgttgttgttgttgagatggagtcttgctctgtcacccaggctggagtgccgtggcaggatgtcggctcactgcaacctccgcctcccaggtttaagcaattctcctgcctcagcctcccaagtaggtgggattacaggcgcccgccaccacacccagctaatttttgagttttttagtagagacgatgtttcaccaagttggccaggctggtctcgaacccctgacctcaggtgatcctcccgcctcggcctcccaagtgctgggattacaggcgtgagccaccgcactcggccaacagtattttaatttttctcatagccttgccaatacatagtatctccctgtttctctcgtttatttgcttgttgtctgctttcccaccaaagcagaaacttgtctctttccccactgtaccctgagactcagggatcacctggatgtgggcatgtttgatagagaaccattgaatgcatgaaccaatcagccaggccctgacccagaggctgagcagtcacttctcccatcctctttgctgtcttgtttagctcccggcctgtggttcgcctgaaggtctccatggccttcacccccagcgcactgcccatcggcttcaacggcgtcgtgaatgtccgtttatgttttgaaatcagctctgtaaccacagcctctgagtcaggtaaaaaaatggtccagctgacccctgcctggtgtgatggtctttcctttttggcttctgtaaggggcagggaaagaggactggggcggggggtgggtgggtgttggtctgaggtcctggtgcttgaaatccctcgattagagcttagctccttagtctccaggtttgttaaatgcaaactgcctcaagaaagggtggtctgaggttatgtccacactcagaaggggtttagagctgacactgttgggaagagggacactggggcccttcctcagggttgaagggttgagtttctgaaaaaaaagactcagaaggccgggcgcggtggctcacgcctgtaatcccagcactttgggaggccaaggcgggcagatcacgcggtcaggagatcgagaccatcctgcctaacatggtgaaacaccgtctctactaaaaatacaaaaaattagccgggcaggtgcctgtaatcccagctactcgggaggctgaggcaggagaatagcatgaacccaggagacggagcttgcagtgagctgagatcgcaccactgcactccacgctgggcgacagagcgagactccgtctcagaaaaaaaaaaaagactcagaaaaaggcagccatttctccatgcccacgtgtgtgcgtgtgtgcgggggcttctgagacacaccctcctctttctctctgacttgtgtcttctccccttccctcctcactatgtgcctccggcccaggtgggattggatcacctgttggaggcctggtttctctttccttacctgaaactcattaggagactgttcccagaaaggaggtggtgggcatggctttcacagcccaggtatttactgctcatccaagagctcccccctggaacgattcctcagcaacagtccccgaggtttaatctctcaggagcaatctctgagatggtctctgcctcccacagtcagagagcagtctcctggggtggggtggctttcccaaagcagcaggctattatccacctggggattgaaaatgacagacctggccgggtgtggtagctcacgcctgtaatcccagcactttgggaggccgaggtgggcagatcacgaggtcaggagatcgagaccatcctggctaacacggtgaaaccccgtctctactaaaaatacaaaaattagccaggtgtggtgacagatgcctgtagtcccagcactttgggaggccgaggcgggtggatcacaaggtcaggagatcgagaccatcctggctaacatggtgaaacgccgtctccactaaacaaaatacaaaaaattagccaggtgtggtggcgggcgcctgtagtcccagctacgggggaggctgaggcaggagaatggtgtgaacccgggaggcggagcttgcagtgagccaagatcgcgccgctgcactccagcctgggtgacagcgagactctgtctcaaaggaaaaaaaaaaagaaaaaagaaaaaaaaaagaaaataacagacctgtcccttccaggacacagagctcgatgggctgtgcgatgctgggcaagtgtctctccctagctgagctggttctgttctgtacagtaagagaggcggccccgggatctccacggtgcttccagctgtgccgtcctggggtttttctcctcagagtccctctttccctctccattctctttgttgtctctcttcctccttattttcttcttcaatctcgatccccttcccgagccctccttccctaaagaaggctgactcagtcctgggaatgtgctgctccgggtttggggcgggagcactcagagaccctggtcaggtgtcagaagacggtgagaaaaatatctttgaaaaaccgacgcaggagtccagccgcagggaagtacctgcatggggacactgttcaggaggggccacaaggaacctcaggcaggctgggggccttctgtctgcggctggctcatccccacctcatcgggaaggtctggtcttcattcccaggcctccgtgaggcacttctcaacttcacgctggatgtggatgtggggaagcagaggagacggctgcagtgttcagacgtaagaagctgtctgggctgcctgagggagtggagcagcggatcccagctttgtgaggacctcctgctcatgcccacagagggagaggtaagtgacggagtttggatgggagtcaggaggggtctttgtcattgagaaaggatttgaggtgatgcagtgaagggcacatacccagacctacaaatgaggtgattaaaataatcataacaggccaggcacggtggctcacgcctgtcatcccagcactttgggaggccaaggcggggggatcacttgaggtcaggagttcgagaccagccgggccaacacggtgaaaccctgtctccactaaaaacacaaaaattagccgggcgtggtggcgggtgcctgtaatcccagctactcgggaggctgaggcaggagaatcgctggaatccaggggagggaggttgcagtgagccgaaatcatgccactgtactccagcctggccaacaagagcaagactccatctcaaaataataataataataaatcaagaaccacgtaatggcacggaagatggagatgctgtcattgctgacgtttttcttggtaataactcaggaatgccagtgttcttggcatgcgttatcagacctcacctgataataactaggaccgagggcctgaatgtcagttggcatcaaaaaagtgaacaactaaaaggaagaataaaaagatagaaacgaccatctagaaaggtttactcctggcaaaggtgcccagagacatggggtaaaaaaagtatgtcgggactcaaaccctgacaggatctcgaactttggatctatatggatcgtttattccaataaacaaatgcatgaattcttcttctgaatacacatttacccccaaagtgattgttaattggattaaagtctacagccttccttaaataaaggcttaatcacattctctaccagagaatcatgctcactttctcccatgggcttgaggctcttataggggcagaaaggcttatttaaacaaagagagtggcaaatggtatgctaagcaatctccttatcttctctcttacctctctaatatgtcctccatgttgctttgagaaagatcttggttggttgggcgcagtggctcacgcctctaatcccagcactttgggaggccgaggtgggaggatcacctgaagtcaggagttcgagaccggcctgaccaatgtggtaaaaccctgtctctactaaaaaaaaatacaaaaattagccaggcgtggtggcatgcacctgtagtcccagctacttgggagactgaggcaggagaaccttgaacctaagaggcagaggttgcagagagccaagatcgagccactgcactccagcctgggcgacagaacgagactccatctcaaaaaaaaaaaaaaaaaagagagagaaagaacttgataaacccaggtgtggctgtgactcttcccttctgtctgagccagttctttacccctttgtgactgggataagaaccatagcagctatagacacaaaaccgtagtagaatgaaggagatttttcccaaagcacttggcagcttgcttgaaggacgtgtcccttcagcctggcttatttggaagatgcttaggacttctgactcaccacttttattgtttatttcttcttatgatgacatcaaagtagaaagtattcttgcaaggtgcagtggctcatatttggaaatcccagcactttgggaggccaaggtgggtgaattgcttgagcccaggtggttgaggctgcagtgagccatcatggtgctgctgccctccagactgggtgacagagtgagtgagaccttatcttaaaaaaaaaaaaaaagaaaagaggccgggcgcggtggcttacgcctataatcccagcattttgggaggctgaggcgggtggatcacttgaggtcaggagttcgagaccagcctgaccaacatggcgaaaccctgtctctactaaaaatacaaaaattagccaggcgtggtagcacacacctgtcatcccagctactcgggcggctgaggtaggagaatcgcttgaacccgggaggcggaggttgcagtgagccgagatcacgccactgcactccagcctgggcaacagagcaagactccatctcaaaaaaaaaaaaaaagaaaaaaagaaaaagaaaaaaaaagcattattgttgtcatcttctcccccacatccaactctaaccctgccttccgtggtgaccccacagctctgtgaggaggactgcttctccaatgccagtgtcaaagtcagctaccagctccagacccctgagggacagacggaccatccccagcccatcctggaccgctacactgagccctttgccatcttccaggtgactctacccacagccagtacccagccctcttaagagcctatcccacagaaaccacctgctcccctaacttccaagaatggtggagttgggaggcaatgtcttcagacggcatttgggcccctcaccgtactcatggtgaaactgagtccctgagatggtgttaatgtgtccccgtgagtgaggactcatgggtaacgcaggtctccatctgcccctggggcttgttcctttatgtctttatgttcacaaaagcacttgctacatctttcatgaggcacatgcatacattgcatcctggggacctcacttggcaagcggctctgatgacgctgtgatgggggttccttgtgggagctagactggagctgtcgtgtcttgcactgcagagaggatgccctttggcacacctgcctgttcatgccctgccagggccttcaggctgaatggccccaccaaacctgtatcctagcctctcctcctggtgcccatcagtgcagcttagacaggcgggtagtgtcataagaaacttttgtcagccgggcgccctggctgatgcctgtaatcccaacactttgggaggttgaggcaggtggatcacctgaggtcaggagttcgataccagcctggccaagatggtgaaaccctgtctctactaaaaatacaaaaattggccgggtgtggtggcatgggcctgtagtcccagctactagggaggctgaggcaggagaatcatttgaatcctttgcccaggaggcagaggttccagtgagccaaggccgtgccattgcactccagcctaggcaacagagcgagactccatctcaaaaaaataaaaaataaaataaattttaaaaaatacaaagattagcccagtgtggtggtgcatgcctgtagttccagctactcaggaggctgaggcaggagaattgcttgaccccgggagacagtggttgcagtgaaccgagatcgtgccactgcactccagcctgagtgacagagaaagactccgtctcaaaaaaaaaaaaaaaaaccacaaaccttcaatatatatttcctaaaaacaaaggcattgtcttaacatagtacaataatcaaaatcaggaaattcacattgataaaatactattatctaatttacaaactttattcaaattttgccagttgtcctattaatgtcctttatagcaaaagaaaaaaaaggttctggtccaggatcattcatagcgttctacagttatttatctttagtctcctttaatctggaagggtttctcactcagtcttcccttgtcttttaatgacattaacatttttgaagggtacaggccagtccttttgtagaatgttcctcaatttgtctgatatttcttcataattagattcaggttatacatttttgttttgtttttgagacagagtttcgcccttgttgcccaggctggagtgcaatggcgtgatctcggctcactgcaacctctgcctcccaagttcaagcaattctcctgcctcagcctcccgagtagctgggattacaggcatgtatcaccatgctcggctaatttttgtacttttagtagagacggggtttcactatgttggccaggctggtcttgaacacctgacctcaggtgatctaccctcctcggcctcccaaagtgctgggattacagacgtgagccaccatgcctggccaggttatgcatttttgtcaggaatatcacagaagtaaagtgtgtccttctcagtacaccatctcaggaggcacctaatgtggacttgtccattcctagtgctgtttgcctgtgtcattaataagcacgtctcattttatggtgagatgccttgcgattgtatcctgcttaacatctctttatgtgtctttccttaaccagtgatgactattatgctatggcaaagagatttttaaaaagttattccccgtataaaatgggtgaggaaaaaaccacgtggtattaggcacatcggtgttaccagagagtgcgttctggctgggagtttagatggcttaaccccattctctttcactggggctgggtggaagagatcaggctatgtggctatattaaaaatacaacaaaaggccgggcgcgggggctcacgcctgtaatcccagcactttgggaggccgaggctggcggatcatgaggtcaggagatcgagaccatcctggctaacacagtgaaaccccgtctctactaaaaatacaaaaaaaaaaaaaaaattagctgggcgtggtggcgggcagctgtagtcccagctactcgggagtctgaggcaggagaatggcgtgaacccgggaggcggagcttgcagtgagcggagattgcgccactgcactccagcctgggcgacagagcgagactccgtctcaaaaaaaaaaaaaaaaaaaaaaaatacaacaaaaaaccctgcatgaaactgttgacccacttagagagagcgccacgctttgacttctgcaaatggcatcccccttccgcaggaagtagaaagttccctttcaagccctgggctgtcattccccctctaggccgtgggaacagacctgcagacagctgccgaggtggccaccgggagagaagtgcgaagtgcagaggctctccagccgaggagctggctgccttccttcataatacaaaaacagacccagctactttagaacactggaatttttaaaaacacgaactggagcttttcaacctccatggggccttttgaaatgtggctttcagaattagtcgattatgtgtaggcaagggaaatagttagcttacagagacgactagccaggccgggcgcagtggctcacacctgtaatcccaacactttggaaggccaaggtgggtggatgacctgaggtcaggagtttgagaccaacctggtcaacatggcgaaaccctttctctaataaaaatacaaagttagccaggcgtggtggcacatgcctgtaatcccagctacttgggaggctgaggcaggagaatcgcttgaatccgggaggcagagatggcagtgagccgagatcgcgccattgcactccagcctggatgacagagcgagactccatctgaaaacaaacaaacaaacaaccgaaaaaacagatgactagccatgaggaaggaacctccaaggcctggaccttgacgatatttggctaggcatcccccactcctgcccgggctgttctgcctatatccgaaaggactaaggaagcttctcttcgcgtaggtgtctgctccctgaatgctcaaagtcgtgagctgtgtgttgctgctgaattcgcatgatgtaaatgtcatgggcacccctaacattccgtgaaggtcaccccagtttttaccttggtcaaaggactgggtcacagtgtgcccatgttataggacagatccaggaatgtcacccaggaatgtcacagtccctgctcttcggggacaatcccagcctgcacccctcacctccctgtaactgcacttctcagggtgagcaggaggcacagcccaaaacttcctataaggagaagagccggaggcagggctgctggggaaggcggagcctgggctgatcgggactctctgtctggttacagctgccctatgagaaggcctgcaagaataagctgttttgtgtcgcagaattacagttggccaccaccgtctctcagtgagttggacatagccgtcagtttcctcgattaaccttctcccgaacgcttgcctgggcaattccttcattaggacaccctgcacatccccttcccctctccccgtggcccacaaatggcttctgcacttattatctcaatatgtcctcagctaccccagaagggaggcaagacagagatctgtcttcccactttctagattaggaagcagactcagtcgccgagggccctgcataggccatttggtggacttgaacctgggtctcttgacatcccggacaatgctatattcagaacccagcgttcttcacagccaggctgacctctacctcagttagaggtaacctctttcccggcccacctcttggccaaattaactaatcaatcaaatatttctggaccatctactttgtgccaagcactctaggtgctggggatacttctgtgaacaacacagacaaaaatccctgccctcctggtgctcttagggggagaagatggtaagtaggtaaattccatgttgatgagatgaacgttgaagacacagggaaggtgggaaggagtgttgggtggcagctgatgctgaagttttcaatggggtggtcacggagggtgacactttggcacacactggaggaggtaggggaacgagctatgtggatgggtgtctaagggaagagcagctgcaggtaccctgggttggaagcctgcctggtgggtggggggcagggtgaggagctagtggctgcagtggagtggggcggggtgtaatgagggaaggggaggaagggggaagaggccatggggcttcttaagccctcagaagggcttttgctgtgagctgggaagtcagaggagtgacacactcatgcagcttagcaggatccttcttgctgcttagctgagaagagaagcggcacttgctccctttgtaaccactcaggtgagaggcggtgtgggctgggccatgacgggagtaacagtttaaagtgacagctcatacgtagcacgtgctgacagaatggaggcggagggaggaaagagggccacagccccagcatgcggcactgcactgtccaacacaccagccacgcttagctgtttacatgtacatgagttaaaattaatcacaatgaaacattttgttcctcagtcacattagccacacttcaaagactcagtggccgcctgtggctggtggtgttgggcagcgcagataccgcctgtctccatcgctgcagacgttctattggaccacactgaattccagaatgacagtgttgccaagcacatgagtgtgggtttagacatgtagtggtcttagaatgccccccaggccgggcgcggtggctcatgcctgtaatcccagcactttgggaggcagaggtaggcggatcatgaggtcaggagtttgagacaagcctggtcaacatggtaaaaccccgtctctactaaaaatacaaaaattagctgggcatggtggtgggcgcctgtaatcacagctactgggcaggctgaggcaggagaatcgctcaaactcgggaggcggagggtgcagtgagccgagatcgctccactgcactccagcctgggtgacagagcaagactccaaaaacggggagggggggagggtaacaaaacaaaacaaacaagcgtccttggcgactagtgttgtgtatgtattgtgattctgttggccagctggctggagttgccgtatatggggaagaacgcagttccccaagtcctggtcagccctttcatagacatttgcaggaccaattgaagactttcaaatgctctggaatccaggctaacaagcaggcacagctgtttccagcagggaattaattacagccaagaaccaacctcccagccagctactgggggtagtagagatacagcacgcatggcttgccctacatcgccccctagtgtacatagcaagcaaacgcttctctttcaaaaacgctagtgagcctggtcgtcggtgtccagctgtctcagtggtttttgacctgaggacatagatccccaaaagaatctaatgaagactacagacccctctccttagaagatcacatgtgcatacataaattttggcattccgggccctctgagacggtccctaggcctcagattaggcaacgctgttaatattctgatgacactgaggtctcacgcctgagctctaagatgtgtgtccagctgacatgtcagcatctctgctttgttatcctatatgcacctcttgtcatgtccccgattgaacgcatcttcttccacccttgggtcttcctcccatgttacctccctcagtcaatggcaccactcagccaccggcaccactcagccaccggcaccactcagccacctgagctagaaactcagaacttgcccttaactcctctgtcccccctcccctgcctctttttcgtttcatttgctttactgtctctgacttctttccttctccactactgttgtcttttttcttcttcttcttcttttgagacagggtctcactctgtcacccaggcaggagtgcagtggcgcgatcttggctcactgcaacctccgcctcccggcttcaagtgcttctcctgcctcagcctcctgtgtagctgggatcacaggcgcacgtgaccacactcagctaatttttgtatttttagtagagacggggttttaccatgttggccaggctggtcttgaactcttggcctcaagtgatccacctgcctcacctcccaaagtgctgggattacaggcgtgagccaccgtgtccagccatccactactgtttccttatttcaggcatgtatcatctctcgggtggagacagcaggctctgtctctgcttcctgtctctccctccagtcaatccagcctcttctcagctgggataaaaaccaaaccaaaaccaaacaatgggaacaaaacacacctcacattacttcctaggccgggcgtggtggctcacgcctgtaatcccagcactttgggaggccatacttcctagatctgcacatctcatctttggacatttcagatggaaaacagttttctcggtattgctaatatgtttttctgtcaatctcagctactgagagtggttctgcactctgggtccctgtgatacctcagcattctggaggaccctttcacacatccccaggaccctcttttccaggacatgtggacccatgtcttaaaccacagccttttaatgggaagggtctgaatgattttgtgggtaggaagctgaggccaagaaacggggtaggacagtatgtcttatgcacactgttctccagtgcacagcagtgccccataaatattgtggcatggatgaatttgtgtcatagagtacctcacctagggtcacagtgaattggtggtagaaagaggatttgggtacaattctctcaattctttggactactagactccaggcatttaattagccttttatttatttatttatttattttgagacagagtttcactcttgttgcccaggctggagtgcaatagtgtgctcatggctcactgcaacctctgcctcccgggctcaagcaattctcctgcctcagcctcctgaatagctgggattacaagtgcctgcaccacacctggctaattttttttttctttttttgagatggagtctcatgctgtcacccaggctggagtatagtggcgtgatctcagccctctgcaaactccccctaccgggttcaagcaattctctgtctcagcctcccgagtagctgggattacaggcacctgccaccacacccggctactttttgtatttttagtagagacggggtttcaccatcttggccaggctggtcttgaactcctgacctcaggtgatctacccgcctcggcctcccaaagtgttgggatgacaggtaattagcctgtcttggcttctgtttcctcttctataaaatggagagtagctgtactatttcacagggttactatgagggttgagcgtgtgagacgcagtccttggcacatggtaagcactaaataaagggcagctattatcgtcatctcatgcaacaactgagatgggcgtggcagtccagctgtttgcttatgttgagaggaagaatgtctaagctaaacgtattccttaggcaacttatctaagaagttacttaagaaggtgctattctgggctgtgtgcggtggcttacacctgtaatcccagcactgtgggaggccaaggcaggtggatcacttgagcccaggagttcaagacccgcctccacatggcgagaccctgtctctacaaaaaatacaaaaattagctgcacattggccaggctgggtggctcacgcctgtaatcccagcactttgggaggccgaggcaggcggatcacctgaggtcaggagttcgagaccagcctgaccaacgtggagaaaccccgtccctaataaaaatacaaaattagccaggcatggtggcgcgtgcctgtaatcccagctactcaggaggctgagacgggagaattgcttgaacctgggaggtggaggttgcagtgagccgagatcgtgccattgcactccagcctgggcaacaagaacgaaactccgtctcaaaaaaataaaaataagaaaaatattagctgggcatggtggtaaacacctgtagtcccagctactcgggaggctgaggtgggaggatcacttgaacccaggaagtggaggctgcggtgagccgtgatcattgcaccacagcaccacgctctagcctcggtgaatgtcctattgtattgcgttgaggtttttacagatgaaataaactgtaacatttttatctgtaccctgtgcaggcaggagttggtggtgggtctcacaaaggagctgaccctgaacattaacctaactaactccggggaagattcctacatgacaagcatggccttgaattaccccagaaacctgcagttgaagaggatgcaaaaggtgactgtgacggtggctgtggaaacaggtccctcacgcccctccctcgctgcatgcctgcttttctgtggtgaccccctcactggcacccctgcctccagcctcctcctggtccaaccaacagatggttaataactagataaatccccgccagtccagctccatgcctcccgaggcaccatattctgctgcagtaccaccctccctatgtgcggccctttcttcaccagggttctgagagagaagtgagtctaatgccctaagacactgagaaagtaaaaattagcttagactgggaaagtgaaaatctgccctgccattcccaaggctggatacagacacagatactaggaaacagtctgtttcccgaggacaccctgtggctgacaagtatcactgcactgagaaattttattctctaaaatcacagatcagaaaactttgggccgggaacggtggctcacacctgtaatcccagcactttgggaggccgagacgggcggatcacgaggtcaggagatcgagaccatcctggctaacacggtgaaaccccgtctctactaaaaatacaaaaaaaaattagctgggcgcgatggcgggtgcctgtagtcccagctactcgggaggctgaggcaggagaatggcgtgaacccgggaggcggagcttgcagtgagccgagattgcgccactacactccagcctgggccacagagcaagagtctgtctcaaaagaaaaaacaagaaagaaaactttgctgtttgaagtagttacgtcagtaattatgaacccctatccctcttgcctggagagtgtaagtcattttgaccaagagaagagtctgtttccacctgaggtagagagcttcagatacagtgtctgtcaactttctactccatattaatggtttcccaggaagcgggccctgggtctgattcacaggctggcctgctggtgactgactccttgacactcagccctgctttaccatcaaaacaggactttatttacatttcatctgaactccacccttccctggagtcctttaataaccgccttttccattgttcagtgatacacacaatagtgtagtttttggatgggtgcagtggcccatgcctgtaatcccagcactttgggaggccgaggcgggcggatcacctgaggtcaggagttcgagaccagcctggccaacatggcaaaaccccgtctctactaaaaatacaaaaattagccaggtgtggtgatgtacacctgtaatcccagctactcgggaggctgaggcacgagaatcacttgaacccggaggtggagattggagtgagctgagattgcgccactgcactccagcctgggcaacagagcaggactctgtctcaaaaacaaacaaacaaacaaacaaaaccaaagtgtagttttcctcattgcagtgagtcaataaatttgaatttgttggactgtagatttgtccccggtcatcttaggctatttgggctaggacagtatccattatatgaatgaagcaatctcctaggccgggcaccgtggctcacggctgtaatcccatcactttgggaggctgaagtgggtggatcacttgaggtcaggagttcgagaccagcctggctaacatggtgaaaccctgtttctattaaaaatacaaaaaattagccgggcgtggtggtgggcacctataatcccagctacttgggagactgaggcaggagaattgcttgaacccgggaggtggaggttgcagtgagccgagatcgcgccacttcactgcagcttgggcgaaagagtgaaactccatctcaaaaaaatgaaaacaaaagcaaaaaacaatctcctaggcatctagaggggaactagggatggaccgtccctgggagaattaagaaaactcactgcagtcatcacctgcccctcgggggtccaggtggggagccctggtggctacgtggcagtgctggtgtgtgccggccttccagccaggctgtgggttatatttgcatcagtccatggcccagctcaaatgcctccttccccaggaagaccttacgaattcctccgagttggaattcatatttctccactgctgttctctgcagctccctcacagaagcaccccttcgaccttgtatttaaattcctcggggatctactgctgaccctgcctgtccggcttgtgaggaagacagggaccaagtggactttatttctttagctcctggcagggtgtctgacaggcagaaaaattagtgaatgtttgctgaattgctgtgaggaaaccacgtttttgttttgttttgtttggctctttaagagaatgtcatctgctcttttaacagcctccctctccaaacattcagtgtgatgaccctcagccggttgcttctgtcctgatcatgaactgcaggattggtcaccccgtcctcaagaggtcatctgtgagtcggtttggaccgattcgctcttctcaccaccctgcagttggcgtcttctgcatcttggtctcatctcaatctctcggttccagctttgcgcttcgcttgactgcagtgtgtccccagcagtgcttacagtggctaagctggctctgaaagtagggggtgatggggacgagagctttccagtacacagccctaggtgaactgcctgctcacctccgtgaagcagagtgaagttgtgggtagtatggagggcgtgtcagacaaaaagtttttttgtttgtttgtttgttgagatggagtttcattctgtcacccaggctggagtgcagtggcacagtctcagctcactgcaacctccgcctcccgggttcaagtgattctccttcctcagcctcctgagtagctgggattacaggcgtgcagcactacacccggctaatttttaaaatatttttggtagagatggggtttcaccatgttggccaggctggtctcaaactcctgtcctcaagtgatccacctgcctcgacctcccaaagtgctgggatgacaggcatgagccaccatgcccggccaagacgaaaagttattaaccctgatctgtcccttgtcatctctgtgctgtgggaaatctctgaagtggcttcttcacctgtaaaaggggaatgaggccgcctgccttgcttactccatatttgtatttgaggcttaactgaaataacggggccaggcgcggtggctcatgcctgtaatcccagcactttgggagaccgaggtgggtggatcatttgaggtcaggagttcgagaccagcctggccaacatggtgaaaccccgtctctactaagaatacaaaaattagctgggcgtggtggtgcgtgcctgtaatcccagctacttgggaggctgaggcaggagaattgcttgaacctgggaggcagaggttgcagtgagctgagatcacaccattgcactccatcctgggtgacagagcgagactccctctcaaaaaaaaaaaaaaaaaaaaaaaaggaagggaaaggaaacatgctgtgttagaaaaatgtgaggaatgtgaaaatctgaggaatcgtctcctaggtctgttccacgagtagctagcggtctgaattgtgagtggcatagagagaatcaactgaccatttttccccctttaaaataggctcatgtttcagtcgtttggcagctagaggagaatgcctttccaaacaggacagcagacatcactgtgactgtcaccaagtaagtactgcctgggtcacagcagagtcaggctatgaccccggaagacatctccctgccacatgcacgctgtgagaggaacggcccccttacagcccagggagaaaggaaaccccagtgagcccacagaaggcatctgtttccctgcagggactcgactttctcttcttgttaccagagataatgaaaatgttcttttgttcacacacaaagtaaaactgtggtacagcctggtggaatgagccctggagttctggttctcgttcactcagctttggaatagcttgggatagctatgttacctgcaagacctctgtgttggggggtaaggtggggaacgctgctgggaagagttctcaaagggaggtgattctgcccaccagaggctgtgcctgttttgattgccatgacttggggaggggggtgttcagtaggacatctggtgggtagaggccaggaatactgccaaacatcacgcagagcagtacaggacagcccccacaaccaagaactaactggcccaaaacgtcaatagtgtggaggctgagaagcccttttaaaatcagtattcttctaagtgtggtcttctagagacaattctgaactccaattgcttatctctgaaagccttttatttatttatttatttatttattttttatttattttttttttttgagacagtctcgctctgtcgcccaggctggagtgctgtggcgtgatctcggctcactgcaacctctgcctccaggttcaagcagttctctgcctcagcctcccgagtagctgggattacaggcgcccgccaccacgcccagctaatttttgtagttttagtagagatggggtttcaccatcttggccaagctggtcttgaactcctgacctcgtgatccaccagccttggcctcccaaagcactgggattacaggcatgagccactgcgcccagcctctgagagccttttcttatctgactcccagtgaccctggggagccaggtgcagaagcacctgttctgcagtgagagcacatggacacagggaggggaacagcacacactggggcctgtgggaggggcagggttggggagagcttcaggaagaatagctaatgcgtgttgggcttagtaactaggtgctgggttgacagctgcagcaaagcaccatggcacacgttcacctatgtaacaaacctgcacatctgcacatgtaccctggaacttaaaaaaatagccaggcgcagtggctcacgcctgtaatcccagcactttgggaggccaaggcaggcagatcacttgaggtcaggagttcgagaccagcctggccaacatggtgaaaccccatctctactaaaaatacaaaaattaactgggtatggtggctcacgcctgtaattccagctactcaggaggctgaggcatgagaattgcttgaacccggggggcggaggttgcagtgagctgagacagcaacactgcactcctgcctgggcaacagagcgaagccctttttaagaagcacttgctatgtacaaagcaggtgtgctatgaactaacactcttattcctagttccaatgaaagatggtctttggccaacgagacccacacccttcaattcaggcatggcttcgttgcagttctgtccaagtgagtactcccaagaggccagcagcggtgtgactccatcgcccagggggcagctttgggctctctctcgtagatggagctggtggtcaggatgaatgtggacactgtccttctgagaggagcctgcttagaacccaggctctgatattgatctctagggtgctaacatttgggtcacaaaaaccccactgtggtcatcaaaggaggtgtattgccaactagtcgtgctacaaaagggaattaatatgacgctgtggagggaagaaggcagctgtgggactgggaagtaaggaggggatgagtaaggccatttgagggataattagaaaatgaaccagcccaacgatacagaattcaaatattccacctcaccccaactgcgctacgaccactttatattttgacattcagcttttattccttttttttttttttttaaactgagacgaagtctcactctgtcgcccaggctggagtgcagtggtgccatctcggctcactgcaacctctgccgcccaggttcaagcgattctcctgcctcagcctcccgagtagttgagactacaggtggacaccaccaggcccagctaatttttaaaaaatttttaatagagacggggatttcaccatgttggccaggctggtcttgaactcctggcctcaggtgatccgcctgcctcggcctcccaaagtgctgggatgataggcatgaaccactgcacccggcctcattcctggtaaaggtctggtgccctctgtcctaatgtattcagttgaaagcagtcgagttcattcaaaaagagaaggccaggtgcggtggctcacgcctgtcatcccagcactttgggaggctgaggtgggtggatcacctgaggtcaggagttcaagaccagcctggctaacatggcgaaaccccgtctctactgaaaatatgaaaattagccaggtgtggtggcaggcgcctgtaatctcagctacttgggggcttaggcaggagaatcacttaaacccaggaggcagaggttgcagtgagctgagatcgcaccactgcactccagcctgggcaacagagcaagactccagctcaaaaaaaaaaaaaaaaaaaaaaaaaagggatgagtgtagtggctcatgcctgtcatcccaacactttcgcaggctgaggtggaggatcacttgagcctgggaggttgaggctacactgagccatgattgttccactgtgctctagcctgggcaacagagtgagaccctgtctccaaaaaagggagaaagactcctcaagggctgacgcatgtcctgtcaattgcagaccatccataatgtacgtgaacacaggccaggggctttctcaccacaaagaattcctcttccatgtaagtacttattattgtaaagctgtagatggcaaagcaataccagctttgatttcctactctgattttaatttgcaggtacatggggagaacctctttggagcagaataccagttgcaaatttgcgtcccaaccaaattacgaggtctccaggttgtagcagtgaagaagctgacgaggactcaggtatttaaaggcagttctttatcagtcacacctctttccacagtgactacagagtctcaagtataaaaaccagagttctagaaacagagtgaagacaagttaaccatgggaaaagattaggagtaaattcccgaagtcctgttcagaaggactctcaatcactcagctcttaaagcaacctgtcagttttcctccctttgaggaaaaataagcaaaaattggccaggtgcggtggctcacacctgtaatcccagcactttgggaggccgaggcgggtggatcacaaggtcagcagatcgagaccatcctggctaacacggtgaaaccccgtctctactaaaaatacaaaaaattctccgggcgtggtggcgggcgcctgtagtcccagctacttgggaggctgaggcaggagaatggtgtgagcccgggaggcggagcttgcagtgagccgagatcctgccactgcactccagcctgggagacagagtgagactccatctcaaaaaaaaaaaaaagcaaaaattaaaaccttgtcagtagacagagacattttccctttgaaaattgataaattctgcttctctgtgtgagtgatgtaacatgtgacatttcttacactgccccctataagttgcttactagcttcccttcttctcccctgagactcttttttggtctctgctttgcctcagcctctttgctttcagttgtctcatctgtagtctggttcccaaagctagccttgatacctgaagcaacaggctctgctcagtatgaagctgaagcctgggcattttttttttgctcagactacataagtgttaaggctcaaaaaacggaaaggaatttacagaaaggactctgctgacaattagaaagagggcttataggtcaggtgccatggctcactcctgtaatcacccagcactttgggatgccgaggtgggtggatcacaaggtgaggagttcgagaccagcctggccaacatggtgaaacccccatctctactaaaaaaatacaaacaattagccgggcatggtggtgtatgcctgcaatcccagctactcgggaggctgaggtaggagaattgcttgaacccgggaggcggaggttgcagtgagctgagatcgcaccactgcactctagcctgggtgacagagcaagactctgtctcaataaaattaaaaaaaaaaaaaagagggtttataaatataaacgtttgttttcacatgtagtttatttatttaaaaaaatagagacaggggtcttgctatgttgaccaggctagatatgaactcttgggctcaagcgatcctcctgcctcagcctcccgagtagctgggactacaggcgcacgccactgcgcccggctagtttacttctttcagaacatttgttatcagcaaatttaaacatttcaacaaatatttcagtttccatttggaaacaaaattcttgtttgaaaagctgactggaaacctgtgagaatgggagttccaccctcctgtggggatggaggttgaaacagcaccagaggcttcaagaccagtctcctctcatttcggggcagtaagatacatttagcttacttaaacagactgtgctggcagagcaagtcagtggcagagctgaagttcagcattgtcctgtggaactcctggatttttctcttaatttgcttcatggcaggagtgttacatttagtcttgaaggtcatttgtttcagcatcttgtctgtcaggtaatgtaaccagagcacattactataagggtgatattcaccccagcggttgttattctccttcttcatgagcctgtagatgtcaaactggtagtcaccgtcaccggtaaacaggtcctcatccatggaaacgtcacagaaaaccacaatcccatcccgttccaagcgcgacagggtgtagtcaatgatgctcacttgcaacccacagctggggatagtgctgctcttcccattgagggtgtagtggagttttttgaggctggttttctttaagagcacgttcccccagtgtaagtctcggtgctcaaagcgcagtgatgcctctgccactgcgagggaggctgtgagctggtgtagaatgctctttgcagtagccaaggaagacaacttggttcgcatttgctctaagtcaatccctccaaactcaaattccagcacaatgaagagctggtcgtctttaaaaaaatcaggccggtcatttgcagagcctttggttgaattatagtgatcccaggctttgaggagcaagggagggtaagatccctggacacagtgcactgagttcagcccgataaagccttctgtgcggttgcacacttcaccggataagaggctcaactctttggagatgatgatctctggcaggatttcctcaaaggttttctgatgggatccattgactaaatctggtccttcaatagcaatgatttttatggctacgggtgtgtgatcagcaattgtttgaaacacttcgccaaacaccccttccccaatcttctcacagcgttgcagtttttctgtgggaaggcaatggctaaaggggacaggacccttctgactgcattccccataaaccttttcagcatcagatgcctttttgtttgaaatacttagagtgtttaaggggcttagcaaatacatagaggaggagtgccaagaggacggagcaccacttgttctgttcatgacaggccggtttgaacattctgataggagggatccagagagagaagtggcagtggtatagatgctgcagacctctgacacatcagtcacaattttcttcttgtggaaactgaaggaagccctggttttggtccaaaagcaggcattctgtaaaggagtcaggtcctgggtggggaacgaatcttttcccagcttttggccctttttaaagcggtgggaatggaggagagaggtttccgttgcctcctgatgtttgctcttccggcttgatctagttctctccagcctgtctgttccccttggcacaatgcggcccttgggaacactggcctcctgatgctctctccggacggcctcttgaagccctctctcttgacaagagtcctggcctgtggccctcctcttgcctgtgcttgacagacctggaccctctggtccatttcccaccaccagtttccttttacagcaggactctctcatattcttcccatctgcccgaaactcagaatcctcaggggttcctgagttcataaggccaaagagaactgacctgaggctggcgcgggtttggtggaccatcctggtgtccttggctcctcctgtcgcttcctcctgggagcaggggagagatgctcggtccagggagacttctgggaggtggaggtcgctcgggacggctgaggctgcaaccagacaggcggaggtgccgatcgagatgacactgtcccttggcgttggggacccggggcagggcgaggccagagagctgaacagggaggcactgatgcccagctcgtcgccgtccctgggctggccgcacacgctgaggtccgggctgaggcggccggagtcgcggctggggaagggcggaagtcggagcgggccgcagggtgtgctgcacttctgcgggggccgagctcgcagccccaggcgtcttggggtcacggttaggcttgggcgagctcgcagcttccagcgctttggggtcacggtcaggctgggccggtccttgggcactcggccgccgggacacctccgccgccgcctcaccgggctgccggggaagtcggggtcgtcgggatcgtcaggatcgtcggactgcgaggggtcgccgatgctggcgtcgctgctgccgctgctgttgaagaaacgcctccggtcctgcggcgggaaccactgcgcggcttcccggcccggccgccgctgtctcctgccgtccgcagccccatatgtgcggaaaagccggctcccaggtcccgggagcgaagccgccatggccggcacccgccaagaggttcaaacgcaaacatcgcgagacttccgtgcgacgcggacgcgcccgcctgccgcggggtcctagctcccggccctgcgcatgcgcacctcgccagggccggggccgggacgggacggaaaactggcggcttggtttgttcagcgcgtcgcggtcatggctctcgtttcaggcctccacggtgtgcacctggagtcaggagcgcgcttgtgcgtacagttcggttcaggtaagcgcggccgtcccgagaggccaggggagggcggagggcctgaagcgggtaacgagaggccaggagactgtttttcctgggttacccctgccggccagtgccgggggctgccaggccctccctagcttcgtccctgggtctcaattgctcccgctggagcttcgcttgggccgaggtgagcgctgaaattgctcacaccctctattctgggaccttacgatgctctgtgtccgaagtgttaaaaagatttcagactttccgcacggaaaggaattgtgttcactagacctcgcttttccagcatgtggaagaatggcattcagtgagctgtgtcatcgcttcagataaagaaaatgtcaccgtggctgcagagatctcctgggatcactctgaggaggtgtttgagactgaaatgctccagatttgattatccagttgctcacgggcatcgcccctagaagagataatagcatctttgcataacatgtccatgtccaaaatagatcttttggtgcaaaaaaccaaccctctgtcccaacccgttccttagctaccctcaggagggagatatactccagttacagtacaaggaactcgagggattacctgtgactcctctttcctacatccccacgtctattccagcagcaagccctgccatttcagggccaaaatatatcctaaacccattcacttctctccatttccactgccgttgtaattcaagctaccctttcttgccagggctgttgcaataaccttcggcctgcctttcttgcctctgcttttcccacattctttacaaataattcccacgtaacagctatccgtcttctaagagcagacattagattgtgccattcccctgcttattaaaaataacaaacaaacaaaactgatgcttgagcacacttagactaaaatccatacttttttcatggccagagcaaggcagtacttgatctggtctctgcttaattcttcaacttcatctcctagtactcgcctttctctcccactgccccttttataatcgggttattctgtcctattcttctagctcgccagtacagcattattctggccacaagactttgtacttgctgttcctttgcttgacactgctcttcctctaggtcctgacgtaggtggtttcttcttaaatttagctcaggtgttcttttcttttctttttttttttttttagatggagtcttgctctgtcaccctcgctggagtgcagtggcacgatctctactcactgcaacctccgcctcccgggttcaagtgattctcctgcctcagcctcccgagtagctgggattacaggcgccggcgaccacgcccagctaatttttgtatttttagtagagagggggtttcaccatgttggccaagctggtctcgaactcctgacctcaggtgatcgcccgcctcagcctcccaaagtgctgggattacaggcgtgagccaccgcacccgacctaggtgttcttttcttttcttttctttctttcaagacggagtttcgctcttgttgtgcaatggcacgatctcggctcactgcaacctccgcctcccgggttcaagcgattctcctgcctcagcctcccaagtagctgggattacaggtatgcgccaccatacccggctaattttgtatttttagtagagatggggtttctccatgttggtgaggctggtcttgaactcctgacctcaggtgatccgccctccttggcctcccaaagtgctgggattacaggcgtgagccaccacgcccggctaattttgtatttttagtagagatggggtttcatcgtgttggtcaggctggtcttgaactcctgacctcagatgatctacccacctcagcctcccgaagtgctgggattacaggcatgagccaccacacccggccacacgtgttattttcttagagaggccttccctgatcacttattctaaagtgggaactagtgatcaagtgatcaagtttaatgttttacagtgatccaggtgacatttgtgaggtctcaactgaagaagtagcaatgggggtggaaaagaaagggacagatacaagaaataatttaaaaaaaaagaattgtgagtgtggtggctcacatctgtcatcccaacactttgggaggctgaggcgggaggattgcttgaggccaggagttcaagatcagcctgggcagcatagtgaaaccccatttcttaaaaataaataaatacataaattagccacgcatggtggctcatgcctgtagtcccagctacttgggaggctgaggcaggagtatcgtttgagcccaggaatttgaagcttcagtgagctatgattgagccactccattccggcccgggtaacagagtgagaccttgtctcaaaaaaaaaaaaaaaaaaaaaaaaaaaggaaaaatctcttacgttaaataaaatgaataagctgggtgtggtggctcatgcctgtaatctcagcactgtgggaggctaaggtgggtggattgcttgagcccaggagtttgagaccagcctgggcaacatggtaaaaccccatctctacaaaaaatacaaaaattagcccagtgtggtggggtgcacctgtggtctcagctactcaggagactgaggtgggaggatcacttgagcctggaaggttgaggctatagtgacccatgatcatgccattgcactccagcatgggtgacagagcgagatcctgtctcaaaaataagtcagtcagtcaagaactgactttggatggcacaagggaaaagaagttgaagaaaaggccaggcgcggcagctcacgcctgtaatcccagcactttgggaggccgaggtgggtagatcatctgaggtcaggagttcgagacaagcctggccaacatggcaaaaccccatctctactaaaaatacaaaaattagcctggcatggtggcacatgcccataattccagctactcgggaggctaaggcaggagaatcgcttgaacctgacggggtggaggttgcagtgagccgagatcgcaccacttcactccagcctgggcgaaagagcgaaactccatctcaaaaaaaaaaaaaaggaagttgaagaataactgcagatgtcttgtttgggtaactttatgtagtgttgtgtacgttagggccattaactaagcccaggaatacctttaaagggaaaggtggtgaaggctgttcaaacacagtgagttcatgtctaaaatatgttttgtttccctcattcctttccccatcttctagttactaaaagatgtaactgaactgcagatccttggtgaaatatctttcaacaaatctctatatgagggactgaatgcagagaaccacagaactaaggtaattcctggctggcttctgagtagtgcccaaggaaaattgtgcctaacctttgagcacctccacagacattctgttgccctcttcctgttttcagccttaacacttctgatcttggctctgccatcgctgcctttgtgacctttgagtgagtcagcttcttatgaaataaggcaattaagaggcctaagctgaggagttctgagttgaaataactaggctggaatctgcagtatatactttgatttgaaaatggattgattaaaaaaaaaaatttcgcagctgggcgcaggtggctcacgcctgtaatcctagcactttgggaggccgagacaggtggatcacctgaggtcagaagttcaacacaagcctggccaacatggagaaaccctgtctaccaaaaatacaaaaattagccggacatgatggtgggtgcctgtaatcccacctacttgggaggctgaggcacgagaatcgcttgaatctgggaggcagaggttgcagtgagccgagatcacaccactccactccagcctcagtgatagagtgagactcagtctcaaaaaataaataaataaataaaaaatgaattacctaagtgagaaattgttttttgtatccagtaactgtcttagtgtgctgtatcagtgtttagttatagtattaaacagtactcaggaatgcataaatcttttataagatttagactagatactggaactcttggaattctttttgcaaaagtatgactagaagtcagactgatgcctgtgatttgtggactgaatgctttgtgtgttaccctgtgttttcattcttgttgacccttgcctggacatggcttcagaggtgatctatctgtgagctctgagctctttagttaggcatgattctctactagagggaatgtcaggagagtgatgctggattgctaaatataaggtcctctgttttcctccctggaggaggagaaaggagcaattctctagacatgccaatataacatttccttttatttttaagtagtgtatttctttttcttttcttttctttttttttttttttttttttgaggaagaatctcactgtgtcacccaggctggagtccgttggtgccatctcggctcactgcaacctccacctccccagttcaagtgattcttcttcctcagcctcccgagtagctgggattacaggtgcccaccaccatgcctggctaatttatttattttttttaaatagagacaggatttcaccatgttggccaggctggtctcgaacttctgacctcaggtgatctgcccgccttgacctcccaaagtgctgggattacaggcatgagccaccatgtccggctaagtagtgtatttctaatacagaaaatagagggaaatggaaaatacagaaaacggaagaaatagaagtgccccattattgcactgcccagattttaacaaataaaaataatagcaagaaaatccaagccatacagagaatggtaccaaatgaaaaataattgttccttcatttctcccttcccatgcccccagcagggaggagttactattaagtttcttatgtgcacattttaaatttgtatgtttccccctcttacttactgatacttttatttctatagcatggattccccaaaattcctttctttaaatccaatatcctaagcaaagtgttaagtagttcctgacaataagcccctgacttacagtgactctatgagtataaacaaactgtatccaaatgcatttcagccacaagaaagggaaaatccagctcatgcagcataagggcatatgctgtttatccagtgagggaggccggcctggggcgatggcctggcttctttggtccttgtactctgccgtgtgggggacgcattccttcatggccagcacaaagttgccacatctccaaatgctgtattttcacatggcaggatacaaaacaggaagcaagaagtcagtagcaaaaggatgttggatttttcttcatgtgccttcccttttcagggatgaaacagtttccaaaagctcccaggagacatcctcttacatcttattagtgagatctgaatctcatgtcagtcactggcaaaggagaatagctgtgtcatgatcacctgagaccaacgatgattcctgaataaaatccgaaaggagagaggggcccctgggcaggccagcatccgtgtttgctgcaaacagtagtacccggtgccttgcttctcccttaacctctacttgggcatctttggggcacttttgggaatctgtgggtttagaagaagataaagggaggtggctttgagaaatagggacatttcttctactcacatctggcctgtttcccgagtcaccttgggacttcctttcacttcccaaacccagggtcttgagtccccctccttctcctgtagaatattccagccctctttctgttcttcctccctctttgttgctatggtacctccctattctcaaagcctaggacttcactcctatttagttcagctacctatgagctaaataggactggaaggtcaactttaggtcaaccagcatttataacttaattggaagaggccttaaaggtaagtttgtccagcccttcaccccgtacagaaacctctccaaagcacccctgaccttggtgcttaaacatacacgtgaagggttgctctgggcaggcagagaagtcttgttggctctctggccccacctaagtcctgggaacttcctctggccacaacttggaagggccatacctgggtctcaggaaggacatctcctgaactttctagctgagccctgccagaagagagattagactcccgaaattgggagagcctttggaaaacaaaacctgaggatgacttctaatagctgagctctgcaagtagtacacatggatataatttgcatttattatgtcccttaggtaatacacactttttagtctggtgaggggaagaccagtacttttgtcatattttatgtggggaaagtgtattaccaaagcctttagggatctgtgcaagatcaaaaagagccgtcagaacggagttggaaaggacttggagatcatttaaaggaagtcatcattttaaagagcataggcacggggctcagggacatagagcagtgtagcggcgtgacagcctcacagtcctgtgttgagaccggattccgtgggaccctctttcaagctgtcagagcatctttaacagaaggtcataatctcctgacagacctagcccttctagataaggggccagaatagtttcttacgaagtatttgggtgattggatagttttagatgatctaaaatgctgcatcagggaatatctagctttttgctttactgtcatcagctttgatcaatacacgggttgttgccaagtcctcgtattttgctccttaaaataacatgtaggattttttcctcgtttgcttcacctgatttattgggcgatctctttgtcttgtctagatcactgtcgtcttcctgaaagatgagaagtaccattctttgcctatcatcattaaaggcagcgttggtggacttctggtgttgatcgtgattctggtcatcctgttcaaggtcagttctactcatggcatcacagtgagggaagactgggctctagttttgggcacagaactccttaggacagccaacctctgacttagagcagctgccctggcctcgtggccacttttttctcctccttcaactgcacacccccatttagacaaatgagtaaaacagtatctgtctgaaaagagaaaactctgagtaataaagagtgattttatatatatttctttggtacctccctattctcaaggcccagaacttaatactgttatgttcggttacctgtgagttcaatagggcctggaaggtcaaccctaggccagcatttataacttacttggaagaggccttaacggtaaggccttaaaacagatgtgactgttgttcccctgttgaaatcttttccttgccttcccgtcttaatgtgcaaactcttctactgctatttaagatcctctcctctgtccgctacccgtctctgcccttaagtgttgcttttttttctttttttttttgagacggagttccgctctttcgcccaggcttgagtgcggtggtgcgatctcggctcactgcaacctccccgtccccccgccctgaccccgggttcaagagattctcctgcctcagcctcctgagtagctgggattacaggaatgtgccaccatgcctggctaattgttttgtatttttagtagagacggggtttcaccatattggccaggctggtctcaaactcctgaccttgtgatcctcccgcctcggcctcccaaagttctgggattacaggcatgaaccaccactcccagcctcttttttaaaaataaacaccagggtctttgtcccccaagctggagttcagtggcacagttaagggctcactgcagcctcgtactcctaggctcaggtgatcctcccatcttagtctcctgagtaactgggactgttactcaggtgcatgccaccacacccagctaattttttaattttaattttgtggagatgaggtctccctatattgcccaggctggtctcaaactccggggctcgagcgatcttctcatcttggcctcccgaagtggtggggttacaggcataagcacctgaccttgcttttttctcccaacaagtcaaactattccctaaataggttcgtgcctctgcgtacgcgtaggctgcttttcttgtcaggaatgccctccatgactgctcacttcactcactgtcttccctgaaagcggtctagagactcctgagtcctctgtgctggcttctgtgtgtttgctgtgagctcccttctagaaacccttccaaatggcagtcatcacactgtattgtaattatctctttttcctactagatgatgagcttgatgtaggaagctgtacttgatctccttctgtcttcagcatcataggctatactgagtatttttgcataaataagattagatccagtacagccgaaattatcatgctttgcaaaataagttaaaaaggttcaactgctcgggagagcagggttcagaggaaggtggagtcagttctgattgagggatgagcaccagaggtcttgaaggattggactctccaggagagattcagagtaagttaggagaagggagtagtaagtatgagaagcagaggaatataggggctatttaggcaacagccagaatgccggttttctgaaacagatggctatctttggcctgtaactggacttttccttcctttgtttcagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagagcagcatggagctgttggtagaatattagtttttaaccatacattgtcccaaaagtgtctgtgcattgtgcaaaaagtaaacttaggaaacatttggtattaaataaatttacacttttctttgcagtagtgcctttaatctggaaatacagtattacttaggatttgcagtacattttgcctgatagggcaagttttcattcttatttttaaaaaatgatagattgtggctgggcatgatggctcacgcctgtaatcccagcactttgagaggctgaggcaggcagatcacgaggtcaagagatcgagacatccatcctggccaacatggtgaaaccccatctctactaaaaatacaaaaattagctgggcatggtggcgggcgcctgtagtcccagctactcaggaggctgaggcaggagaatcatttgaacctgggaggcggaggttgcagtgagccgagatcgtgccactgcactccagcctagcaacagagtgagactccatctcaaaaagaaaaaaacaaaataggcggggtgcggtggctcacgcctgtaatcccagcactctgagaggctgaggcaggtggatcacgaggtcaggagatggagaccatcctggctaacacggtgaaaccccgtctctactaaaaataaaaaaaattagccgggtgcggtggcaggtgcctgtagtcccagctactcgggaggctgaggcaggagaatggcgtgaacctgggaggcagagcttgcagtgagccaagatcacgccattgcactccagcctgggcaaaagagcaagactgtctcaaaaaaaaattatcgattgtatcctttcagataattcttaagtatcaatttttcagatttccagaagaaactctttggggttttaatttaaacatacaggttaagtttgggagcattgatatctttatagatttcctttctactccgcttgctgcgatttattttttattttttattttactttatttttttttttttgagacagagttttgctcttacttcccagactggtgtgcaatggtgtgatcttggctcaccgcaacctccgcctcccaggttcaagcgattctcctgcctcagcctcctgagtaactgggattacaggcatgcaccaccacgcccagataattttgtatttttagtagagatggggtttctccatgttggtcaggctggtctcaaactcctgacttcaggtgatccacctgcctcagcctcccaaagtgctgggattacaggcatgagccaccgcgcctggcaatgctgagatttttaaaaacactctgcagcaaggttttataattttcttcaaaggggtcttaatttataaagacttacttccagctgcatttttatttgtttatttattttgggggggtctcactgtgttgcccaggctggagggcagtgatgcagtcataggttgctgcagccttgaacttttgggttcaagccgtcctctgcctcagcctcctgcgtagctgggactacaggtgcaagccactatgcccggctcattttttaatttttcttttgtagagatgggatctagctatgttgaccaagctgatttcaaactcctggcttcaagtgatcctcctgccttagcctctgaaagtgttggggcgtgagccactgcgcctgacctgttattatgcttttgttgctactgtgtgaaaataccgttttttccccctgactgtttagagtttgcacttagaacagttggtggttttgaatgtttatcttatctggccattttactgaactgtggttttgtttttttggagacggagtctcactctgtcgcccacgctggagtgcagtggtgtgatctctgctcactgcaacctccgcctcccgggttccagcaattctcctgcctcaccctcccgagtagctgggactacagggacccaccaccatgcccagctaatttttgcacttttagtagagatggggtttcaccatgttaggctggtctcgaactcctgacctcaggtgatccacccgcctcaggctcacaaagtgctgggattacaggcgtgagccaaatccgggcccggccaaactgtttttaaatcactctttagttgat

SEQ ID NO: 790 - DNA, 9881 bp, Human
ctggagccgatatgggaatccagcttccactaagccggacaatacaaagattcgcaccaacgtagaaccacgccacttttctcaggcgggtttttcatttttaaaagtatgattgcttttcataaaacattatgctatttatgttaatgtgtaatagcaatattttcttatttttaagtgaattggcaagtattctgaacatttctgttatgatttagaaaatgataagtatccataggtataacccatacaaacaaaaaagttcttcagtgtcctcaattagttttttttgtttttgttttttgtttttttgtttttttttttttttgagatggagtctcgctctgttgcccaggctggactgcagtggcgcgatcttggctcactacaacccctgccccctgggttcaagaaattctcctgcctcagccttctgagtggctgggattactggcgtgcaccaccacatccagctagtttttgtatttttagtacagatggggcttcaccatgttggccaggctggtctcgagttcctgacctcaagtgatccgcccgccctggcctcccaaagtgctgggattacaggcatgagtctcactctgtcgcccaggctggagggcagtggcacacacagttcactgcaggcttgacctcccctggctcaggtgatcctcccacctcagtctcctgagtagccgggaccacagacacagtctcctgactagttgagaccacaggcgcactccaccacacccagctaatttttgtatgttttgtagagatgaggtctccctgtgttgccaaggctggtatcaaactctgggctcaagtgatcctcccgcctcggcctcccaaagtgctgggattacaggcatgagccactgcgcctggccctcagtgacctttaagagtatgaaggagtcctcagataaaaacatttgagaagcacggaggtggaaatttgtctttggcctgggggcctggagtctaaatactgcattgagtggctgatctgtggttttcgcttaaaatacaggttagatcatttgtttctgtttgcattctgtcctagttgcttctatttattttttctctctttttgaatctgtgaaacattaacagggttccaaacatcagagtgttttgtctaagcttaaaagccctctgggtgattccgatgagcagaggccgggaaggattgagcaagaccatccccgagctccttcctccgctctgtttccagatcccatgactggggacctataaatattttcctgacatggagcaggatcaacttcagcatctgttagcttcatcccaaaggcagggaagcctagagcccctgggagggctctgcaccgcacacaccgccggcctgcagccccagccctgtgcggggtcctggggaggggggccccctttctgtggctcttcctgactccctgcgcgttccaccccagaccctcagcccactctgacctccctccaggagggatggcttgcaaatgccctctggccacagtgcagaccgctaggctgttctgtgcagctttaggccatgccaggaaagagacttaaagccagggccccaaaggccagggatgcctgcgccgggagccaggagcttccccagccacttccagcatgtagactgaagtcaggccacgcacagggctctccaggtcacaccctgcgcaagaaggtgtagcacgctggctctaatttcgagaaggtgaaaacaagagcccctctgcccccacgccctgagctttcccgaaaggcttggggcaaagaactcccctcagtggcacctagggaggcaccaggaaggcgcttgttggaacgggagagaaacggggagagggaggaggacaggggggaggggaggaggggaggggaggaggggaggggaggaggggaggggaggggaagggaggggacagggaggggaggggagggataggacagacagacaaagaaaggggtgcggcagcactgccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgagtactgcgtgcccccgggacacccagagagggcccgggcctcctgcactttccccgcggcccagaaccttgtggcacctccagagggacccccaggactggctgcgaccgagctttaagggtctagtcccgggggcagccagtcggccaaggccccgggtccctgcgacggcgaaggcatcccggaggccgcacccagaccggcccggcaagctgcagggactcggactgaaaacctgcccgttacccctggtcgctcgcaggcgcacgggcgatctaaccccgcgccgtccattccgctgatgggggtctcggaagcgccgcaggagagctttgcggagcagggagggggtcgcgggtgctcggggccgtcctcagagcccaaagtgccgcagccctctcggctttccaccccgaggctgccacgacggtgccagcgcgcggctgctcccctctgtgctcccaggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggtaagtacagccccctcctcgcctcctgctccaccaggagggctgcggcgccggagccccccgcacagctgcacggcggcgcttcccagtctggggcgtgctgacgtcgggagactctaacaccagaatgtttgccgagcgcctgcggtgtgcggttccggggatgcggtgggggcagggggcgctcacggggagggcgcaggtgggtcgcggcaggggcagccacagggtgtcacggtccgacgtgactgggggccatggttccctgcgggcggcggggagggatttcctggggcgccccctggaatccaagcccgaccgcagtgtctgaccatggtccgcggcgcggccgggtggtcctgcaggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgaggtgttttcggcgcccgccgtccccagcggcaccgggcagacgtcggcggagctggaggtgcagcgcaggcactcgctggtgagcgcggggccggccgggggcggggtccggggggccggggccaggcgcgctgagccgctgtcgccgcaggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgaggtgagtgggcaccccgcgtgcgcaagggccgctatggcccccgcggtggggacggggctggggcctggctgcaccctcgcctcccagcccaggacagccgcttgcggcttttgtgtggaagaggctctgcttctagcgccagcagtgagcaagggggtgcagccctcccatactctcccaacccggggtcacagcaccgcagggaggacagcgggacgcgcgtcccgaggaggccgccccttcctggcctcggtttccagcccgtgttccgtgggatggctgagaggagtacatgggaccctgtccccaacagtggtgcagagggcacgctggacgctgggcagtggccccagtgaggccatacgcataccagaaggtgggcttctcggaccccaggccaacctcctcttcttcctccccagataacgtcctcctctcccagccacccggccaactccttctactacccgcggctgaaggccctgcctcccatcgccagggtgacactgctgcggctgcgacagagccccagggccttcatccctcccgccccagtcctgcccagcagggacaatgagattgtagacagcgcctcaggtaacggacatacaggtcacatgggacacacagcagccccgaaccctgccacagggcgaccaccaaacccgaacctaaggctctgagaaattccaagtagggattcgtagtgcgtactgcaagatggtgcctagaagatttaggattctgttgattcacacactgaagatgtgactcttgcacattatttgcagttgaaagcatcttacagggccacagcccagaggaaagaatgaaaggaggctccagacagtacctgagagactctgtcctgtcagacacgcacccacaggtgacctgtgtgtcacagctgacaaggaagcttgctaggatggccctgtgtggccaccgggtgacagctatgctgcagggcacctgtgggggtctcgggacccagccaccacacagctcggggctctgctcacaggcgccttggcctggggcggggcaggtgctgatgagcattctcctagctcttccaggcacctgctggacagggcaggctgggaacgctggggccgagtggcagttccctccctactcagctgggtggcagccactggcctcacggagcgcctgtggtctggagcgcattgctgggtcgtgggtcagggcctgttggctctgggtctctgggtctcacctgatatgggtgtgggacagtcagtgtaggccccagacaacagcggacttcagactttcccgaggaggaactggagcccaccaacctggccatgggccccgtcgtcctccaccctccatgttgctggctggagttgaggcaggtacggggccgccccacacctgccccccaagccatgtggtagggacagatgtcgtcttgaggagcagcagtaattacaagcttactgtcagccgtccctggaagcaagggccaggtcaggtcagacaggaggccgcctggctggcgggaaccactccccagacagagactgtgcccagtcctgggtccctcctcatttgggatgaactgggcctccctgtgccagcctcggtgctgcccctgcccagtgcaggcttgggctcctcactcatttgtccacgcggatgccccattccaagcagatgtccccgagccacttacccaacaggcagacgtgccagcactgttcgtggtgtgcaactggtctggcgggaagagcccctcgtgggcagagggtccagagaggtgcggtttgccccacatttgggggcactgggccacagtgggcaggggagcacgtggccagtgccctgggctaggagagggataaagtcagctgtggccaagcagaagcagtattgcaggggaagggtggggagagactgtgctatgagctctgagcaggaggcaggacatggagagaagggtgggagacggacagagccagctgtgccagccgagggaccagagtgggcagtggggacggagcacagaccaccgcccacaagggtctctcctgtgacttctggcttcccgagggcagaggctgggatgggcatgtggcggctggcacccaggaggctccgccaggtccacgccaagccagcctggctcagctctggcttcctgctcacacgctggatgcctgtccccaggcctcctgacagggctctgcagcattggagaggcttgtggtggggccctcgctgtagaacaggcactgccagtgctcactgactcctcattgcagccagggcaggggcgctcccaccacctcggtttcagtcaggaagctggggggtgctgggatctgccagcagctctgtgtgctccccaggtgggctgcccggggccctggctctctggcttctacaccagtgcccctgcgaagcctcagcgcccaaggtctttgcaagccctgttcctgcatctctggagagggctgctccaggtgtgggcctggccagggcttccagaccagtccaggcactgcacctgcacattgacccccttctccactctctctcatccttcagtagccacaaagctggcagcagggtactcgcagatttgtgaggagagccgagcccttgctgactgtcctcccgtgcacggcagagtgaggcggggctcctggcctccttaggggctgcccgctctgggccacacagccagagaaacactgtccatctggctggcttggcctgtggggtgcaaaagaggtgttttcactttgctttggaaacatggaaattaccaagtgacttaaccataacaccaaatgatgatttttaaatttatgaaaattatggaaccagatgggacacagggaaacgagaacgatactgaaaaggtctgagtcctgtggggggtccaggtcccgcaagacagctaatcaggtgcccctgtctgttattcgggtaaatgtagcagctgggtccaggctcgggcagagcagctttctacagcaggggtgtccgccctctcccggggttcccacggggttcccaggggcctcttactctgccacgatgtgggagttccaccaccacagggacttgagcggcagctccggctcttacgtagaaacgcgcaactccagtccctaggttgtgtccgaggttgctatggtgccatcccatcttgccgctcactctgcgactgtgcggagaaacgcaagtgcccccgaagggtgggcgtggcctctgatgaatgcacacgttggtgggaggtggcttccgtttgtacgaagcgcctcttcacgcgagcgttcacctcggtctcccctttgcttggtccagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcacaaatgtccctggctgtccccacacttgttctgggccccgtgcagtgcagggacccgtggtgtgcgctaattggggacacacattcagaaggcgcctggtgctgccgtcagggccatgaggcacgtgctctgtgtgtgtgtgggaggcaggcctgagacctacagatctccccacaacagacgccacccctggcccatacaggatttcagaagacacagcaaatggcatgtcagatgcatccacaaacccggcaggcacgcgcctgcccacaggacgatcagaagctcagacaaggggcaccttgagatccggacgaggccccagaagccctcactctgccccctcctctgtgggagcagcttgcattgctgctgttcatgggggggccactgaccaccaagaccctcgcagcccatcaggccaccagcagacacctcctgagacctgagctcagaggccccaacctcaaagatgtcctcaggggctcactgtaatctgtcgtggccctttctgcagcaggggtccccaggcctccccaccagtgccactcacctggtggaaccccagggccctctcagtgcctgggcgggagctctgtgtggtttgaggatggagatgcttgggggatggctgcttcttcagtcctctcccagtgactggaaggtgggggctcacttctctcaccgaggcctggtagacgacccttcctcgtaactgtctaaggccctccagccctgatgcttctagaaccagaccccaggcccagctcccaccaccctgcacgccatccccgcccaccatccttgaaaacaatgaactaagcccaagctcacgggcgcatgagctctgaggtgacgtggagatctgaaaaacccctggcttaaagttttcttaaggttcctgggactgacaatgccaggaggcccctgaaagaatggccgtaaatcctgtgtagagatcacactgtgtacttggaactcaagaggatccccaggaacatgaacccacaatcagaacccataaaacgcacagaacaccagccttgatgctcctgagtcagagcacatggcaaactccacggtcagagccaccgggccgctggggctggcatgaccaggagaagatgctgaccgagttaacctcgccaggagctctaaactcaaagacaccagagcagcacaatggggtggtgcattgaagcctcgacagacggacacaacactccagtcaaagggcagagactgcaagagcagactcacagaaccatgcgctactgtggagcctgtgaagtcctgtaggatcactgaaaggctggggaaggggttgtggtgcagactcctgcagacacctggatccacctgccctccctcctggagcatggagctgggggtccctggggtaggacaggcgtcactttggggccagaacatttactgcccaggtgagaggctattgtgctttcctggcctcagggaccccagggcatgtgttgacgtgggtgccatcactgaagtctctggggccccagggcatgtgttgatgtgggtgccatcacagaagtctccagggccccagggcatgtgttgacgtgggtgccatcacagaagtctctggggccccacgccactaggacggccactgttgtgctgaggcattgagatttgaaggagaccaatggggaacgccatccggtaatggaatgctgtgtgaggaatcccacaggggccgcctggccggagggtggatcagacaggacctatgtggctgccctctcctgaatgaggtggggagcacgggaaggcgcagagtgcagaaacagcactgcatcagtggccgccatcttgacagcagtgagtagtgggtatagacaggaaaatggagaggagaagcccctgcaatagtcccaaaagagagaggtttgggcctcagagacacccgtggacatgggaagaaatggatgagtctgggtttgttttgatgaaaacgcaacgtgaatactta

SEQ ID NO: 791 - DNA, 23116 bp, Human
ttgagcccaggaatttgagaccagcctgagcaacatagtgagaccctatctttaaagaaaaaaatctgatcatgctaagacctgctgaggggagtgtaaatgggcatgtgcattttggataataagacggcaatatttaacaatgcagtgtaattactgagctagagtgttggaagactttcagctcccctgcaacattgtttataatcaggaaaaactgaaaagaagcataaatggctaggtatgagatctggcagaggacacatagtgggtctcaaaagaccatcctggctaacacggtgaaaccccgtctaaaaatacacacacaaaaaaattagtcgggcgtggtggcgggctcctgtagtcccagctactcgggaggctgaggcaggagaatggcgtgaacccgggaggcggagcttgcagtaagctcagatcacggccactgcactccagcctgggagacagatcgagactccgtctcaaaaaaaaaaaaaaaaaaaaaaaaagagggtctcgaaaatgttagtactgttttatttctcaagaataaattgtatacagatgtgttcaattccatattttctatacttattttgtatgcttaacattttcacaattaaaaaattaatttggtgaggctgctggagaaaaggtactcacacaagctggcgggactgtcaattgatataactacttccaagagcagattagaactggtggtatagtgatgccactctttttaacctcttggatggacaaagatagaaaggttggataacagtttgtgttggcaaacaggcactctctttgcagatgggaatatagattgaagacacctccttgcaggtaattttttggcaatatttgacaaaattggaaactccccttcacctagcacaatttccttgaggtatttattctaagaaaataagcaattttagagcaaagatttatctacactgaagtttcccatagcaatcacagtattgtttctaatattagtaatacaaaaagaaacaacctgtatgtctaacactaatcgattctaatttatggtgcaactgaacaatggaccaaaatgatgctgttggaagtttttaatgatgtggaaccgcttgcaaattattaagctaaaagaaagtaggttacaagatagcaggaagaataaaccattaaaaataccaatctgtgcactgacaaatgttataaatattttacgttatgttatgttataaacattttataatataaaaaaatgttaactgaagttacttcctggatgaattacaggtgatttcattgtcttctagaattttcttttccaaaaatgttgtgtatgcgtgtaattattattttaataggagacactctcctttggtgatataatttaaacaggacggtactgactgataacctcccggggaaggcagggagccaagtactacagacttgtatgtttccatggaaatctaacgcgcctttgattatcacagattctggagaagagtgaggacttgggttcaccagtgcgttcccaaggacaggctgggcttctgaggaagttgcccaccctctcggaatctggtttggcctccgtaaaatgggcagatcccgctcggatggcccggttcccggcttccttttgcgggtcaacggcagcgtcacgcgcgcgagcgcggtctgcaaagcccccagcgctgggcgtcacgcggggattgctgtcgccgctgccagccgcagcagcgacgcgaactcggggcgcccggcccgggcgcgcgggggcggggacgcgcacgcggcgagggcggcgggtgcgacgggggcggggacgggggcggggacgggggcgaagggggcggggacgggggcgccccggcctaagcgggactaggagggcgcgccacccgcttccgctgcccgccggggaatcccccgggctggcgcgcagggaagttcccgaacgcgcgggcataaaagggcagccggcgcccgcgcgccacagctctgcagctcgtggcagcggcgcagcgctccagccatgtcgcgcggcctccagcttctgctcctgagctgcggtagggctcgcgagcgcctgtctcgcctgtcgccccccgcccctccacgacaccccctcccgtcggtcgcttgctcacgacgcgctctctctttcttgtagcctacagcctggctcccgcgacgccggaggtgaaggtggcttgctccgaagatgtggacttgccctgcaccgccccctgggatccgcaggttccctacacggtctcctgggtcaaggtaggtgctgcgatacccacgggctggggtttggtgggctcatttgaagacagcaggaaccatctcccctaggctggcgaccctctgtggctgccaggtgggggcgaggggcgtctcccgcagctgaacttggagtacccagcctcccgtcgcgcctcccccaccccatccgcatccaggtacagggccgaattaggttttgctctccgcagacctcaatccccttcctgtcactgaaggtggcctgagatgaatgatccacttaagatgttttggaagggcagagactctctcatttggattaattctggaggccacctgtggttgtgggccagcaggtcaggaagaaagcaacagggacctagatttgggcattggacagggggaatgtctccagacttctgatttcttgtgttttgtgactgtgatgcccatgatacatgggagggggagggggcaatttgaaaggaaaggctaagacacagaagtgacttaggccatttcatccatggtagttatcagtggtcatctcctttgtgggatacccttggcttcctcccctagccctcctcctccttcctctggcagccttgagagcatcaggtggatgcatgagccggagcccgcatgtgtaagaacaggccttgctgctcctactgtaagtggactgagtgacaaggaggctttttcaaggtttcctcttgactgaaacattctcagattctaagatggcaatgatggtgtcattccaaagccaagcagctactgtttgatatcactggtccttctttaagtcaggccactgctaccacagcacctccattttaacccaaatgaatatgatattacaaccttactctgtagctctcactgatttgctgtcttaccacgggggcaaatctctgcacttgtagctttccccaaaatgcagggcgttcttctgcccaccataaaagatactataagaaactgtacgtctttggccacttaacagtacaaggcatcattgcggtgatctctttgtgtgtgtgtctcctaactggatggtcagttccctggggggcagtggctgtatccatacttctgtgtattcttcacggcacctaatttttgccctataaattgcaaaggtgctctgtgaattcagcccagcacttcatgagttatgcatgacggggatggtgctgctgcctcagagcattgtattgtgtataaaagtaaggtgttaaatattcctacttcattggtaccttacttactgtgggatcagagaacacaacaattccgaaattgttctcatagtcaaaacaatagtatttttaaaaatattgtaaaaacaatttttgaatgctcaccacgtgccaagctccaaggtaaatatttacatacattatccatttccatccatcggaagaatggacttagggattagtactgttactattcctactttacaggtgaggaaactgagccttagggagggaaataacttgtccacttttgcacagctagctaaatggtggagttgggatttgaacgaagcagtctgattccaaatcctgagttgttagaggtctatcttgatctctgttttctcccttaataacttaagataaagaaaatcaaagtgcccctgggctaaccaggcagggacttagttatctcaaagaacggggaaaaacatgaaaccactatcccttccagagagtaactatttaataaagaaaacattattaatacccccaggggagtaattaaaaagtactcatgaaacaagtagatgaaatttcaggctgtgaagttcaaacagttctggagtgaaagcttcttgcacagggtcatttggaatggtccactaaaccatagcaattaaccttggacttctccttggatgtcagctggtgacgtaactcggtaacgcatgagcttgtttattggacagaattcttgcgagatttacccccaaggtctttgaaagctctgtcaagaaaaaaagggacagcagtctctaggcgttctttttttcctgttgatccatggaatagtgccaatgaaaagtcataccgtagttattttttgagaagtaaatggtgattgagattcgtgggtaggagagttatgctataccaataaacgaatcaggtgcctcgaaagtgacatatattgttcctttaagcattttttttaaaacagctctcagcatgttctgtagatacttattattttccagcccaataattatactttttcattgattatgcttatacaacaaaaatggatagagtgttctggagacaaggccagtggtgaaatgccaaaatacttcattttacagaatgttaagcatctggtcatttttctataagtttcttgtaaaatgtttcatcaaagtggaggggtagccacaaagggaggaatttcattttggtaaccagaaccagcttatcccatcctactcacttcatcatcactaccctggctttgtaaaacctgttttgccagcttaggagggggcttcatactgggcaaggaaagcagagtcccttgcagtgggttttcaccatccaccagattgaagcacattctgcaggctgtctgcatatcataagtatggttataatgactcacaatttaaaattctattcaccactcaatcctccggcaccatgtagcatcttgcctttgtccatttggcactgatacttgtaattaacaaaaggacccatgtaaaccatgtgttttttatcatatgcctttgaccagaaaactcaaaacagacagcatccaatctgtttgcaacattagggttgggaaggaagagtgttcattctgttctctctgtttcaaagatgcagtgagatgggctagaggggacttaatagacacatgtgcaagaggctaaaggtgaagccaaaagtggacagagatatcccaattcctgttggcccagctcttctcttctatggaccatgtcctcttaactgggatccaacaaagggtcctcttctcatcccttcctcccttatactttttaaggcataatgggtgattgagaagaaatagaaaagttaatacattatattcattaggatagtagctcaatttagctttatgtttattttttgagacagagtgtcaccctgtttcccaagctggagtacagtggcatgaagatggctcactgcagcctcgacttcctgggctcgagtaatcctcccacctcagcctcccaagtagctgagactacaagggcgtaccaccacacctggctaatttttatgtttttaattttttgtagggacaagatttcaatacattgcccaggctggtctccaactcctgagctcaagccatcctcccacttcagcctcccaaagtgctaggattacaggcatgagccaatcgatttatcttttaaagttgtaatagactgggtgtggtggctgaggcttatgcctgtaatcccagcattttgggaggcgaagatgggaggatcacttgagcccaggagtttgaggccagcctgggcaatgcagtgagacctgtctctaccaaaaaaaaaaaaaaaaaaaaaaaagttgtaatagatgtggttctttgaggaggtattttgagaaaatatgcaaatagactttgatccatgacttttcttccactggccatgacctgtgattaaattccagcataaaagggcatagcacaatatcatgtctgtgaggagtaaagccatgcattaaagggctgcatgtggacttcatgaaaagcgtcgctgtgtctacactctctttaatgtaggtttggagagagaggatgactttggttggagtactttgggcctggttgataatcactaaagatagtaatgagtgatcatttatcccagagttgcaatgccttcttgtatcatgctaggagccctgacagcctatgggtgatgcaaaacgaaagaggatatatggtgtcatctctgggtgatgctgcgggggtgaggagagtgaagcatcacaagacaagtgcccttttcagatgatttccaaaggaagggagaaaagggaagtaagagtgtgacttcatataaaagtctactataaatagactttataatattgagaagagccccagctggggcagatcatgggccatccatggagtgttctgcttctgacattaacactaaggaaactgttggagagcaggttaatggcttgcgtgaggccacttcaaaagttcaaggctgtcttccgtgtatgttgctaaacttctttttggtggagttatgttttctgtctctaccatcttgtgtgataatgagctacaaaaccagggatactgaggagagcagagtgccttaggagggcctagagttgataagcggttggggcagatgtaatctgtacagccagagaccttcatagcccatggaaggagccagtactgaacacttactgtgcttccttgattccagaatgattctgttgtaaggtggatttaagaacatgttttaggacaaaaaggaaacatttctacattaaatgtagaaccattgaattatgaaaacaatgtatgttagaattaaaaaaaaaaaatcgtactgtccccattggcacctatagtacttgacctggttgaatcacttttatgggctcctccctaggtcaaaccatgaaagatgtaaagttgcttttcagatgtctctcatatttacactttcattgtttagtagatacttctaagtcccaaatgtgtgccccatcctgggcctggcattggccatctcaggatcaatgtagaacttttgccagaggaccatcttgagcaaaggcctgggaatccactaagactttttgggaaccattgaggtaaccagtgatgtagaagggagacttaaacagcagatatggctgagagataacattagaaagtaggctagagacagattgtgaggggccttgaatgcccagcaacaatgacttgacctttatccttttggcagtaaggagccattgaaggattttttgtttgtttgtttgtttttgttttttttttttttgagacagagttttgctcttgtcgcccaggctggaatactgtggtgtgatctcagctcactgcaaccccctcttccaaggttcaagcgattcccctgccttagcctcctgagtagctgggattacaggtgcccaccaccatgcccggctacttttttgtatttttagtagagacagggtttcaccatgttggccaggctggtctcgagctcctgacctcaggtgatccacctgcctcagcctcccaaagtgctgggattacaggcgtaagccaccacgcccggcctcactgaaggattttaagcaaagacaatggcataatgcaaaatatgcctaaagcaaagcatatttctcctggtgttggatagaatatgattcatcttagaagatgagtctcagagggagacttcattcttttccttcttttcctcttggtcaccagtcctgtccatgtagttctgcggaggagtgggcaaggaagaatgaggccgcctctgagtggctatagaagaagtctcatctagatgagaatggtggatcactgagatttttggacaatagtggaacagagcacaagttgccaaaatcttttagcttgataatggggagggaggaagaaagcagctgagagttaaattgaaaaaaaaaaaaaaaaaaagctaaacaaaaaaaccaacttgttttccattaataaaagggggaacctgagtcacatgaggactggattgtcttagctacgtacttggcaatgtcactacacaaagaagaggaagtttggagaaggtctcagtgacataagggaaagttttatgtagggcaagactaaaagcagattgattacctaaaaaaagtttcctccctctaaagatgtttccgtaatcccttcctggctactcctggaataaccctaaattttgtatcaacaatcattagctcaaaatagagctgggcagaaaatacttccctaagattcttttatactcataagcatgtttttgtttttcattttgttttgttttgcactgaggtgtatttgggtaaaatttccgtgtgtgtcatgtgggactagtacagacttgggagcccaaggcttgttaatatcacttgatgctttcttggaggaccagtctactgcatatcccaaattgggacaatttggagaagtgttccagttcttagcttccagtggttgccagcagtcctcggggttaccgattagaatcggtattaccgatagaattgaggttaccgattctagaagagctggtagctgcctaggattatgggtccacatagggaaaacctttaggaaaagaaggatgctggtttccataaacagttcataatcaccttggaccagcagttctggagaacagaggttctgattcaaatcaggccttgaggtctcattccccaaggagtgggaggcatgtaagcccaggggacaaagcaggactggcctcgaggctggagccatgtgccaatagccccctacgtaccaaccttatttacatggtggtgcggggtgccttatcattaggagtctttcagttgtgagggattgtaaatccaatcaaaactagcctaaagagaaggaaatatattggcttatatataattggaatgggaaaaaattgaaaaatcaaaatacagttcacatttcagttatggatggcgttgtggcttgaattgtgccccccccaaaagatcagaagttctaatttctgatgcttgtgattgtgactttattttgaaatagagtctttgcaaatgtaatcaaattgagatgaggtgctacctgactagggtgggccctacttcagtatgaatgatgtcctgataggagaaaacacacactgacacagacaacagggagaaagctatttgaagacagacacagggattggagtgatgtgtctacaagccaagcaacgccgaggactgctggcaaccactagaagctaagagaaaggcacagaacagattctcccctaaagccttcagagagcttggccctggcaacaccttgattttggacttctggcctcctgaactgtgagagaatacatttctattgtttcagccacccagtttgtggtgctctgcagccctggcaaatgaatatagctaggcttagaggttcatgaatgtccccaggacttggtgactttccatctgtcaactctgccttcctttacattggttctgtgtccaacctctacatagcagccagatcacagccagtaactacagagttggacaagttgcacatcctttatctgaaatgcctgggagcagaagtgtttcagatttttggattagggatgctcaacctgtatatccttccagaagcaagtgcaaaggagaaggttgtgtttctcttcaaatatctcaacttatgtctgattattctcaagggactttgactgggtcacgtgcctatcagagccagtctccatgatcgtggggtaccaggcctgagttaagttgcctcctctagaacctaggtgtggagttcttcagaggacatgaactcagagcttgtaatggtacctcttccaggtccagcaggccccacgggatgctaatagaagagagatgattggcatgaacaatgaagggtccaacattgccttcaaatctcagttccaaaggggttttgatacattattatgatggtgctttaaaaaatacagaatgttgtggatattttgaagacatcatatgtggaaaaaacagtttctccctagagcagagattgggacttctaggacaactttcccagaggagacgggaagtgtcagtggtaaggaaatgacagagtgggtggatggtgtggaaagctatcacagacaagaataatttctattaccagcattaccaattatacagcacttttcttgttttctcacttgattttataataaccccatgagcaagtaagggagctccagatcacgaaatggggctcagaggtgaagtgacatatggaagatgacccagctaacacatggagaaactgggattgacttcagacctttgattccaaagctagtgctcttgtaactttctcactctttctaaaattcacgcattcattcagtaaatactttttcaatacgtcttatattcagggaactatttagtatgcagaatgaaaccttggttataaaaaaaaggagagagagagagtagtaacatcttcagggctttctgtgtgatcgatatgatgcttagggtctgtatacatcatcataagtatcttcacgccagctcagtgagatgtgatcacccccagattccagtggagctatccaagcctgagagtggttcagtcagttggccaagagcagaggtagccgtgggagggctggggtttggttccagctcagtccaatgccaatgcctgtgctcttaattatgttgcctctgctatactcataactctgttaacagccataaatccagctctgtctgttagacccagtaaatttcaaagtagaaaatcatttttctaataaaactacgcatagaaaaaaagatattaatgctcatacattctaccctcattatgacatcaacctctgagccaaactattttgcacattataaagagctgtttttatgatgaatgggaattatattggcactttaattgagttagaaaccaaggtacatgaatgttagtgcacaagaaatgcgataaaaaaagctgctcaatgtggttggaatacatcagattaatttaataccaactttaaatccttacaatctatacccttaaatatgttttatcaaattattagatgaaatttttatactgtttttttttcttttaggtaggtacctattgcacattccccccacccctgcttttatttttttatttttttttaagacggagtcatgctctgtcacccaggctggagcgcaatggcacaatcttggctcactgcaaccttcgcctcctgggttcaagcgattctcctgcctcagcctcccaagtagctggaattacagatgtccactaccacgcccagctaatattttgtatttgtggtggagatgtggtttcaccatgttggcaaggctggtcttgaactcctgacctcatgtgatccacctgcctcagcctcccaaagtgctgggattacaggcatgagccaccgtgcctggccctgcattcttaacaaatctgctatatgataaatttagatttcaattttgtgatcaaaactctttttttgctataaaatgaaactattgccctcttagcttcaaatatggtaatgtaggaggttggcatatatttggataaaattatgtaaacttaaaaaaaaacactttccacaataggatgttttaatattggttcagtttcagccataattaatgatttattttatgtcttttgttttagttcaaattagttcatcattaaaaaaaaaaaactgactccattcacgtgcccatacaattagtacttgtgtttgcttgatttagcattctgcaaatgaaagagagtttgttttaatttagggcctgtgctttccttaaggtcaaatctccatttgagagaaagaatatggtatttaaataatttagtcaaattggaggccttgagacaagtcagagtccccaggctttctgaaaatgagatgtcccacgtttgcacttttccagcccaaccaaaaatgatagagttgtcagcataaaagttaatgtacaacatgtggatttttaaaacatgattgggatgagtgttttgagtaattaatttgctgaaattgtgttgtgctttagcgcactgtactacaatattagcattgtgaagggtgcattaaatagttcctgtcaattatggttggctgtgaatgaatctgagggttccttttgttataaattactatttcctaaaatggttttgcagagaagcaatggaacacttttagatttggaatgtttaaagagctgttcttgccagtggttgattttgagtgagctccaatgtttatgagaactcataaaacaaagcaaagtggggatggcccatttgctgttactccgttttcctcccactgaaatttccctccagtttttggtggtgcctctgccacagttagctcatctgataaagcagggtgatagctgcctggccacgtatctgatgataatgatatgagcttttgcatacggtcccttgatcctgctagggccccacccccattctgagcatgcaacattaacataaaaactaccacgccttttgcagctgtggataaaccccaaattccacagctgggggtcacaagagaaagtttagctgaaaatgtatatacctaaaactggaagttagagggagggttatgaaatatttccaggtgcaatgtatgaatttacagggaattctttttgctgtagttagttattaggcaaacagcgctgttcattggtttggcaagagttcctaggttttgcggatagttctctgggtcatttaggaaaaggggtgtttggaagatgaccctgtgagagttgagatattttgccatgatcccactggtggcagcacatcagaattctgcaggtcgctttgaggttctttgttttgccttctcccttgattcttccttctgttcttatggctcaccctgcctttgttttgccatttaaaaataactagcggcccactgacggttttgccagaggcccttggaaatctaaccgtcaaataaattttattggtgttgctgctgatttttaaaatgaattctctgcaaataggcagaagttactgccagccagttttgatcaccagcacctttttgcttcaacagttcccagcagctaacacaataatggggccatctttatgtaaatagacacaatagtttatgtttctaccagctccagaggggttcacagtgttgatcttgactttcagatgggcctttctgagctgagggaggggttgctggatgggagaggagcttcccaggagaaaaccatgggtgaataatctcaaaacggttgttgcagctacactcgcatttggaggttaatttagaaaaagaaaagcaagattggacatcggaatggggactgcagggactgggccgagctaattatttcaaactggcctttcaggccatcctagacacagattggccctggatgggcctcggtctctggtctcttgaaagcccttgcctggtaggaagaagccgctctgccaggcagcggaagggagaggcaagcagtgtgagcccatgacgaggcttcagtttatggtttacttaggcttgaaaagggaaaaatggtgctaaattagatgtgttctggaatcagatggacactgttagtttcctctaaatttccttggccccacctcctttttgtgctttatttttgcacacctatgggccccagtcttttagcttcctcccatagattcttgattatttaggaaggaatctttccacacaaaaaggaccatcaagaaatgggatttatgtccgcagactcggcctgagaagagccgttcatctcagctcagggctgggagggagctgagcaggttttcttgcaggagcgatcaatctgccaccagatgtctctgtagcccactctacaggaatgctcacaaacaccagggctggagcctgagctttccggtgaccttgtggtatatgctctgaattaataaatgaagcagaaatgactgtgtgtgtgtgtgtgtgtgtgtgtgtgtgtatacgagtgcacacgtgcccatgtgtatgtattttctttcctgagttgcttctcagagtattcccctaactccttggttatctctttccctacactgagttccttcctaaaagtcagagaagagttgtagggtgctcccagaacgggagattcatcattgataggtgcaagcaaagacagtggcagtgggccctgataatctctgtctccttccctaaggtggctcttgggtgcagttatcatgctagggacaggtaaggaatgtcacttaatcctgggctccctgctggtccccagccaaccagcaaagggaaactcaggtgctgctaggggatgtcattgttgaagggctgcccaggaaggctgaaaacaaggatttgctttactgcatgtgtacattcattttagaagctttaaagtatttcaatggaggagcaacttagcaagttaattaggcaaattaaaaatatgtctaggaaagagagaattaatggtgaatgtggtatgagcctaatctatgcagtgggagatgctgtggacactccaccagtttgatcacaaagaattcacagaaagcaagccgcgcacggtggctcacgcctgtaatcccagaactttgggaggccgaggcgggcggatcgcttgagtctgggagttcaagaccagcttgggcaacagagcaagacactgcctctaaaaaaacaaacaaataaaaattagccaggtgtggtggcacaggcttctagtcctagctactggagaggctgaggtgggagtaccagaaggttgactcaggaggccaagggtgcagtgagccatgatcaagccagttctctccagcctgggtgatagagcgagaccctgtctcaaaaaagaaaaaaagaaagccagccagataaaatgtctggctaaattgggcatctccccaagtccggctggtctgtcctgagtacagtgaagtcagctgttactgcccttccatgtggagtttgatatgagcagcaaatgatctgacacatacactctctataaagcatgcttctcagctgtctcactgccatagtacagagaaaaggtgtggcacattcggcgacgtcaggcatgaccacacagagacacagcccttgaggaacaaggtgactgttcgcaggaggcgttgctcatctgcttatctgattttagttgaattgtctggcaaggatcataacagatttaggaatttttccaaataaaaggctgggatacaaaaataggaatcattcagtgggtgagttggtatctgaagaaaacaagagaacatttaatacagaacagtcctatctatacatgtatacatagacacaaaatataatccagcaagattcacacacagcatatcactgtcatcaacagtgactctctctccctaatatagggtggaaattgggatacttatgatagaatcatgagatgtagtcctgatatattccgaagatgtagccttgggaattttcatagatctttcctcccccagaggtcacacacacacaaaagcatcacgtcttgttttacaaacataagttgaggctggatcttctgaaaacaaaatggaaacattggtgtcgagttggagtgcttgcagtggaccgtgatgcgctctgattccttcttcacagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggtgaggtgacctgctgcacttgttttcttcttgaacaatgcatgtgtacttcctttaggtcctaaaatcgttcctctcttttggagtgtagctctagagctttggatcacatctgtggctgaaagtggaaatccgctgcaagcatgtcaccattttctctttctgtggcttaaatgatgccttttgtttgacttttgcccaacacttgttaggggctgagggtggaaatgataaaaatgtggtcacagagcccctgattccgtacaaccgttgatttctccttctgtcagggatctgaaaggaattggacttcgggtaatattattacacctgcaagagtacagtccctgtttaagggggcagtgtgtgctttttgcttagtgttgtatgcacacacctcccttaggccctcctggatctccagcccttcatcctggtttctttgtttcctggtacttagtacaactggcatgttatgtatggattgatttactgtctgtctccccaagagaacaagaacctctgcgttttcttctctgatgtatctgggcacatagtaggccctcaatgaatattcacctgaatgagaggaaccttgcagaggagagtggagagggcaggcatgtcctgcagggagtggagagaaaatgaagagaatagctgattttctctccttttcctcttccatggcgatattgcctacaacttaaggggtcagagtctacagtcacttagatctggctcaaatattaactctgccttttgttagtgtgtgaccttgagcaaatcacggattgacactaagcctcagttctctaatctctaaaatggaagtaacgtctacaacataggcttgttgtgaaggttaaatgagaagttgcgttaaaatgctgagtgtagtgcccgggatagactgaatgaccaatacatattagggaccatgaggacaatggctctcattacccacggctgtgagaatccatccctcgactgctgcacaaaatgtcgaatccattttcaggggttgacatctctggagatctagccattggctccaatggcagaaccccctccgctcacttgcactccacctgctcctgcctggggcatcaagcagattctgtttgcaagcacactatagccaaagctcaacttgcttccccaaacagcacattgggtgttgcacctgagtggggagaggcacctcccttcatgtctgtccctgggctaaaggcctcgctgctcttaccctcccttcgtgctgcaccaaaccctttaacagccctgagggagttgttcttccacccaaccatgctggcacccttgccgaaagagcttgaatgattctagaaaaatctgttgacgtatttggcaatatcagggcagctcccctgcttcctttcatagtccctgaaacctcctgaggtgaggacacaccacagtctacccaacagtgatgaagttaagataatttctggattaacaagtggtggttcatctggtaggaggacaaaataagccaggaaaggcttgacatccgaagtgcaggcagacaggccgcaggataagcctggaccagctgtctggctcagccgccttggtccttggtccttgaccctctctgagcctcggctctttcatctgtaaaatgggactactcaggcctgttctgaagattcggaaagatgccatgtgagagtcgcatgcagccagacacagagcgacagtgcgcgccggctgctgctgtcaccttcactgtcactgttactgtcgttcatcctgatggtgggaagaggagacaagcaggactccaggaccaaggaacaaagcattcttagctttttttcatggtagaaaaatcctgttaaaatggcttcacatgtcgcttacttttttaaaggatgccctgcacagcgtaaagaagagacttttaagaaatacagagcggagattgtcctgctgctggctctggttattttctacttaacactcatcattttcacttgtgtaagtatcttcttaaaacatcttctcttattaaaagattacccagggcaccaatccaagtatctcttgcagatagtgcgaatcatttaataatggtgagagagattattctttgaaccctggactttttgaggcccctagactgggagaatcattacaggaagctccctgaaatatttccagcttttgtctagtggctacgtttagagcattgtggaaaaaaaaaacaaagtaagatataggaaggacgtttgggaaatgacaaggggttctatgcaagagcagaggccctgtaggcgcagtgctagaagttgcagcgctgagggtcccccatcccagagcagaggccccgctcttcctgtgggtgagggagtgggccccactgccccagggatgccaggggatagatcagcctcctttggctgccttcaaactatttctcgtgggggttctccccttctatttttggtatttctgcccatgccttaagaattaatcccaagaagccagagcagtgaggcacagtgggaggcttccggggtgcaggatggctggccggtgctcaggcaccctaagacatgcccatgagctgttggttgcaggttccggctcaaagccctcagagattctttctgcatggctgctcacctgtgttgatgatggttgtgggagagtagggccacatgtgtgtctgacccctctaggaagtgatctgccccctttgtctccatccaccaggcagggctggctacctaggggccaggacagacttcacccaggagctaccccaggactggttcttgccactcactgtgtccctctattcacttacttgcctctctggctgtgcactcatctctctggtttctattttagataccagtcaatcagagactccagtgagcacctactatgttcaaggcattatgctaggcactgtacagggcataaaaaggtgtaagacattgttcctgccctcaaggagcttacagttaggatgttagggttatttgcgtataagaagataattagagttaccaggcagtatgttttaaacatgaatgactttagcttcttgttggaaaatgcctgcttctgtgggcattgactttccatacagagacctaacagtagggggtcgaaatggccacaatcagtgaatctcctggtccaagtttagagacgccagtgaaatggttggtacaaatcccttgtggagcgagtgaggcagtgagtatgagagcttccagaatgggttgtctagccagctcttagtgaatagagtttaaaaggaggtgacaactgctgaatttttccaattattcacttcacatttctttcatttctttttagaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattctttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaagggtgtttttctgttttatattcaactcataagactttgggataggaaaaatgagtaatggttactaggcttaatacctgggtgattacataatctgtacaacgaacccccatgatgtaagtttacctatgtaacaaacctgcacttatacccatgaacttaaaatgaaagttaaaaataaaaaacatatacaaataaaaaaatcccgactttgggatgagtgctaggatgttgtaaaccagtttgagaatcagaatccaaaatgagagctgaaagattggctgagtctttctcggagggagggcatgctggcagacagagctttgtaaacagcatcctccttcccagagatgcttctgcttccatcctggggccacgttgctacccagtacatgagcagctcatactaacatgcacggtcatgggtgggcgggatggagggagggtttctgcttcagaaagatgtgtaacatcaggggctttgtgcctggattcatgggtttcactcaagattctcaaataggtcccttccccccaaaatgttaagaacgatgtggtctaagtagttgtaatagttataaaagcatcaggccaggcacggtgactcatgcctgtaatcccagcactttgggaggccgaggcaggcggataacgaggtcaggagatcgagaccatcctggctgacacggtgaaaccccgtgtctactaaaaatacaaaaaattagccgggcgtggtggcgggtgcctgtagtcccagctactcaggaggctgagacaggagaatggcatgaaccctggaggcagagcttgcagtgagccgtgattgtgccactgcactgcagcctgggcgacagagcaagactccgtctcaaaaaaaaaaaaagcatcataagtggaagtctctttacaaagatgaatacacataaaatgtctctaaaagctgtggaatcactttcaatggaatcaagtctgttctcaaatgctttaccaaaagtgccagggcatggtaattgagagttcacagagctcctagtcacctgagtgtgtagcccagcttcaagatttggaagttatatttccttgggcagaggacttacccctctaagccttagctggccaatctttaaaataagaatagtatctgcctaataggtttattgtgaggattaaataagataatatatagaagcagtaagcctagtgtgtagcaaaaggtaagcctttgattgatattagaacaagaaaggagaaaaaggtagcagagaaagtatcagtaaccataaatctttgacaaagtggttttgttaaaaggaatgaattggcttggtgaaggagtcatgctgctttcagaggattaatactcagtgtactaaaattcttcgtggccattagaattacagtacaggacacaccaggaagaagggttgccctttgtcagtttggactgaattaagctggaaacatgatggaaatttgagagcaggcggactcaatgtttcagacctagtctttggtataagaaaaagtttgtgtgtggcggggcacggtggctcacatctgtaatcccagcactttgggaggccaaggcgggcggataatgaggtcaggagtttgagagtagcctggccagtatagtgaaacctgtctctactaaaaacacaaaaattggccaggcgtggcggcgtgtgcctgtggtcccagctacttgggaggctgaggcaggagaatcacttgaacccgggaggcggaggttgcagtgagccgagatcgcaccactgcactccagcctgggcaacagagtgagactccatcttaaaaaaaaaaaaatgtgtgtgtgtgaggcagagagagagagagagagagagaagggggtgtagaagagaatggagggcagaatttgtcaaggagagtggactggtctcaactgcctcgattgaggcctacgaagatgtttcagaggaaggcagatgatcatggaccatatttattcttcatctccattgccagggaaagctttgtattcaaggctgtcccttgtctatgaaattagttctagagttataataattttgccttgggatgtcccagggcacaaatacagatgtgactatcagctccacattcttccaaaagaaagcctgtggttttttcgtatttataataatacttaggaggtttcctcgtagaaaatactgagccacac

SEQ ID NO: 792 - DNA, 8655 bp, Human
aatctccacctcctgggttcaagtgattctcctgcctcagcctcccgagtagctgggattataggcatgcaccaccacatctggctaatttttgtatttttagtagagacagagtttcaccatattgggcaggctggtctcgaactcttgacctcaagtgatccacctgccccatcttcccaaagtgcttgcattacaggcatgagccactgcacctggcctgtgtgcctcagttttctcatttgtacagtaatagaaacaacaaaattctgaacatttctggtcttggaagatgcccgctgtcttcccccctgccccccagaaaaggcaggattattacttttcagttgatctatttcatctctttaaactggttaagacaatagcgaagacttggccgtgtgtggtgcctcacacctgtaatcccagcattttggaaggccgagtagggagaaccacttgagttctagatgagcctgggcaacatagcaagacccctgcctctacaattaaaaaattaaaaatggccgggcgcgttggtgcacgcctgtaatcccagcactttgggaggccgaggcgggtggatcacttgaggtcaggagtttgagatcagcctggccaacatggtgaaaccccgtctctgctaaaaaatacaaaaattagccaggcttggtggtgggcacctgtaatcccagctactcaggaggctgaggcaggagaatcgcttgaacccaggaagcaaaggttgcagtgagtcgagatcgcaccactgtactccagcctgggtgacagagtaagactctgtctaaaaagataaaaataaaaattaaaaaattaaaaattagctgggcattgtattgcaggcctgtagtcccagctactcaggaggcagaggctgaaggatcgcttgagcccaggggaatgaggttacagtgagctatgatcctgccattacaggccaacccagagagatcctatgtcaaaaatgaataaataccctggtgtggtcgctctcgcctgtgatcccaggactttgggaggctgaggcgggaagatgacttgagtccaggagtttgagaccagcctgggcaacatggcaaaaccccatctctacaaaaaaaatacaaaaaattagccgggtgtggtggcgtgggcctgtagtcccagctactcaggaggctgaggtgggagaattgcttgagtcagggatagggaggtggcagtgagcccatatcgtgccactgcactccagccagggtaacagagcaagaactcatctcaaaaataaaaaataaaaataggtggctgggcgtggtggcttacacctgtaatcccagctacttgggaggctgaggtgggagaatcacttgaacccaggaggtggaggttgcagtgagccgagatcgcatcactgcactccagcctggaagacagagcaagactttgtctcaataataataacaaaaataataatagtccaggcacagctcatgcctgtaatcccagcattttgggaggccgaggcagatggatcgcttgaggtcaggagttggagaccagcctggccaacatggcgaaccccagtctctactaaaaataaaaaataaaaaaaaaaaaattagccaggcatagtggcgcgcacctgtaatcccagctactcaggaggctgaggcaggagaatcgcttgaacccgggtgtcagaagttgcagtgagccgagatcaagtcactgcactccaacctgggtgacagagtgagactccatctcaaaaaaaaagaagaaaaaaataaaaaagaaagactcgttgcccagtgctccctctgggagaagtacatccaaggccctggccctgggagaaaggctctggcactaaccccacccttgacctttttcctgggcggtcctgaagaatgttctgtcccttctccaaggcccccagctgggacggcccaggcgcctataaagggggtccccgcttggccccggcgccacccaccaccatggacccccgtctgcccgcctgggcgctggtgctgctgggccctgccctggtgttcgcgttgggccccgcgcccaccccagagatgcgtgagaagttgtgcggccaccacttcgtacgcgcgctagtgcgcgtgtgcgggggcccccgctggtccaccgaagccaggaggcctgcggccggaggcgaccgtgagtggggacgggcagggacagcgctctgggaagccgaggtggggcaggtgcacgtaggcgcagatgcacacgtgcagggaggtgggcaggtttgcatgcatgtgcccagggctcacctgccggctgcgtgcacagatcgtgggtccgcactggagtgtgtgtgaacgcgcgtgtgaaagtccccagagccgttagccaggcgtggtggctcacgcctgcaatcccagcactttgggaggctgaggcgggtggatccccagaggtcaggagttcgagaccagcctggccaaaatggtgaaaccccatctctactaaaaataatttttaaaaaaattagccggggataatgatgcacatctgtaatcccagctacttgggaggccaaggcaggagaatcgcttgaacccggaaggcagaggttgcagtgggccgatatcatgccattgcactccagcctgggcgacagagtgaaactccgtctcaaaaaaaaaaaaaaaagaaagtcctcagagcatgagtccccctgaggggccagaaacagagtgaggcaggagaggtaggctcttgcaagtacatggtgagatcctgtcttaaaatttcaatattttgatcttcatgaatttttgccttaattttgctttgtttgtttgttttttgagacagggtctcactctgacgcccaggctggagtgcagtggtgagatctcggctcactgcaggctcaacctcctgggctcaaaccatcctcctgcctcagcctctggagtggctgggatacaggtgctgccaccacacccagctaatttttttttctttttcgtagagagggagtctcactctgtttcccaggctggtctcaaactcctgagctcaagtaatcctcccaccttgaccttccaaagtgttgggattagcgatgtgagtcactgtgtccagctttaaaagtatttaaaagtattgcttttgaaaagtattgcttttcacaattatgttactttattttattattttatttttatttatttattttgagacatagcctcgctctgtcacccaaaccagagtgctgtgacgtgatctcgtctcactgcaacctctgcctcccgggttccagcaattttcctgcctcagcctccagagtagctgggactgcgggcacgcaccaccacacctggctaatttttgtattttgtttgtttgtttgagatggagtctcgctctgtcacccgggctgaagtgcagtggcacgatctcagctcactgcaacctccgcctcctgagttcaagcaattctcctgcctcagccttccaagtagctgggattacaggccactccccaggtcacccactaccatgcacagctgatttttttttttttttgtatttttagtagagacaggtgaacaggtgaaacaacaggtttcaccatgttggccagtctggtcttgttttgttttgttttgttttgttttgacattgagtctcgctctgtcccccaggctggagtgcagtggtgtgatctcggctcactgcaagctccgtctcccggcttcacgccattctcctgcctcagcctcctgagtagctgggactgcaggcgcctgccaccaagcccagctaaattttttgtatttttagtagagatggggtttcaccatgttagcaaggatggtctcaatctcctgatctcgtgatccacctgcctcggcctcccaaagggctgggattacaggcatgagccactgtgcccgggccaggctggtcttgaactcctgacctcaggtgatctgcccgcctcagcctcccaaagtgttgggattacaagcgtgagccgctgtgcctggcctttttacaaatattttaaattttattttaaaagtattgcattaaaatacttaccttgctggatgtggtggctcatgcctgtaatccctgctactcaggaggctaggagggaagatcacttgaggccaggagtttgagaccaacctgggcaatatgagactcagcctgagacagagacccttgtctcaaaaaagggaaaaatattaatattattattattatatatatatattttgagacagggtctcactctatcacccaggctggagtgcagtggcgtgatctcggctcattgcaacctctgcctcccagactcaagcaatctgcccacctcagcctcctgagtagctgtgactagctactctcaggctggtgagaccagcctggccaacgtggcgaaacctcgtctctactaaaaatacaaaaattagccgggcgttgtggcgcacacctgtagtctcagctactcaggaggctgaggcaggagaatcacttgaacccgggaggtggaggttgcagtgagccaagatcacgccactgcactccagcttggcaacagagcgagactccatctcaaaaaaaaaaagctgatgctgacatttggggatgtatatggtagtggggctgtcctgtatattgtagggtgttagataacatctctgtcttctgccccctaatgccatgaatagcctcacaccccatccaagttgtgacatctaaaactgtccccagacaagtatcccctggaaacaaaatcaccctggtttgagaaccactggtgtcaattgtaaactgcagattgggtagagggtaaacaaccctctaaattttcataagtccttttttttttcttttgagacagtcttgctctgtcactcaggctggagtgcagtggcacgatctcgggtcactgcagccttgccttcccaggctcaagcgatcctcccacctcagcctcccaagtagctgggactacaggcatgcagaattatgcccagctaatttttgtattttctgcagagatgaggttttgctgtattgccaaggctggtcatgaactcctgggctcaagcaacgcacccacctaggcttcccaaaatgctgggatgacaggtgtgagccacggtgcctggcctcaaaaaaatatcctgatggcttcgtgcctccctgtctgtaccctagtcctggccctggtgcagggatatacgacaagtttgtgcagatgtgttaacacgtgtccacatgtctctgtgtgccactccacttgcggtgttagggatccaggggaggcggtctgcaagggtgtgtcctcgtaggggtgtgtgtgtgtctgtgggtccaccacacatgcgtgggtgaccaggaagtggacccacagacacatgtacacccctgcatgtctctgtaccacgaggagtctgtgggtgggtctctgacctgctctgggtgtctcacggacccttggacctgttggggaaactgacaccatctgtagctccaagacccccgacactccctgggcagggcatggggcactcaggtggcatatggggacccacgcagctggggatgtgagtgtggacatgagttgagtggatgagaggattaaccaggtgcctggcgtacagtaggtgcttaataagtgctcgcttttttttttttttttttttttttgagatggagtttcattcttgtcacctaggctggagtgcaatggcatgatcccagctccctgcaacctccacctcctgggttcaagtgattctcccaccccagcctccccagtagctgggattacaggcgtccaccaccacgcctgactaatttttgtattttttagtagagacaggtttttaccatgttggccaggctgatctcaaactcctgacctcaagtgatccacccacctcggcctcccaaagtgctgggattacaggcgtgagccactgagccgggccagtgctcacttttttttttttttttttgagacagagtctcactctgtcacccaggctggagtgcagtggcgtgatctcggctcactgcaagctctgcctcctgggttcacgtcattctcctgcctcagcctcctgagtagctgggactacaggcgcccgccaccacacccggctaattttttggttgtttttttttttagtagagaaggggtttcactgtgttagccaggatggtctcaaactcctgacctcgtgatccgcccacctcggcctcccaaagtgctgggattacaggtgtaagccactgcacccggccagtgctcactttttatctgcatgcatgagtgtttggtgggttactcagtgggatgtgtgtggattcgtgcacatgcagcatggggtagcatgtcctctgtcgtttccgttccagctgagtttcactctgtccccaggtgagttgctacagtggctggagagacgacatctgctccatgggctggtggccgacagtaatctcacgctgggacctggcctgcagcccctgccccagacctctcaccatcaccgccaccaccgtgcagctgccaccaaccctgcacgctactgctgcctcagtggctgtacccaacaagacctgctgaccctctgtccctactgattcctccttgggtgcagcctcagagtggcctgaggcccagagggtctggtctggtgagctcctgaggccacacagcaccataaagtctcgcatctacaggcctttgattacctcctgggatgggtgctcactatctaccccagaccaatgccacctgcagcctgtggagtcaactgcagaataaatcacaccctagccctggcttggaggatccccgctttcacagatgctggacactgacagccaaatgtcctcactccaggggagccccagacgctccgctccctgcatgtgtaacaccccttcttgctgtctcttagtaaataaacgacccaaagcagcttcctgcattttctctagaaaaagggacaagcctcagtcagtccctgtgtgggcttgtcccccagcagccatggacccaccggcacttccaggagcttgataactagagaggcattgcaacgcaaagtggggaaactgaggcccagggagagggctgcttgccaaggtcagacagggaagggtaagtgcaggacttgaaccgaggtctctaccaaggcccatgggagtccttagcattgaggacttagaatggtagacattagacacaaaacaaatgtcagaaaatgatcatcacaaaacacattagtctttttttttttttttttttttgaggcagggtctcactctgtcacccaggctggagtgcagtggcacaatcatagcttactgcagcctccaactcctgggctgaagtgatcctcccacttcagcctcctaagtagctgggattacaggcacccgccaccacacccagctaatttttgcatttttagtagagacggggtttcaccatgttggccaggctggtcttgaactcctgaactcaggtgatccgcccacctcggcctcccaaagtgttgagattacaggcatgagccacgtgcctggcccagtcatcggatttagggtccaccctaatccatgataacctcatgtctgtctataaagaccctatttccaaataagcccatattctgaggtgaattctcagaatatgaattctcagaatatgaatatgaattctcagacatgaattcttgccagacactactcaatccagtggagcaggggagctgggactctcccctgatggcaatagggagccacagaggctgtgtgagcaggggcagaatgaggtcagatgtgcctgtcagaaagccctgcagccccatctcatccaggcctgatttgcaggatggtgtctcatcctcccagctccctccagtccccagagcagccatttttaaccacctttttttttttttttttttttgagactgagtctcactctgtcgcccaggctggagtgcagtggcatgatctcggctcactgcaacctccgcctcccgggttcaagcgattcttttgccctcagcctcctgagtagctgggactacaagtgcacaccaccacgcctggctaattttcatatttttagtagagatggggtttcaccatgttggccagaatggtctcaatcttctgaccttgtgatccacccacctcggcctcccaaagtgctgggattacaggtgtgagccaccacggctggcctattttttttttcttttttttgagatagattctcactctgtcgcccaggctggagtgcagtggctcagtctcagctcactgcaacctccgtctcccaggttcaagtgattctcctgcctcagcctttcaggtagctgggattacaggcatatgccaccacactctgctaatttttgtatttttagtggagacggggtttcgccttgtctaggctggtcttggtctcctgacttcaggtgatccgcccacctcggcttcccaaactgctgggattacaatcgtgagccaccatgcccagcctcattttatttttgaaacaaggtctccctctcacccaggctggagtgcagtggcatggtcctggctcactgcaacctcaacctc

SEQ ID NO: 793 - DNA, 17199 bp, Human
cacccttgtgtccctgagctcccaggggctcctagtagcttaggcagcaccttgcccacaccaagctgagggagacctgagaaatgggattcctgccaaagaggcaaagaaaaaagtgaagggacaaatgcaaggccatctttgccatttgcgtatgaggcataaaacttggaagataataaacagcaaaatcatagtccctatgtgctgagtgctttctctgagccaggccctgtgctgagtccttaccccaccttgtgagatcgatgacagccctcagagaaggaaacagaggctaggagaggttaagtcccttgtgcagtgtctcagagcttgtgagtggcctgtctgtctccagggccatgctgtaggaggtggccctggattcaggccccttgctatggtttaatgggtttcagtgaaatagttgggaaacctcaggagtgggatatggagttaagggaaagaaaagccagagagaaagggaaggagtgcaggtgactgtcccttagccaccccagtcctgatgaccacaggcctccatgccaataagccctgactagtgccacttgggtccaaacatggcatctctggccccaagggcttagtagcaaacacccatctagggaagctggcgttcattctcatcacctcaaatgcttcatgagcctcagggatcaaccttgaagtgggtataaggctgggagaatgttgggggcagcaaactgaagggcacaataagaagcaataaggccacctcaaagcccacccaagcaaactgctcattcacctccttccttcctgaatttcaccttatgaggaggtgagtggaaggtagggtatcccttaaaacatctaaaaggagagttgggggcagcaaaggagatgtgcttcacgggactcttataaacaaaactggggagagaagaattggaggaagggggaaagacacagatgaaagggaggggaaggtgtgggagagggaaacgtataaaagcttccaagaggagtgggaggctgggggttccccagacagagactcagtctggaccagatgcagagaacaatggacttcaaggctggaggggggcagaagggaagcgggaggagagccacacggtcaagttgcacaggttcttgcagcttctggaatcaagaccatgggcaccctcataagtcagtgtgggcagggactgccccagggccaatccaagatccagaggtagccatagggtgtgacaagttgtgcagattacaacactcaccccttgcaataacgtcactgcctgtgactcggggccaggcccaggccaaagcccttcctacatcatttcgtttaatcctcacagtttcctgctgaaagggctactattcttactcccatccccactctacagatgaggtaatggaggcccaggaaagttaagtgacttgtcccagatgacaccgctggtaagttgcaaagtcagaatttgaactcaggcagtttacctctgatggctgctctgttaatcacagctgctttccagtgagacaaaaacgggtgatcagggcagagtcaagacagagaggtaaacaagattgggaaaaagacaggaatgagaggggaacaatgggggaaaagataggaacaaagagagttggggaaggggagagaaacaggaaacatgacttgcccgggaggggcatcagtccacgtgcaagcaggtggaggctcaagttttctgctcacttggtgatgcagaggctccctttccctcagcagccgccttgctgcgtggacagcagcttcccatctggcctgtccccggagccccggcctcatcctcctcagcggcaggccacttagcttcacaggaaatgctctttctctaattggcattgaaactcacagccctcccttttcctgtaggtggggtttccataggaaaaagctgcttctctgtttccccagcctagcaactgtttggcagtcagagtcccacatcctgctcaactgggtcaggtccctcttagaccagctcttgtccatcatttgctgaagtggaccaactagttccccagtagggggtctcccctggcaattcttgatcggcgtttggacatctcagatcgcttccaatgaagatggccttgccttggggtcctgcttgtttcataatcatctaactatgggacaaggttgtgccggcagctctgggggaaggagcacggggctgatcaagccatccaggaaacactggaggacttgtccagccttgaaagaactctagtggtttctgaatctagcccacttggcggtaagcatgatgcaacttctgcaacttctgctggggcttttggggccaggtggctacttatttcttttaggggattgtcaggaggtgaccactctcacggtgaaataccaagtgtcagaggaagtgccatctggtacagtgatcgggaagctgtcccaggaactgggccgggaggagaggcggaggcaagctggggccgccttccaggtgttgcagctgcctcaggcgctccccattcaggtggactctgaggaaggcttgctcagcacaggcaggcggctggatcgagagcagctatgccgacagtgggatccctgcctggtttcctttgatgtgcttgccacaggggatttggctctgatccatgtggagatccaagtgctggacatcaatgaccaccagccacggtttcccaaaggcgagcaggagctggaaatctctgagagcgcctctctgcgaacccggatccccctggacagagctcttgacccagacacaggccctaacaccctgcacacctacactctgtctcccagtgagcactttgccttggatgtcattgtgggccctgatgagaccaaacatgcagaactcatagtggtgaaggagctggacagggaaatccattcattttttgatctggtgttaactgcctatgacaatgggaacccccccaagtcaggtaccagcttggtcaaggtcaacgtcttggactccaatgacaatagccctgcgtttgctgagagttcactggcactggaaatccaagaagatgctgcacctggtacgcttctcataaaactgaccgccacagaccctgaccaaggccccaatggggaggtggagttcttcctcagtaagcacatgcctccagaggtgctggacaccttcagtattgatgccaagacaggccaggtcattctgcgtcgacctctagactatgaaaagaaccctgcctacgaggtggatgttcaggcaagggacctgggtcccaatcctatcccagcccattgcaaagttctcatcaaggttctggatgtcaatgacaacatcccaagcatccacgtcacatgggcctcccagccatcactggtgtcagaagctcttcccaaggacagttttattgctcttgtcatggcagatgacttggattcaggaaacaatggtttggtccactgctggctgagccaagagctgggccacttcaggctgaaaagaactaatggcaacacatacatgttgctaaccaatgccacactggacagagagcagtggcccaaatataccctcactctgttagcccaagaccaaggactccagcccttatcagccaagaaacagctcagcattcagatcagtgacatcaacgacaatgcacctgtgtttgagaaaagcaggtatgaagtctccacgcgggaaaacaacttaccctctcttcacctcattaccatcaaggctcatgatgcagacttgggcattaatggaaaagtctcataccgcatccaggactccccagttgctcacttagtagctattgactccaacacaggagaggtcactgctcagaggtcactgaactatgaagagatggccggctttgagttccaggtgatcgcagaggacagcgggcaacccatgcttgcatccagtgtctctgtgtgggtcagcctcttggatgccaatgataatgccccagaggtggtccagcctgtgctcagcgatggaaaagccagcctctccgtgcttgtgaatgcctccacaggccacctgctggtgcccatcgagactcccaatggcttgggcccagcgggcactgacacacctccactggccactcacagctcccggccattccttttgacaaccattgtggcaagagatgcagactcgggggcaaatggagagcccctctacagcatccgcagtggaaatgaagcccacctcttcatcctcaaccctcatacggggcagctgttcgtcaatgtcaccaatgccagcagcctcattgggagtgagtgggagctggagatagtagtagaggaccagggaagcccccccttacagacccgagccctgttgagggtcatgtttgtcaccagtgtggaccacctgagggactcagcccgcaagcctggggctttgagcatgtcgatgctgacggtgatctgcctggctgtactgctgggcatcttcgggttgatcctggctttgttcatgtccatctgccggacagaaaagaaggacaacagggcctacaactgtcgggaggccgagtccacctaccgccagcagcccaagaggccccagaaacacattcagaaggcagacatccacctcgtgcctgtgctcaggggtcaggcaggtgagccttgtgaagtcgggcagtcccacaaagatgtggacaaggaggcgatgatggaagcaggctgggacccctgcctgcaggcccccttccacctcaccccgaccctgtacaggacgctgcgtaatcaaggcaaccagggagcaccggcggagagccgagaggtgctgcaagacacggtcaacctccttttcaaccatcccaggcagaggaatgcctcccgggagaacctgaaccttcccgagccccagcctgccacaggccagccacgttccaggcctctgaaggttgcaggcagccccacagggaggctggctggagaccagggcagtgaggaagccccacagaggccaccagcctcctctgcaaccctgagacggcagcgacatctcaatggcaaagtgtcccctgagaaagaatcagggccccgtcagatcctgcggagcctggtccggctgtctgtggctgccttcgccgagcggaaccccgtggaggagctcactgtggattctcctcctgttcaggtacctggggcatgggcagctctttctctggtcactcctggaccaccagaaacagaatcagacacccccataacctgcacagtcctcatgtttcttccttaggctcacctggcactttctgatgctttgggtagcaatggttcagggcacagctttgtgatcggctgaacttagctgtgtgatcctaggcaaattccttactgtctctgggccttagttgtcttatctgtaaattagagatgatagtaagggtatctaccttgtagagttgtccagaggatttgatcaattaattcctataaggcatttatggtgcctcacaagtagacacacagcaaaggtagtgattaagagtataagctttgggcaaggttacctgggttcaaatcctggctccacttcttcctagctctgaaccacagaggaagttaacatctctgttgaagatgtctatgttaacaccacccatcttctaagtttgcctgaaaataaaatgagtgaatgctcttaatgcctgtagaacagtgtccatctgacatgtagtcagtactcagcaaattattactattacttcctcaaagcacttctccatctccactatttgcctgccttcatctcatctgggcaacttccctatgaagaaggccagcataggcatcattgcacccaaacccaggtgttgcaaataatttgtctgagaccccagagctttccggctgggcctgcggatggggcagtggaaattaccttagaacttagcagttaggcagattggagttcagatttcaacacagccacttaggagctgggcaaccttgtacacgtccttcaacatctgagcctcatttcctcatctataaaatggggattatgagaccaaacttaccctgtgtctgcctccttagagtgtgagggctaaatgggatgatgagtgtcaaaatgtctaaggacctgggattttctagacacaagtggggaaacctttccagggatgatgcctgatctcacacccatatctgcttctgtgaacctcagatattttcactgtgccaggctgcccgcccaaggcacacttctgtttggccaggctatcagctcaggtttcctgtgaagcaaaacacagtttccttccctattccctcctcaggaagccacctggagatggcccagctgttctcttaggaatcttgccctgggatcggtgcagacccagaggttgccagagccaaccattcatttatccttccattcatccatccatttatcaggtgctttttggataaactctgtgctgaacactgtgctggctgctggtagacaggacaacagagaataggccctgtgggtgaccccgctgaggtgacagaaagaaaggtgcccatttgggatcaacttgagggtaacaggcaacttgcccaatgctcatatctttccagcagcacatagagtcagatctgagtgtaaattccagccctcccactaatttctgtgtagcccctgtgagcctccaattccacctctgcaaaatggccataatggtatctcttcccttaggctgttgtaagaattaaatgagattatacaccactggacaatcactgtttatcatgggatttattaataagctcatttaaacctcgtaacccaccatatgacctgggtctcattaatatgcactttttttactgttgaggaaactgagtaattttctcagaatgcttaagtaattcctcaaggccacactgatgggaactggggcagggacatatttaggatttgaacctgagtctgactgattcgagtctgggctgtaactgtgaagtgaccctgaatgacagtgctcagcatagggcttggcatgtagggagtcatgtcatgaaaaggcagctgtcacttgagcaaagggtggcaggtatcttaggagggcttctgggcctgggctgggaggtgggatcttccctgaggcaggcaataagaccccgagtctcccaagtcacagtgaaaccccagtcctggccatctcctcttccaactctcctctgaggttgacacttcctacctcaagctgcacagaggggcatggtggacctcctaagggaggaatggggatggacccaggaggaggaagcagtgtttctaggaataacagtgcaaactccttgcttttgcagaggatttttaactttttcaaaccatttaatcgtgacaacactgagaagaaggcgtgtgggtatttctagccccctattagagatgaggaaactgaggtctgaggaggtctaaaaacctgtctaatgctatacaataagctacaaatggccttgaactagaactccgcctcccaggacttgatctgttgcctctcccttccaatggcctatagggtctggccgtgatatctcacccatcccctactccattctccagtctttctgaaactctaccttctcttccagcctttcagtgtgcagtgcttctgcctgaaaacctccccaccccttgcccagaccttcattctctttccacttgccaaactcctatggagcctttgggtctcagcagaggtgcctggcatgtggtatgaactcagtaacatctgttgaaatgaatgaattaacttaatccagtaccacccccctgcttcctccctgctccaagttgggttaggggccctctgctcccacagagcccccattctttccctatgcccagaggcaacccctgtggtaaacactcttcgctgccctgatctccagccagcctccctgtggggctgcctgcaaccttcacatcctgacagatgtgaccacgctgagggcagcagctggggctccttctccttcttactcccatagcaaccaccctgcctggcacttattaagtacttgttgaatgaatgaaaagatgaataaatgaataattcaatgacaccattttgccttctctacaacatagtcttacatctggtcaacaaaaattggccgaatgtccaaatactgctaaaggggaacataactctttaagataatcttcatcaaagtaacaacaaattgatggtcaggaaatgcctttttcaccccatctctcagagtccaccaggtgcaggacactcggaggaatgagtatgaggggacaggcccagagggtcctcttgctctccttcagacactcaggtcctggggtgacatgacagagcaggggacctgcccgcccaggtccctgtctctgtcactgggcaccatcccccatctgatcacacaaacatctgaagccagaggaaagactataaaaagaaagcaccggcattgagggaaacatccggcgaggaagtgtgctgagtcggaattgtgtggagtcaacagatttttcctgtcttgtagcaaatctcccagctgctgtccttgctgcatcagggccaattccagcccaaaccaaaccaccgaggaaataagtacttggccaagccaggaggcagcaggtaagcagcacgtagcccccacaggcatctcaaggcccctactggccgcccctcatcactgcagcctctgtgagtgaggaagggtgagcacaagtcagacaccggtcccctgggagggtgcagcagacagcatccatcctcccaccctgggagttttggtcgtgaggtgactgtattgatagtatttacaggacctagaagtcctgtaggactaactagctgtattgataaataccatcaatacagtagtcaccaaggaaatgacctcatccctgagactgtatttgtcccaattacagaggtgctgtaaattgcctttatatctgtaactgtcacctctctttctcttgacccataaacataatatgaaggctccccactaaagacatggctgtgtgggcgtgtccctttgggcaatcctagaattgaagacaccttaagagaacatcaaatccaacttcttgttacggatggagaaactgaggctctgagtagcttgattcaaaccagctatgtaaacttgagcaagtgagataatctctcaggaccttggtttccccatctgtaaaacagaacccatcccatttcccttgtggtaatggggtgaggatttcataatcaattgtattctaagcccatagcccagcaactgacacatagtaggtgcacacacaatgctaactcctttccccttgaagcaattttgctaaaggtcatgtaacaagtgagtggcaaagctgggaccagctctcagagttcctgactcctgcatcagtgctcttgccctgacaacttacagcttctttttacaaggatggtgagaggtagtgtactgcaggggtgagtccacacactccagggtcacactggcctggatttgaagtcttgctttatctcttaatctatggggaccttgggcaacctgcaaaatcttcacaagtcttggttttctcatttgtacaatgggttgattaaagagaaccccttacaggtgtggaaggtttgaataagacggtgcatggaccttgcatcgcataaggcctgactcagactcactgctcaaaaacattagttgtcattatcacccacacacttgccacctccctgctcatttcttcacagcagcagaaatggctacaggggaacaaaaccaaacaaacagaaggactcctacgccttaaaacccctcaggtagccttcccacctgctgggatgagggtccaggcctgtccccaagtgtctatgggagagagggaccaggatggagacagcaggagactggggtgcaggtagcagattctgagcagctttaggctgcctcactccggctgcaccctccataggtctgctcttctggcctaggatttggcctaaagtagggaggaaggaatgttcagtcactcattcagcacccactgtgtgccacgccctgttctgagcatcagtgagggagcaggcaatgagacaggcaaaaatcccagccttctcctacggacggatggacggctgcactggctccactgaggtttactaaactcctcctgtgtgccaggcaatacctagacatgggaggggcaacgagaatgatatcaatgaactcatcttcacttctgtctgctgagtgcttacaatgtgccaggctctgtggtaggcccctctacctacaacgtctcattttaccctcacaacaccctgtgaggtgggtgttatttattactctcattttacaaatgaggaaacagagtaagaggagggcgggaatcacatgatccaggttggtctgactctagaggccaggctgtgtatccagttccctatatgggtaaatgaatgcaaacatgaatgggcatgaatgaatgaatctatatgggaatgtccctacccatggactggttggtttcttttgcaggagtgcaatcccagacacagatggcccaagtgcaagggctggaggccagacagacccagaacaggaggaagggcctttggatcctgaagaggacctctctgtgaagcaactgctagaagaagagctgtcaagtctgctggaccccagcacaggtagggaccccctggagttaccttgaccctgcttctgccccatggtgtccaagcttcagagttctgctccaatccactgcagggaaaagccattctgtttctgtggaggaacatcagcaacatttaacttcccttgcacccttgcagcctcagaaagtattttaaagaccaggttctactttgattttttttttttttagacagggtcttgctctgtcacccaggctggagtacagtggcatgatcacagcgtgatcacagctcactgcagcattgacctcctgggctcaggtgatcctcccaccttagcctcccaagtagctgggactacaggtgagcaccaccaccacatcccgctaatttttgatttttttttttttttgtagggacagggattcacctgttgcccaggctggtctccaactcctgggctcaagcaatccacccacctcagcctcccaaagtgctggcattagaggcatgagccacctgtaatcaaagccaaagtaggcacctggcctacgttgattattcattttaaaaatcattgtaaaaatagtgaacatgccaggcactggggaagcatcttatgtacatgatctcatttaagcctccaaccaatcccctcaagtagataattattacctcgaatttacagatgagcaaaccgaggctcaaaaaaatcaagtagccttcccagagtcacccagctcaccagtgattgaaggggagccaaaccctgagccagcctgtcctctatggacttcttaccactcattggcgtttggtgtgtttcaataccctttcaccctgggaaccaggtcaactctttaatatgctaacaattgcaatgaaaacaaaaagatttttttgcagagaaataattagctttgacaataaatacataatgtgaacttgaattcaagaatctgctagcgccccccgcccctgctgtggacattggtcagcctcctttggtaacacaccccacggcagaccatccctgtgctgtggttttctatctatgtagttaacactgtttctcatgtgctccatctggctgcagacacactgaaggtatggcagggacttctctttccttggttaaaaaatattgctaatgtttattgggcactttctatgtgctaggccctgttctaagtacctcatgagaaaatcttatgagataggggctattcattatccccatttcataaaggaaaaatgtgagggtcaggggtgtttcataatttgcccaaggttgtgcagctcgtggatggttattaacacaggcagtgtggctgtaaattttagagctgtgttgttcaatgaggtagtcactagcgacaagtggctatttaaatttaagtgaattaaaattaaataaaataaaatattcagttctgccataccagccacatttcaagtgctcactggctatgtatggctgggggatatagctttggattctatctctattggtcagctctggctggaacctgtggggtcagttcccacacggtcctgcttgcccacagcacaaagggtactgaacacaggggcactgtaaggagttgggggtaaggaaagaggaggggcagaaaagcctttgctgctcacaggctggactgccatggggagactgggatcttgctgcttcagatctgcttcagattgcttcagatttgctgcttcggattcagattgccccacttgagaatgcgaccatgataatgttttcctggttgcatgaactcactgaacctcacaacaactccacaagatacgtactactgtctcaccacttcctaagaggaaacgggagcttagagaggttaagccattttcccaaggtcacacacactgcccctaagctgcaaagctgggaaatcaaacccaggttggcccagtgcccacctgcagctagaactggtgggtgatgctgggtgaattcagcatcacttttcagctgttctcatacgccccagtgattttctcattccaagcttcactccttctgaagctctctgacccgtgtaaaaggaaaggcctgattctataacaccaagagttccatccaaccttatagcctcagagtctcaaggaactaaggtttgcatttcccaaatgttgaaggttaatatttatgttcattcaatcattcaacaaacattcactaagtcccaggcatggggctaaacccaaggatccagtagggcaggagcccaacagtgtctcacaagctgcacagtccagaatgcagggcagagattcatttatcagtacaataaatgactacacatacttcggaataacttgttcaaattacataagtaatatttggttaatatagaaaaacatagataaacaaaaagagaatggattgcttctgcccagaggtaatttcagttaacattttgacatatctccttccagtctttcattctgtgcgcagattttaaagtaactcaccttaggcaaacattagataaatgttaagtagatgttgtgcttttttttttttttaatttttttaagacactgtttcttaactccaagacttataatttctttcctctggcttggtctctaccatcaggcctgggactggtttcttgaaacaggattttctgttaaagggatgggaaaagaagggtgactgtggcattgcaaatgtaggggccagttttttgaattcccagccaccaggctgacttgccaccgccactaccccagtccctctcctgggacagcccttggacaggcagcccctccccagcctgactctaggccagggttccagcagcttgagagatgatgttgaggaggatttgaggatctggggccaggtggtaacagtgcagaccttaggtagcctgggaattccagaggccccagctgggcacctggagtatccagggggaggaagggccagctcttcagagagagggtagggtggtgccatcataggcttcaaagtcatcagacctggcatcaaattgaggtttggttgcctagcagatgtgtgacttaacttctttcagcttcagtttcctcatccatcaaatgggaataatactcttgacctcaaaggtttgtgaagttaaatgaaataattatgtaaattgctcatcacgtaagtacctaatatgtggtccctattattatggatgggaaccaaaaaaggcagcgctaagtcaggaactccagccttggcaaagaaaagggattttccctccatcctcagctagtggagccctgaggggagaaggcgccctgaggggtaaaaatcctggatgaaatatagaagacactgagactggaaacacacgcccagattgggaaattcttcagaaaacggcaaatttctacttctaggccttctcctcctcctgctgcttccccacttggttcgcccgggtgtgtcagtcgactgctttcctacccagggagcttccctgtcagggcctcttccttcctgtccccgtctggccactctgtctgtcccctgccatttcccttccctcctttgtccactgcccttgccctgctcattgccccaccctcacccgcctggcccttcccggagcctggccctcactgtgtcccctccttcccccacaggtctggccctggaccggctgagcgcccctgacccggcctggatggcgagactctctttgcccctcaccaccaactaccgtgacaatgtgatctccccggatgctgcagccacggaggagccgaggaccttccagacgttcggcaaggcagaggcaccagagctgagcccaacaggcacgaggctggccagcacctttgtctcggagatgagctcactgctggagatgctgctggaacagcgctccagcatgcccgtggaggccgcctccgaggcgctgcggcggctctcggtctgcgggaggaccctcagtttagacttggccaccagtgcagcctcaggcatgaaagtgcaaggggacccaggtggaaagacggggactgagggcaagagcagaggcagcagcagcagcagcagcagcagcaggtgcctgtgaacatacctcagacgcctctggatccaagaaccaggggcctgaggatctgtggacaagagctggtttctaaaatcttgtaactcactagctagcggcggcctgagaactttagggtgactgatgctacccccacagaggaggcaagagccccaggactaacagctgactgaccaaagcagccccttgtaagcagctctgagtcttttggaggacagggacggtttgtggctgagataagtgtttcctggcaaaacatatgtggagcacaaagggtcagtcctctggcagaacagatgccacggagtatcacaggcaggaaaggatggccttcttgggtagcaggagtcagggggctgtaccctgggggtgccaggaaatgctctctgacctatcaataaaggaaaagcagtgattcattctcctgtttgcacctgtcaagagggagaagggaagagtaatagagtggggtttatttgtcatccaatccctggcaagaccgtcacactgggcctggacaggagtggggcaccttggtacacagtaacaggtacacaaatagcagacatgtgtgctcttacccctgttcccctatcactatgttaccaactaatctgcttctcagctgcaaaattagagctaagaaagcacaactatttataaagcatttacatgagccaggcaccaggctttacaataggatttaatttgattttccaacaatcctgggagggaggtattattaaccccatttcacagacacggatatggggcttggagaggtcaagtggctttcccaagatcaagcagggagtagagccagagccaggatttggacccaggctgggccaacaccaaaacccatgccttcaaccttgacaccagcctgccaaccaaagacaggagaagggaaggccctggaggtgagctgttggcagcagtgaacttgctcgagctccctcgggaaacactgttgaaaggaacatttccaaagccatccaggcccgcacctctctacattcccaagcacaaggcaaaaggaacttggatctgaactgatgcagacccgttctttcccaacaagtagctcttcaagtgcggatgtcatctttcccaaccccatttgcgggtaaaccttcctctgtcattgcaggttcaggcttgtgaatcccagaggacgctgtgtgaactgggtctatgaaatcggcactgacagcagccagccttccaggggatgggggagggaagaaacagcagatattttcccaaggttcagctttataattttcttggaaatttccgagcagccaatcagctagcttctaaatagtgtgggtctctcctggacactgcaggcaaaagttcctctatctgctcctctttttgtcctttcttggagctcagtgctcatgttcactgttcaagaaatgggccaatcatactcccaactagggataatgtgcatcatacatacttggaatacagtgtggtatcattattccattttacagatgaagaaaatgaggctccccaaagttatgagtttcaggggcagagtttctcctcacctcactctaggccagagtgatctccttacagaatctgtgattttcaggctggatcacagaactgttgggttctgtgggccagtgagagaaactgggggatatcaagcaggcaggcagggtctccagcctgaccagccaggtgcctgctacaaagcaacacttgatgaatagctgttgaatggatgtatgaatgaataaatgtgtcaataaatgcttcagaggccccttttatccatattggagctccaggtaggacttcattagaaaaaaagactctgtgatgtaaaagcaaagtctgagaaccacagtactggagtagaccatggtgacctcccagttaccagcagattttcagtgcagagcagatgttgggagggtggagagaagagagtgggcagggggagatgacctgaggaagctggagctatagctggcaactggatcactagacacatgggaccattgcatcattctagttcaaaagccctaaatctgtactccttgggcaccctgaatactaggtaaaactttgtgtctagacacttttttaggcagaagatacaaaattctcatcagattctcaaaggaaaccttgacctttaaaaggttacacagcattgctttaagatactatctaaacatccacagacatgggcagttgtcataaagagtctgaactttatctatttcaactcttcattttatagccaagaatatagaaagaaacggcagatgacttgcccaaggccacctggcaggtttgtgggggagagctttccaaattaagacatttaactgagtgcttgctcaaatcaggatttggatctgggatttagtatggtggtcttttt

SEQ ID NO: 794 - DNA, 39428 bp, Human
atttcagtttaaaactttaggaaattagtaccagacttttatattggtcaacagcaaaatgaacattactactcagcctccaacacatgcagtttgcctataccagggatcctgtcaaaatatacaccacttatagcttcttaagtgcagttatcatagagcacagtccctgacatcacacagctgcagagatgaataaacaaagaggaacctactcagaagtgagtctggcccaggacccaaagaggcagcaaaggaaacttaagggcaataaaatctccatttcaggaaccaaacaggaaatattccaagtagaattaaaccttcaaaatgcttcttcggatcatcaagggaatgacaagacatatcactgcaaaggtaaaacattaaatagatcttcaatattattgttctaggatgtgcagttgaatgcagaaaggtggggaaagattagggaatattttgcacttgtgagaatcagaggtcaaagtcaggatctaatattctaatatgaaatctgaagcctgattttattcaggcattgttcaattgtaatttgtgattaacaactcatggagcattatatttactgataatgaaatggtatattctgagagaaagattactagagtagatgtagatttagaggacagagtttatcattatgttttcctgtgcacgtgagttctcttgtacgtaaaccttctcatcaactctctatctcccctctctcagtgcctctttctctccctgcaggtttactgccacctccagagaagctcactgctgaggtcctaggaatcatttgcattgtcctgatggccactgtgttaaaaacaatagttcttattccttgtaagcatattcttgaaagattataagggaacttttcactataatgattggaagcgccttgaaacatttcataataatgaggattagaattctctgtttaatgtatatctctgaaccccaagataatatgctgcttctgaacttttcaaatttataaataacagaataattgtagaaaacatttatttttttgtgtgtactaaatatatatgtatatatgatacacacacacagagatgtattctgatttcatgactcaaagacatgttttaagagaaaaaatatttagaaaaacaaattaatttttgaaagtggttagatcaaatactataagagatggtgaagttttatgctaatggctttaaaaatatttgttttaaagatctcattatttttatagaaaagtcatttttatttcagattgttccaatttaaaataattttaaattttgtatttcaaagtaagcaactgaatttattataatttgtctagatattaattttgtaagaatcactttaatttttctaggtattggagtactggagcagaacagtttttccctgaatagaagaatgcagaaaggtacattatgattgtcaatgttctgatgttagtacagtttatattttgtctctaaagggatgcaaaatgataataaaatgttttgggaaaataaactataacattgagccataaatgtttataaaataaagattatatgagggcatgtccttttctccaataataagtagaaatgctcagttaaaatcattataccctcttgttgcatttaattaactgaaatttcctactactataagatgataagagataaataattttactatacttaaaaagcagttttgttcagtgatgtttaagatgtgtagggtggatttttgttggcgggcttgttttgtatgggaacacaattaagggatgagaggtggaccttttattgtgcatgtgcgtatgagtgactcgttattttaaaatatatatttaacaacttatgaggatgcagatattgtgtacctgtatgtttatagctttgcaaatatataaaataattttcatttgtaaacatattgttttgcatagtaattcatatttttatttagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatggtaagacgtaaatgtttcaacactttactaaaagcttatttctgtcaatatcatatttgtagaaatcatccatatgtttatacatatatttacttcatatatttttaagtctgtgtagtattcaactgacttcataatatttttatattcatatactgttaatgcacatttggttatttccagttttgcttttcatggaaacccatgcttctataaatgtttttatcacaaaataaatataaagaaaactaagcatgtcatggtcatgcatattgatcacaaagtgaatggattcatgatacagggcagatcatgaaatagaagtttccagccccagcagtcctgctcctgtgtatgccttcctcacttttcctgcctcctctccaaacctttgtattgatgtttaatgtgataaataagctttgcctgttccagaatttatgtcaagggaatcatacaatgtgtattttcatgtgtgtcttcttttactcctatatgatatttgtgcaataatgcagttagctgttgtttgttgcttttcattgctgcatgatgtgcatagaacatttacaatctgttcagtcctgtgtctctggatggggaagtgagtctcgtgccctcaggaacaaagaggaacctggatgggcacgtgtagtcatgcggttcctttgctgatccctctcaccgcacctaccctgatgtcttttggtttgggaggagaagcacttcctctagctcctaactggtagcaggcctcctggtaggtcatccttgccagtggtaccaggcttgcctaatgttgctggcaggactccctttcaatacagagtgggaatgggcttagctgacccacctcctgttaccagatttggttctgagaaacagaggactagatcactttcttctgctgagtgggggactgaagatgcccggacactctgttgatccctgattctggggtcccaaactattttgccttcctctttccacctttcagagttttcctgtgtgtctttcattacttgcagagtttagagttgtatttattagggagtagcagagaaaaaggagtccatgtacctggtcaagaccattgttattccaccaaaaccaaatcagataaaagtgagggcttatctagttagagagtggtgtggtgcccagaaaagccaatttttggctgctgtgtcatttatttcctcaatggcaacctttcaatttccttctaaacttcaaggaggaaaagttccactatgagacacatagtggaaaaatacatttatttaatcagaatatctggagaaatacatgcacagtatcaggaaatttatttcagttcttactgtgtctgtcttaccaacacaagcaactgttaaattacatgaatcacaattttgcttgttaaaataagaagaatgaatgtactaagtataaaaattgaagagttcattttaagtcaaaattacaaaaatttgtaatagctttttacactataaaagttgttttcaagtttactattttgtttaaggtatttattttgttttgaaaattaagcatcctttgaaagaatgtattacctgcacttttaaaaattaataaaagtttagaattcaaagaaagcacctaaaaattagtaaaatcttttatagttattatttaaatgaaaattttttatttttcgttagaaatttctgggctccctgtcagttctctcatgggttggcatctctcgtagtagcagtgatcatccatgggtgtcaataaatggctcaacgttcaaattgaagtaagttttttgaatgatgctatatagtagaagaatataaaaggacaggttcagaataacattatgaataaatttaagtgcaattatagccataaataaagatgttgaaagttagtgaaatgttgatataaatgttaaggaatgatccacaattacattttctgtggttttagttacccaggctcaaccacggccaaaaatattaaaaggaaaactctaggaagagaaaatccatgagttttaaattgttcactcttctgagtagtgtgatcaaatcctttatatagtgtatggctccatctcacctgggacatgaatcattgcttcgtccaggatacctgcacagcctaagttccctgtccattagtcactcagctgtcgcagttatgagattgactaaggtggtatggtaccgcttgtgttcaagtcactcttagtttacttaataagggccccaaaatgcaagagtatttatgctggcatattgttataattgttctttttcattattattagtttgttttaatctcttaccgtgcctaatttataaattaaacttcatcaaaggtatgtatgtatagataaaacacagtatatatacagttcagtactatctatgatttcagacatccactgggggtcttagaacatatccactgtgcagatgaaaggactacttcattcagttttcatattatgatatgcagttttcccagcattatttttgaagagactatcttttttttccaatgtatgttcctggcacctttgtcaaaagtgagttgtctgtaaacaaatggatttgtttctggattcattggtctgtatgtctgttttaatatgagcaccatgctgttttggtttctgtagctttgtagtatattcaggtaatgtgatgcctccagctttgatattttgctcagaattgctttggctatactggatgttttgtggttccatataaatttgaggattgcttttgctatttctgtgaagaatgtcactggcattttgatacagattgcattgaatctggactagctaaggttttattttgaatgttgaatagaaggcacagaaaggttatatgtatatcatatgtatcagttcctattttaggtaaaaagattgcaacatttcatccatatttacaaagtgtgttcgtttttattatacctttctcatattgaagcagctttatcatattcctgtttttctaatagattttgttatcaattgtaacatttttattattttggcatcagttggaatgatacatgttttctctgcataatcttaataagtaaactatttcaattctctcaaatgttaaaccagtctgaaataaaaccatactggtcattctgtattgcctgtttaaatttattaatgcacaggagattatactgtgtttttatttatagctatgtacatgaaagccttttctcttaagggtatattgggaagcatttctctttttctataacctagaagactttgtgtaagggtactgttttaaaatgtaattattcattagtgatgccatctgagtgtgtagaatgtttttgtaggaaagtttatgtaggaaagtcaatttctttagcacatacagacatttcatccatatttacaaagtttatatttatagaggttactcagatttctgtttgttgtattgcaatttggtaatttgcatattcaagaattttctatctcatatagatataaaagtattcataatatggtttcattatctgtttaatatctgtaaaaaccataatggttttcccttatttaatctagaaaattatttgagccttctcaaattctttaagtcttttatcaattttattaagtcctttcaatgaaaatatcttcagcctcattgatcttctctactgtaattttgctctttgtcatgattttttactatttattgttttcttcctaccactttacttctatttaatttcagttaatttcatatttctgtttttattcagacaattcagtatctgcaattttgttgcaatatatgaatttaaggcaatccatttttcccaagaaaatattttgctctattttccttttaattgatgtaaaaattgtgaacatttattgtgataatttatttggcccttaggttatttagaattatattactgaatataaaaccatataaagttcctaaagttttgattattgacttctgtgttagtaaactgtagttagaacattttctgtgaggctagaaatgttcttcatctctgtgtaaatatagctagtgtgactaataaacttatgtttaatgttatttacttctaattaattaatattaaacttgaattggtgcattttaactgtccactggccaactttggctaatgctactgtacttatagcaaacttctaaattttatattaaaatgcataggtttatgaaaatacagtgtagcttaaaaatattagtattccgaattagtatacagtttatatgtgtgtgtatacacaggtgtgttggctaattgtctagtttaaatctctgtatagagtcagtgatgtatctgtttgtgtgatgagatgtgaaagagaagtgactaaatccctaaatttattaattactcatttatttctttcaactttatattaaatgtgtattattaggtacatacaaattattttaaaattactaatggtatagataataaatatatcactatgaatatgcttcttcatttttaataacaacttctgttttatattattacagtatattaaagtggttttctaccagtttgtgttgcatggtatattttttccatttttcatcttcatattttttatgtttatgttaaaggagtatttttatgagtatctcataaagacagcaaactactatttttaaatacaagcactttgtaacaaatcaaaatcattccatatgtatttgttaaattttaaaataattatttatattttcaattgtatgtataaacgtgtaaatataatatgtttattgactgtaatattatattatttcatttcagttaaacacttccaattcttgacctctctttttcttaacttttatattaagctctggagtacctatgcaggtttgctatatagttaaactcgtgtcacgggtttgttgaacagactattttgtcatccaggtatgaatcctagtacccattaattacttttcctgatccctttcttcccccaccctctaccctcaggtaggccacagtgtctgttatttacctctatgtgcccatgtgttctcatcatttagctccacttataagtgagaacatgcagtatttggttttctgtttctgtgttaattggcttagaataatggccttccactgcatccatgttgctgcaaaggacataatcttgttctttttttatgactgcctagtatttcatggtgtgtatgtaccacattgtcttcgtccagcctatccttgatgggcatttagggagattccatgtctttgctattatgaagaatgctgtgatgaacacgcaagtgcatgtgtcttttgggggatatacccagtagtaagattggtggatcaaatggtagttctaagttcgctgagaaatctctggactgccttcctcagtggctggactaatttacattcataccttcagtgtgtaagtgttcccttttctccaaagccttgccaacatcagttgtctttgacattttagtaatagtccttctgactggtgttagatggaatctcatttcagctttgatttgcatttctctgataattatgtttcatatttttttcatgtgttttttggccgcttgtatgtcttcttttgagaattgtctgttatgtcttttgcctattttaatgggattatttattatttgattatttaattgttcctcatagattctggatattggacctttgtcaagtgcatagtttgcaaatatttttcccattctgtaggttgtctgtttataggagcttaaagtttcttttgctgtgcacaagttgagcttattttgtatgtggtatgaggtatagatcaaaatattttgtgtgtgcatattgatagccaagtgtttaaacatttgttaaaaagattatactttctccactgaatgcctttacatctttcttgaactattctacattccatatatttgtggatacatttttgcactttgtagtctatttgattaatctaggtatctatttatatactggttccacatcttgtgaaaattgagagaaagctacagagacttcccatggtcctcactcatgcactacttctcccatgatcaatatcccccatcagcatggtatatttgttacaattgaaacatcattattattgaaagaccatagcttatgttaagtttcactcagtgttttacactttatgggtctggccaaatatataatgataatgacatgtctttatcatcatagatcatacagaataattgcattgccctgaaaatcttctgtgctctgcccattcatcctttcctccttcaaacacatggcaagcatcgatttttgtactgtctccatagttgtttacttttccagaatgtcatatagttgaactcatacagtatgttacatctgagccattacatcttaaccatatcatatatctcaaccatttttaagtgaacaggtcagtagtgttaactatattcacattttacaacagatttctagaatttgttcattttgcaaaactgaaactctatacacattggacaactcccctttttgcccctagcaatcagcattctactttctgtttctatgagtttgaatactttagatatctcatataaataaagcaggcagcattttttttgtgtgactggcttatttaacttagcataatgtccttaagatttatccatgttgcagcatgcaacaagacttccttttttaaaataaagtatattatcctttttaaaaatgtttaaacaactttattgaagtatgattgacatacaaaaagctgtacatatttaatgcatacaacttgataagattagagataagtgtataaccatgaaaccaccacaataatctgtgtcataaacatatctgtaatctccagaagtttccttccaccttctttattattattttttgtgatacaaacacttaagatctacgctcttagccaaatctttagtatacaacattattaactacaggttctgtgtagtaaaacagatatctagaccttgttcatctcgtataactgaaagtttgtaccctttgactaatactctcctgtttttccctctcccagcccctgacaaccacccttctactccctgcttctatgaatttactattattttactcagcataatgtccttcaggtttatccatgttgttgcaataggtttttcttctttttaatggcagaattgtattccattttatacacatgccacattttctttatccaccaattcatcaatgggcttgtatgttgcttctatgttttaactgttgcaatgaacatgggagtgcagatacctgttcaagttcctgatctcaactcctttggctctacagaagtaagattgttggttcatatgtcaactcaattttaaattttttgaggaacctccataatgttttccatagtgactgtaccattttacattctcattaacagtgcacaagggcccaaatttcttcacaacctaagcaataattgttattttctgcttttttcatagcggccatgctaatgggtatgaagtgatatttaacagtggttttgatttatgtttttctgatgatagtaatgttgagcatcttttcatatgcttattggacatttgtatatcttctttggagaaatatctatttgaatcctttgtccatttttaaatagggttattagggtttttgtcattggattacataagttcttaatatattctggatattaatcccttattagatacatgattttgttgcttcaatcatttgctctgcagacatttttaagtctgatgtaatcccatttgcctattttttgcttttgttggctgtgatttgggtgttttatcaagaaatgattgctaaatccaatttcatgaagctttcctcacatgttttcttctagaagttttacagttttggatcttatcattaagtcttcaatacattatgagttaatatttgtagatggtgtaatgtaaggctttgatttcactcttttgcatatgtttagccagttttctcaacactatttctggaagatactgcccttttcccattgaatggtcttggcactcttattgaaaatcactagtccatatgtaccgacgtttatttctggatgtattaagttgttgtttctatggggagcaagtgctggggtatgctattcctctatcttgttgatgttgcctccttccaatctagaatagtattcagggcaaatgtgggttctctggaaggtaatgtggtcaaaatactcctgctggtgggggatacctcaaccattccctggcattcacacagactcaagtcatctcataatccgtcctacctgttcccttgattatctcagggtctttgtcttaaaatcctcttcaatcatttgattatgatgttttgagatggggatttctacatgctgattctattagtcattagtttgcttagcatcttggatgtatacatttttaaaaaagcaaatttgaaaagtttttaagtcagttttgtcttaatattatttttctacatctttctgtattctctttttctctgggatgaataatttctattaatatatcccaaagttgatgaattcttccttttgaatctcaattttttttctagccaatttagtgaatttttcgtttcaagtaatgtacttctcaactcagaatttggtttatttcttggttttcatttctctgacaaaatttcctacttgttttctcattgccatcatattttcatttaattaattgaacatacttttctgtataatttaagtacatttataatagttactttaaaatatattttctgataaatctaccatcttgtcccagaaaaagtcagattttattgactgattgtctttccctccaagtatggaagacattttccagtttctgcatgttttctaatttcttataatagacattttttataatatagtatcatacaaataaatttggggggtttataaagattttgggggggtaacttacataaaattttactgcagaatctttctcctttaaaatgcatttgctgatgtttttgtttcaaattctaattttttatttttattttttagccccatttcctagggattgcccttgtgaattgcatagcttggttgtcagccaatatattattttaaaaggtttattcgaaaaccttaagttagtagaggctccactctgtgctagcggtgtgtgtgtgtgtgtgtgtgtgtgtgtgtgtggtgaaggaagtgttcataaatttgcaatcagttctcaagtctccttgggcttttactttttactggaatcaccctggtctcctctacacatatgcatatttttttcaataatcaagaataaaatcctgtcatttatacaacatggatgaacctgctgagcatcatgttaagtgaaataaggcagatacagaaagacaaatatcacataatctcactcatgtagaaataaagcaaaaaagagctgatattatagaagcagagcgatcaccagaaaaacaccagaacagtggtcaacagagactggaggagagaaaaagagggggacagggtgagagcttggtcaatgggtacaaagttatagttaggtaggaggaataagttctgttctattgcatagtagggtgatgatggttaacagtaagatattgcatattacaaaatagctagaacagaggcttttgaacgttctcaccacaaagaaatgataaatacatgaggtagacagatacactaaataccctgatttgattatttaatgtaacatatatatgtattgaacatcaagttgtaccccataaatatgtacaattacaatgtgtcaatttaaaaaaaaatttaaagaatatgtagagggctaatgtcatgaggtctattgcactctcatgtttaggattttgttatatttatggctggcactgttcttgccccagaggagactacacctcagactaaaaaaaataaaaaacaacaaaaaatggggttttctcattcatttcctgcaaaattcagcactttcagttgaaaagcagtggtctgttacactatgccccaacctctgaccgctaatcaagtctgtccttgtggcaaaaaacactgttgattttcccccagctgtaaaaactgcaactgttactcactgtgctgggtgtggtgggtgggcagaaggcacgggagcagcactaggtaaacttactacaaatttgctgcactcttccttgaatctctagcagtttttccaagaataaatagttcacaaatgattattagcctttgatcaatttccagggcctcggaattgctttgttaatttgtcctcttcattcagtcacagcaatacatttgtatgtgttcagtgcgtaacactcattatcttagtgaattgaaagactgaaaagtaacaagaattagctttgctattacaaaatttaaattagtataatagtattgattttgcatctcataaaatttgttttcttatacaaattctcaaactctgccagtaattttttatggattgcagtctcccgcaaaaccaataatcatttgcaggtgtggccaaatggcccagctttctattgcaaacactaatcttcttgagaacgtctatattttatacctagaaggaataacattacaaagaaaagagcaatatgtgaacaattgtataaatatttgtttccatagacaaattatatagaaaatattcagatttagatacgtaactattaaataagtcatctattcataaaaaaattgttatatattaccagtattagcaatacatttccaatatcttcagagaggaacaagaactgtgcacatctgaatttttacaaagacaaacttcttttgaattttgttcggaaataaaaacatgcttgtaaacaccagcttataaacatgcttataaacacttaagtgttatagcttacacaaacttaatataacattactcccaccatctgtaaagaacatacttctagttgcttcaaaagccatacaattaggttcttcgaactatttttaaatctttacattattttaaaaatacatatccaggtacatactctttctttctttgagacagaggctcgctctgtcacccgtgcagtggcagtctcggctcactgagatctcagccttccaggctcaagcaattcttcggcctccacctccgaagtagctgggactacaggcactcaccaccatgcctggctaatttttcgtagagatggggtttcgccatgttggctacgctggtctcaaactccttaccgcaagcaatctgtccacctcggcctcccaaactgctgagattacaggcgtgagggattgtaggcgtgagggattacaggcatgagccaccgcgccctgctatgttacttatttcttaaacacctgcaattcattaaaatacaccatgtataaattataaatcataatattatcaagaactgttatttctaagtgctgaataaaatgaatatttccacgatgaattaatttcttctagtctttgaaggtgtttaaaatgacaattcaacaattgtgggtggccctaggacagggcagttctaaaactagcaagttgaaattggcgaggatggatctcacgctgtgactggccaggaggaagagttttcattccagagtgctggagctagataccggaaggcatgtaacagggatccggacagctaacaaaaacttgctggagggtaaataccgcaggatgttatgcaaacatgcagctggtagccacagtcataggagcaaaaggagagaaagtatcataaaaccaggaagaaaaaccctttttcctccagactacacactgccttttagggacaaaatttatcatataagctggcaagggagaaattttatgggctctgctttcattatggtagagcaggatggtgaaggatagatttgaaactaagaggcaataaattggtaataaacacacaaggttactatgcagcaaccacaatgttgctatataacaataacagccatttagatacaccccacttcctcagagaaggaaaccaacattacattctaaatctgttctagtgtagcattgtcagtaattagttctcctttctggtagagattggtatttccactgagaaatagttttctttgttaatatcacagttccacgtaaaaacatcatttgcttctatggcatgtggcccttaaccatttgtgcctgttctagccccattaatatcaaattcattatcttctgagtaggtcacattgtctgctcaaagcatggaaaccctgccttgttaacctcttccttaaaacccctcaaaggctttttactgactacatggtactatcaaacaacatagcttagattataaatctttcttctcacttgaaggggtggcctgcccctccacacctgtgggtatttctagtcgggtgggacgagagactgagaaaagaaataagacagagacaaagtatagagaaacaacagtgggcccaggggactggcgctcagcataccaaggagctgcagtgggcactggtctctgagttccctcagtttttattgattattatcttcattctttcagcaaaaaggaatgtagtaggagggcagggtgataataaggaaaaaaacatgtgagcaatagaatctacgtcataattaagttcaagggaaggtactatgactggacgtgcacgtaagccagatttatgtttctctccacccaaacatctcagtggagtaaagaataacaaggcagcattgctgcaaacgtgtctcgcctcccaccatagggtggtttttcccccatctcagaattgaacaaatgtacaatcgggttttataccgacacattcagttcccaggggcaggcaggagacagtggccttcctccctttctacacagacacagtaacagtctgatctctctttcttttccctacatcactcacaccctttcttgtggttccaggttgccccaggctgttttcatctccagctcttcataacgccacttaataaaccaacaatactggactgcatatagcattttttattcattttaatgtctctcttctatgttttagagatttctgtctttggtattttgtatgttttaacaacattaccttgatttctaacgttttttttttaatctccagaaatcacccaatctaggacaccttctctaacaccattttctcacatttaatactggagacctattagaaaattgtcctttataatactatcatttaaaacacccagagtttgtgtctaccgttgtgaattacatactaatttaaaaccatctgcttctgtgtatgccttaaatagagtgtggacaactagatgataggaactgtgctttatactttattgaactttgtttattcatggccaaacaatatgcttgctccataatagataaaagctcaataaataaatatagaatgatattatgaaaatatcagtaatttcctatttacttatttttgttaagctttggtactattacttctatgtcaaattatgaagacaacattattacagtgcagaaaaacgccaggacctcttggctaagacctcaagaggaacattgtaagattttagtagtgatttttatattcgccaaaatataatgcaagcgttgtagacttttaaccacttgcattttttattcctttgcacacaaatgaagctactggggataaaggaaggagaaataagtcaactaaaatttgagcacctgctaataggtacgtaagagggaaaaaaacgtgacttgagacaccttgcttcactcatttctacaattaatgagccattttccttaggaagaaaaatgctgtcttatccctatatctgtgtctttaggcacttgtggtaagtaatgtcacaaatttaagacatcttcaaaattctagacttctttgatatttgaagcactgaagtaaacacaaaatccatttgaatccaagatgcagaagtcgttaaaggcatcgttccatctatgaatgtggagattatcactatagcaggaaatggaaggtttaatggcaatcaaataagcaatcagagaaaagtaaccaggatgctaataaaaaatatgatgtcatctgacctgcaaatcatgcatgtgacttacttgagagcaattgtttaaagttactatttatgtatggctatttatgcacaattataaagataataccagagtgggaaaaacacttttctgttccattataccatatagattgcaattaaacaatcaaaacaatggtgtgtcctagcatggattaagttaatataacacaaatatttgctaaagatatttcaattgaattgctaaattttagaattatacaaaatttcaactgagatggggcaaaaaaatcatttaatcattcctggcttaggaagctgtgccagagaaaattaattaattgccaagatgatgacctgtttttccccaaagtataaattccagatttatggaatctctgccttgagttcatataattacaatacaccagttaacattatatgtcagtatgtgtagcccagtacataatacctagctgaatggaaaataggttctgaaaatatatatatacatatttcttaaaatatgtttgcagacttttttacttttacattagtcatcatttcacttctgcttcaatatgcccatgcgtgtccagacgagactggatgcatcatggtggtgtggccatagatgcccctgcatatccaaagactcagctctatttcttccactcctttttattttctttattgtccatgtgaattttaaaaatttgtcctttttgacatgtcttttgtcaattcaaacacatttaccaaaaggtcaagattacaaaatttttgcttggcaatagctgcacatacttaagctttcatatttgggcaagcgtccagtaaacgcctctgaccacatccagctttagtgtcacagcttgaagccagcaacctgccaagcactctgtttctaaccacaagttggctgcgtgttaagtctttcctgtgtaccagaagagaagggttttctgaggccacagtgcgagttagcttactgaccaaaaaggccggttgattgttggctcttctcaactaatgaaagtaattaaatagtttattgtggtgatggatgttctcaaatgacttgagcccaggctgtttgcaaaatattgtaatttttcttctaacaatagtttttgaaagttatatagatacgtctatatgaagtttgttcaggtacttttatagtcaaattattctttctgcagaagttaattgcgttggttttatttcacttattagaaagtattttatctgaaaactatgctatgtccttttgcaattcacatagaataaaccagtacaaatgcccagcaaatccccaataagtttactatcatgactacagcaaagtgagtgtatgttcaacattgagaaagaaattggagttttaacatactatttctttatctaactaattgttttaacccgacatacaggacccattttagaattttcttctttaagaatcctttccacactctgtcagttggtttagggacctttatatatgacaataaaactctccctggtgcttagctttatcatggtatttatttcagaaatcttcttttaggtatgtgtggggacttcccagttggctgtaagttgccatttgaactaaacgaaataggtaggatattcaaatgttcttttttatcctattcctatcccccttttctcaattctgtatttaagagacaatctctattcaatcgaaaactacatatataaaaataactcttcaggaaattgtgattcaggtttttcccataaaaagcctgcatttactcatttattcatttcctttcaaaaaccaaatatttgttaaaatgtagttgttagaaaatatcagcctatatttcctctatatagatctatttttactatataaaatagctaatagaaaatgttgattagctgaaaagaatcttggtatgtcagaaaataacatattttcttcaacttgttttatattcacctatcttgtttaattttgaatttgttttatacttattcattttatatcacctaaactaaaaagtaatttccagctgggtgtggtggctcacgtctgtaatctcagcacattgggaggctgaggcaggaggatcacctgaggtcaggagttcgagaccagcctgactaacatggtgaaacctcgtctctactagaaatacaaaaattagccaggtgtggcggcacatgcctgtaatcccagttattctggaggctgagacaggagaattgcttgaacccaggtggcggaggttgcagtgagccgagatcgccccgttgcactccagcctggacgacaagagtgaaactccatctcttaaaaaaaaaaaaaaaaaagtaattaatttccatgtgggcaaaaactttcttttggattgtttactttgacattctcaagatctagaaaagtgcatagcaaatagcattcgctaaagaaaaaaaatgttgaataaatttattgtccaactttaacacatcaccacatgaaagctgttttccttccttatatttcagagttttaagattaatagctttggtttttgttaaaatgttataatgtgttcatcttatattactttatatgatgtcttatgttagtattttaaattaataaacataaaatatatatttagcttatcttgttcattggtatcaattcatatattattcttatgtatactggggtatatatttaagtttctaattcttctgcatatgatgtagatatgacagagatgcaatttcatgttttttatattaaaatttaaaaattcccaggactaattttttgtaacttaaaggccagtgtgatagtaacccaggacaaattattgaataggagctaatttcccactttatctgcaatgttaccttatattttttaatctatgcacatgactttttcttgtctgtatttttacccttctcaatttgtctatctatgccccacatgccactttgcctttattaatacggttttaacataggtcttactatctagtaaaacaaggctcccacattttcttcatcttcaattgtgactttcctagtcttgacttttgtaatttaatgtacatgtagaattctgctttgtaagttctacaacaaaacctgaggtattaactggaattgaattgaatctctaaaatatttaggattaaatggcatcatttaaattcatcattttcaaatcctaaaatgttatttaaaataatggcaaaactacaattacttttgcaccaacctaacatttatccaacaatgggtggtcttaactcttttaccaaattaacaatatttttgtagtgataaggcggaagtactgtggtttatgtttttccacaggaagatgagattataatatttgtcacatctttctcaaagatagaaattcactaagtatctccactttcaattctagatcaggaactgaggacatatctaaattttctagttttatagaaggcttttatccacaagaatcaagatcttccctctctgagcaggtgtgtgtatgtgtgtatgtgtgtgtgtttattattcaagatatgagaaattatatttcaacctcaaaaaaataaaaatatttacactataaggtaattctaattgtttcttagatgcttgaatagaactcctgaggatacggaatgcttatcatttctgatgtatattctatcactgtatctgatgataggtaattaggatatacttattgaagaatcagaagttgtaatattactataagaagaagccttgtctctaagcaaaactagaaaaatgaatctttacatttaggatgagaagaattgagattcaatttaaattgtcaaatttttgagttttctgatgctgtagggggcacttacctttgatacacatctttacatgcaaggtgaaacaagttatatctgtgctttccaactatcataatcaaatatgaaatagcttttatttttgaaatctaagcactatgcttatttattaaatggttttttctggaagctctgctgtgcattgctaagatgttactatataaacatgtgagattagttttgttaatgatgatggtgatgataatttgttgatgatgatgatatgggcacgttggattaaaatgcactagaaaaggacattcaacaaaagtgcatataacttacctgagtttagcttgcagaaagaaaactaaattattgccagataaaataaacaactagaaacacttgatcttagctaaaaggccaagaagcaataaacgactataaacagaaaactgggtgtgttgttatctaatatcagtaacgtaaaatattggtattaaatatctcaatgtaggtgaattaataggttcattatattgttatgacattttgaagtaattggcgattattttacaaccaagagaaatgtataaaattaattttgcctggctttatgtgaattgtcatttctattcttttcttaaaggcatgcacaggggaaaagtttctgcattttacttttctattcaaaatattttatctcaccacgggaaagagaacaaaaaacaaatgcccagttttattttattcaggaatcctttgtgcattgaagactttagattcctctctgcggtagacgtgcacttataagtatttgatggggtggattcgtggtcggaggtctcgacacagctggggtatgtttttaccacataagtgtgtagttttgtttttatacaattttaagataccaagaatttcatacaagcatataaggcataggcaagcaatttactctgattcttttcatgttctatttatgttgatttcatgttatgttcatattgtattttaaatcaagtcttccaaaacttaaaaacttttttccctttattttattaactatattatggtaaagtcgctcacaacttgggacagcttgaaatagtgaaatagatgtggagtcagacttgaattttactcaaacttttaccgctctctagatttgaagggtcaatttgcaacctctgtgtagtttagtttagtttctttttctatcaaatacaggcatgaaacattccatatttatcttagatttgtgtaatattcaaatcaactgacatgtatgttaaagcactttttatcctaaaggtgtttataaatttataacttattcacagttggtaacattatattaaataagctttatgattttggccatctctagcattcaatttcttcatccataaagtgatacctactctctttactccatatgtaaaataactgagttaggtattacatgcgcaatcaatgtctaattttacctataaaatataattcatattatcatttaatttataaaaggcttttgtacaacaaacccccgtgacatgaatttacatatgtaacaaaccttcgcatgcacccctgaaccaaaaataaaagtttaaaaaaggcttttaagtaaatattaatcatcagtaaataattaatatttcaagagagcaaaatgattctttaggtattttgttcagaggcaagattatctgtctttgttctaaatcattagaccccactattttagcctatgtatgtccttcattataaagaaaattagatggctgggcacagtggctcatgcctataatcccagaaatttgggaggctgaggtgggtagatcacctgtggtcaggagttcgagaccagcctggccaatatggtgaaaccccgtctgtactaaaaatacaaaaattagccaggtatggtggcacaagcctgtaatcccagctactcaagaggctgaggcaggagaaccgcttgaacccaggaggcggcggttgcagtgagccaatatcacgccattgcactccatctcaaaaaaaaaaaaagaaaagaagaaaattagacacactgctatttactaaaagcttactaaatgattgatgttattgatgctaagttcattatatttttattttatttttaaaatacccatactggattgtgacagtatccttttcttttttatttctttcgtcttttgcaaattaggaaaactgggatgcaaaagctaggttatttgtgaagttatcaagtttgtatatgtggatctgtgatttaaatacatgtctttctccctacatctgccttttcactaaccaagtccctttctggtaatgttaggtttcattatacattacgaattaactaattttaatagtatataggattttgctaagggtactttgcatggcataaatatagttttatttatatagtaaagtgtaaacataataatgtagtactataaaacaaaagtaagttcatgttgtactttaaaaaggatagtcaggggaagtacatagatggaaatggcaagctgaatttttaaaatttatgccccaaatggcagaaaggccatgactcatataagcctgaattctttttctctagagatgagtgaatttcataattataacttggatctgaagaagagtgatttttcaacacgatggcaaaagcaaagatgtccagtagtcaaaagcaaatgtagagaaaatggtaagtcctatgttccatttgtctactctcagtatattgaaatgaatcttggaaactatgtgattaaatgaatggcaatcattcagttgactttatcttcatgaggaaagcaggaataacatgaactctcatataatattaaaatatataataaaattatggtattaaaagctattgagtttagaatattgtcacgccctaaaaaatgatgagtttattatcatgataatataatcgaggcaggagtttctaagagatcactgaaaagaaaactaaatagaaatgaaaaagagaagagaaaagatattttaaaaaccctccagagatatgttcctaaacattatagaagtggtagcttgattattatttatagaattgtttctgagttcagtgaagaagatatattctccaatgacttttttcaaagcagaatattattggtaatagacctttatatagtttgtatgaaaaggaaaacaacagatgaccctcacttatcaatttttattaaaaactaagaaacaaattattaacaaatagcatctctttacaagaattaatttaaggaatgcaaagtgctatatgtaaaaatccctttttggactaaaatattcaattgttaccaaaatttaaaacacacatgccctttccctcaacaattatcattgtgggaatttatcccagagagagactcaaaaatatgcacagatgggtatgaaatgtatcattatttctcatagcaagacctaagaaacaatttaaatatccactggaaaaaaaaattgacagtccgtcaaaaattagatctgtccagagttgtcagtgaaatacaatgcagctatttataaatttggtatccttatacgccatgaggactaatcaccaggatattgtcttaggtaaaaaaaaaaaaaaattcataggatattttgtgtattatagtttctttaaaatgtatttttaatatgtagttaaggggaacggtaatttttgtttatttttagttggcatgtaataattatacatatttatgggatacagtgatatttccattcaactatacaatgtctaatgaccaaatcaaggtaattagcacacccatcacctcaacatttatcacttctttgtgttgggaacattcaaaaccttctcttctagctatctgaaaatatacaataaattactcttaacagtactctccctacagtgctatagaacactagaaaaatcccgcatgtagctgtaattttgtattcattaaccaacctctcccaatcttctcctcccccctattctttctagccttaaataaccacaattctactctctacttctgtgagctaaaagtttgtatctcctacatatgagtgagaacatgtggtatttatctttccatgcctgatttactctacgtaacattatgtacttctgactcatccatgttggtgcaaataataggatttcattcttttcattcttttttttatgactgaatggtattcctctgtgtgtgtgtgtgtgtgtgtgtgtgtgtgtctgtgtgtgcttagctatttatctgttaatggacacaggttaattccatatcttggctattgtgaataatgctgcaataaacatgggtgtgcagacgttacttcaatatactgatttcctttccattggagaaagacccagattgctgagtcatatggtagttatatttttagttttttaagggacatccatactgtttccataatggctatactaatttacattcccaccaaaattgtataaacattagcctttccctgcatcctcactgtcatttgttattttttgtctttttaaataatagctattctaactagggtgagatgatattcattgtggttttgattttcatcttcttgatgatgaatgatgttgaatttcaaaaaatatatccgtggctatttgtatatcttctcagaaatatctattcagatcctttgctcattttcaaatcagtttttgttgttgctgttgagttgtttgaattccttgtatattctggatattggtctcttgttagaggaatagtttgcgagtattttctcttattctacaagttgtctcttcactctgtcaattgtttcctatgcagtagagaagtgtgttagtttgatacaatctcatttgtttctttttgcttttgttgcctgtacttttgaattcttacccataaaatctttgcctagactaatgtcctgtggtgtttctcttatctcttctagtagtgttatagattcagttcttatatttaagtcattaatccattttgagttgatttttgtatatggtgtgagatgagggtctaatttcattcctctatgtggatatccagttttttcagcttcatttattgaagaggctctcctttcccagtgtatgttattggtgactttctggaaaaatcagttggctataatacatggatttattcctgggttgtctattctgttttattggtctaggtgtctatttttatatcaatgccatactgttttggttgttgtagttttgtcgtatatattgaagtcaggtaacgtgatgccaccagttttcttcatttttgttcaaaattgctttggctattcagccttttgtggtaccatataaattttaagatatttttctatttctgtagagaatgttactggtatcgtgttaggaattgcactgaatctgtagattgctttgagtcatatgattactttaacaatattctttctgtctatgaacatgagatgtctttccatttttttgcatcctctttggtttcattcatcagtattttacagttttcattgtagaggtctttcacttgtgtgattaaatttattccagggtattttattatttgtaggtattacaaatggaattgacttcttgatttctttttcatccagtttgttattggtgtatagaaacactactgatttttgtatgcagatttttgatcctgaaactttactgaatttgtttatttgttcaaaggcatgttgtttaattttcatgtatctgtgcagtttccaaagttcctcgttatcaatttctagttttattccattgttgtcagaaaatttacttgatataatattgacttttggaaatgttttgagacttatcacctagcatatggtctgtcctgatgaatgttccatgtgctgataagaagaatgtgtattttgcagcagttggatgaaatgttctgtacatttagttaggttcgttaggtctatattatagttttactctgatgtttcttttatgattttctgcctgaatgatctgtccattgcttaaaatgtgttgttgaattcccctgcccttattgtattcatctatttctcccttcagatctattaatatttacttaatatatctgagtgctgtaatattgggtgcatatgtatacttataaatactatattatattgctgaagtgacccatttgtcattatataatggtcttctttgactcttttttactctttttgacttaaagtctattttatctaagtatagctgtgcctgctctttactggttttcattttcatggaatatctgttttcatccctatacagtcagtctatgtgtgtttttatgagcaaagtgggtttcttgtaggcaatatattgtttggttttttttgtttttaatccattcagtcactctatgtcttttacttggagaatttagcccccttgcatttaatattattattggtatgtaagaacttactattgccattttgttccttgttttctagtggttttgtaagtcttcctttcttcctgtcttcctttgtgattaagttgctttctctggcagtgtattttaattccttgattttcattttagtgtatctattataggtttttgttttgtggttactgtgagacttacaaggacatcttatagcttatagcaattattttatactgatgacagcttaactttgatcacaaagcaaagaaaaacaaaacaacaaaagaaaaaactaaacaactctacactttaactccatctcctctcacatgttgacttatgtttgtatggatttacatcattttatattgactatctcttaataaattgtaattactattattttgatagagttgtcttttggtcttcataagatctgagtggttgaggcaccacaattacagtattagaatattctgaatttgtctgtgtacttacttttatcagtgagttttatacattcaaatgttttcttattgcacatttgtgttcttttttttctgactgaaaaaactctctttagcatatcatgtaagacaggtctggtggtaataaattcactcaacttctgtttgcctgagaaatactttttctctccatcatgtcgatagttttgctgggtacggtatctcagttggcattttgttttccttgggtctttgaatatgtcaccccacttcctcttggcctataaagtttctgctaagaagtctgctaacagatgtgttgaagcttctttatatttattttgctttttaaattttgcttcctttaaaattctcactttgtctggagctttgaacatttaaattttatatgtcttgtggtaatctcatttgggttgaatctgcttgctaatctttgaccttccggtatttggttattcatatctttctctgggtttggaaagttttctgtttgtccacagcctcccagaccagtgctgtgccagggcttgcccaagggccatggttgctatggcctgcaaccactgaaattttcttgggaccaaggccactttagtcagctggtgataaagtgggctgagactaaggttcttcctgcctaagcagtggattcacctctggcccacggtgggtcaaaatgctccccatatgagcactggtttggaatcaagggccatggggtctctgtcttttgctgtgttccaatgtggtggggccaggtctaagttccgacacaaagtcccacactcttatttccatttcccaagcaggcagtttttctctaagcactgcactatctgggtttggaagagaggcgtttaggcaaggcaagaccatcttttcttacctctttaatgtgttttttctcgttatcatgctaaaatcagggtactgtgatagcgcacctaatttcttgaattcttttgaaggtattttcttgcatggataattatttaatttgatgtttctgtgagaagataatcactaaagggttcttcacagccagcttgctcttctgccattttcttaattgttttctgatatacctgttgttttgcctacccattgatttttttctcctctatcattatttatctttgtggtttggtggttctctgtagccataatgtttgattcctttctctttcttatttgtgcatctgctctaccaaccagttttatacttttgtgtatttttatgatgatagatattgtccttttgcttccagatataggactcccttaagcatctcttgtggggctagtctagtggtgatgaattccctcagtttttgcttgtctggaagagtatttctcctttatttctaaaggatagtttcgcttaatacagtattcttgtttgggaggaggtattttttttttttggcattttgaatatatcatcccatgcttttctggcctgctgctggagaaggtgggattgctggcagtggtggcactgggctccaagtgagtggctctgggaatctgggggggcgcatgcatgactctctctatgctgaggacagactctgtgcttggctgcatctcctgttccctgggcatagggctctgtataggcttgatgcaagggtcatgactacacctttggttgggatcacctggtgtggctatgctacagtcctctaggtggatttggtggaatgtcagcagggccccagggatgtgaagatgcataagctattgggccccaaacatgcgaagataaaggaactattaggccccagggcagagcgtactttggtggtggctacactctcaaaatggtgcagtgctgctgcagcctgtgttccagagaagaggagggacccctgtgtgaattcccactctggaataatgcagttatgtggatgtcagtgaactccctatactggactcagggatcgtgaggaatgtggagctctcctatacctaggatagcaggtatttataatgggaatgtggactgctggggagctcctgtttaccttttctcctcagtggagagtccctcttggctccaagctgatccgtgtcacctgcttctcttccctttctatgctatcgccctgagcatctgtgcctcagagagacttggtcactttcttgctgaattccagccttctcccttcagcactctattcaatgtgtggttatctacttgttgttttggtcctttgtggaagtgagtgctgggtgcctgtagttagccatcttgatgatgcttcctccttctttatgtttattattgtatctgcataaaaataataaatcgcggccgggtgcggtggctcacgcctgtaatcccagcactttgggaggccgaggcgggcggatcacgaggtcaggagatcgagaccgtcctggctaacacggtgaaaccctatctctactaaaaatacagaacattagctgggagtggtggcgggcacctgtagtcccagctactcgggagggtgaggcaggagaatggcgtgaacccaggaggtggagcttgcagtgagccgagatcgcgccactgcactccagcctgggcgacagagcgagactccgtctcaaaaaaaaaaaaaaaaaaaaaaaacaataacaacaaaaaatcataagcataatttactctagggatgactggggaacttgtagagaagtatagaaggaaatattacattgttgtactctagtttttgatcatttgcgaggtatttatgttctgttctggaaaaaattattaaggcagaaaaaggatcaataccaccttctcatttaaaaaactctaatatttatattaaatacaaagatacccaaaccttttatgcttctttctctgatctgtgtcttttttctttgacagcatctccattttttttctgctgcttcatcgctgtagccatgggaatccgtttcattattatggtaacaatatggagtgctgtattcctaaactgtaagtgacaacagagaagtagattgcaacattgtcaatttaacaatgctaatgtattatttttgttagtattcataaacacagacacataaactagaaatattaaatgtatctttgtcacatttttgctattagtccagaaatttgtaaactatatttgcttatactataagttactaacaatacacacttttaatacttatggttattttaatagcattattcaaccaagaagttcaaattcccttgaccggtaagtgaatttttaaaatattttagatcatatattatatgtatctacctacattattgtgtagacatgtattccatgattaaaaaaggaaaaagtaattaattctagtctgtaatacactatggcttctgttttccttttaacaatgaaggaatacttgtaaaaagtagaggctacttaggtttgacatcatctttctctctctctctctttttttttttttttttttttttgagatggggtctcactctgtcacccaggctggagtgcagtggggtgatctcagcacaatgcaaccttcgcctcccagtttcaagcaattctcatgcctcagcctcccaagtacctgggactgcaacctctacctcctaggttcaagcaattctcctgcctcagcttccaagtagctgggactgcaggcgtgagccaccacacccggctaatttttgtatttttagtagaggcagggtttcaccatgttggccaggctggtatcaaacttctaacctcaagtgagtcacctgccttggcctcccaaagtgctaggattacaggcatgagacaccacacccagcctggcttctctctatgaatatgtagagatatgcctttggttatgactgtaataatttaataatctgaaattttagagttggagtgaaaaaggcatttaatttgtctagacaaaatctgctataatggttcagatgtgtagaattaataatatattctccttttccagaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggttgagtatttattttaatttcccatcctgtatttaatcctaacatctgagacaactcactggaatatgaacctagaacatataagggacactgtgacttggttattctaataccaaccctaaatctttcttcattgaaaataacaaagcacagaaattgtaggtatcatgtatgtgtgctcggatgagaattatgccagttagtggacagaatgcatttttttacaagtgtgagaacagatgaaatggttatggtcttgcgtttactaaaattatcaacactgattttacttatagtttatttgtggtttcaaacaggatttacttaaactggtgaagtcatatcattggatgggactagtacacattccaacaaatggatcttggcagtgggaagatggctccattctctcacccaacctgtaagtctctgacccaatgagtctcttctttttaatttttttcctaagttttccctgtaataattctaatcactcatctcacataatcccaggacatttgcacattctaatagatttagtaaaaagtgcttaggccctaaatttgggagaaagttgtattagttgtagagcagccaacacaaatactagtaagtaatacaaattgtttactatatggtaagtactgtggaaggcaggtctaatatgttcgttttacagataaagagacagaaacagagaggttaaatattacatacatttctttttgaatttattaccagacatgttgagatataattaacatataataaattgcacatatataaagtatacaatttgataagtctcgagaactatatgagcccatgaaaacataaagaacatcaagatagttaacatataaattacctggaaaacattctctaagcatgcacctttgtgatttctcctctgtgtccctatgtccttacctctttctctttccagtcaatcagttttctgtcactgattagtttgcaattcatagaatttaatataaatgaagtcctacaatatatatcatttgcaatgtcttattttcacttagaaaagttatcttgagattcagccatctcattgcatgagtaaagagttaatttccttttatctcttcatttattgatgtatatttaggtaattcccagttattgatcattacaaataatgctacttgctaataatatttgtgtacaagtatttgtatcatattaacgaaatctttctttcccttaacataaacacctagaaacaaaatggctgaatcatataagtatatacttaactttttttaaagtgccacactgttatccaaagtggtgatgatattttacaaattttactttctacctagcagtatgtaagagaaaatctgacagagaagttgcttcacatcctagtcaacacttgttttgatcagcctcttaaattttatactggctgggtgcagtggtttatgcctataatcccagcactttgggaggccgaggcaggcagatcacttgaggtcatgagttcaagaccaacctggccaatgcagtgaaaccctgtctctactaaaaatacaaaaattagctggacggggtggcaggtgtctgtaatcccagctactcgggaggctgaggcaggggaatggcttgaacccgggagacggaggttgcagtgagccgagattgcgccgctgcactccagcctgagtgacagagcaagaccctgtctcataaataaataaataaataaataaataagtaaatttcagacacactaaatgatgtgttttggtatatgaatgtagttttaacttgcattttactaatgcaatgatgttaagtagcatttttttgtgtgtgcttatttgccatttaggtaaaaattttcttctcactgatttctgctttgatctttattatttactgtcttcttatagtaggttaaatttgcttttttagtttcttatattgaaagctgatatgttgatttgaaacctttttttctaataaaagttatactattaatatgtgagatgatttggcaacatcccgtcatattttgagatactattttttgtttccattcagttaaaaatagtttctaaattgtcttttgcattctttgattcattggttatttacatgtgtcatttagttttcaacatttgtgaatttttcagacatttttattattgatttctaatttaatttcattttcattagcgaattattttgtataatttaaaacttaaatttattgacatcagtgtttgttatggactagactatagtgtgtttttaaaaatgttttaggtgtatttgatcagaaatgtttattctgctgttttctatgtattctatgtgataacctttgaaatacaaagttttgtaatatggctggtagaaacaggcaaaatactagaccctatgttagcactaagtattgtttaccctaaatcttttcagacagttctttctccatcctggagtagttttttacatacatgcattagtaagtactctgctgaatattcaaaggtgaccttctgcatatctttacatttctttatttcttcaaatctcttatctccatttctgtgtcctgtgaactacagcttggtctttctggattctgaagtgtcccatgtctgtagtttttatagcctgctcttttacccacttgattgcacagagcaattcagcacacccagactaagtgacaacatcttaatgttcactgatcttatgaatatagttgtaattctccagattaatgctagagtattcaagaaaggtcatttctaccatttgaaagatctgacctgtcactacactgttgagtaatttcttcattcagctacaacgatcaggaatgaaacctaagcattttgtcactactgcttttccttttttcagtctcataatatcacaaatattgcagaagtcctctagattgtaaatattataattctttatttcaaggggactttagatatttgaatttccaattcttcaatgtaataaaaagtcacaacaatatcaatgttaaaattaggttaattaggtgcttcctgtctgtcagacacagatttaagcacttaaatgtatcctttcattaaatatacttaacaatcctgtatacaggtgttattttaacctaattctaatggtatacaacagaatcttaacatgttaaataactcacttaagttacaaaatgaataattgttgcaatgaggactcaaatatatatatttctggctctggagccagacttactattaaatgactaaaaaagtgctcttttcgctgatttttaaatttactttgctactttaatgattaattggcaatgatcaatgcacaaccttttactctcatgtgttattttcaattttccccttgtgtttattgtagcaagaactccctaccttccttccttattatctatttgtaatttggaagccccagtataccttagaattgatccaggatggcctcatttatgtatggcttgagagttttttttaacagaaaaaacattgattctctaaaaaataagagtttatatcatagtttctcaatattttcctatctacaaggacaaaattttttttcagaagcaaaacaactagcatactaactttctgtttatgcatgtagtaaatattggttgattactgcacaatttccaggaattatgcagagataactacagagatgagtagaataaaactcattttagagcttcaaactctagtcagagatgtagttacaaacaaataatccagtgtagttagttaggtactctggcagaagtgtaatgaaagtagtatgaaaaaacagagaaagaaatcgaaggaacacatggacaaagtgatattaaaaagaatgaggccgggtgcagtggctcacgcctgtgatcccagcactttgggaggacctgaggtcaggagttcaagtccagcttggccaacatggtgaaagctcatctttactaaaaatacaaaaattagccagatgtggtggcaagtgcctgtaaccccagctactcctgaggctgaggggcagcagaattgcttgaacccaggaggtggaggttgcagtgagccgagattgcgccactgcactccagcctggctgacaagagcaaaacactgtcaaaaaaaaaaaaaagagagagaggaaagaaagaaaaaaagaacgagactctaatgtagactgaacctagtaagagcagttattaaaaaatctcagctggggccgggtgcagtggctcacacctgtaatcccagcactttgggaggccgaggtgggtgtattgctttaggtcaggagtttataaccagcctggcaacgtagtgaaacaccatctctactaaaaataaaaaaattagccggatgtggtggcacatgcctgtaatcccagctacttacgaaactgacacaggagaatcacttgaacttgggaggcagagtttgcagtgagccgagattgaaccagtgcactccagccttggcagcggagcaagattctgtctaaaaacaaacaaacaacaaaacaaaaactctttaagaatagttttctccctacagtggccgattgttcagttacagaacagaggtcattacatcgtctttttaaatagggatagcatcagaccataatctttttatttttttgtcaattttacattgaagtgacatcctcactctttcttgagctttctatttcccatctcttatgaaagaaaacaaagtatcattattaatcatataactccaaaagattaaagatgccagagtaaaacacatatatagatatagaaatctccacatggaatgcctaaacatatgcacacacacacacacacacttatacacacttgtgaatgtgtgtatgtatgtattagatttgaaattttattttcatttccttaccaagtaaaattgcatatatctgaagaaaatgttttatttttccacaaaacacagtatcaaattctaaattgaacactgaatttatttctcacttaaatatttgttttaaaataaacattctaaagttttcatttaacttgggtatacatatgaagagattttagacttcagaattggctagtttctgatgtatgataaaaagagtggcgcattatttataatttttatttttattatctgagttggctatattttgtttatgaattaggaccaggcatggtccataatctcctaaaatggtattaagttcctgtatttgaagttcaataggtatgattcatttttattttcccgcgttaataaaatcatgtatgtaatttgtaattgtctctcctctagactaacaataattgaaatgcagaagggagactgtgcactctatgcctcgagctttaaaggctatatagaaaactgttcaactccaaatacatacatctgcatgcaaaggactgtgtaaagatgatcaaccatctcaataaaagccaggaacagagaagagattacaccagcggtaacactgccaaccgagactaaaggaaacaaacaaaaacaggacaaaatgaccaaagactgtcagatttcttagactccacaggaccaaaccatagaacaatttcactgcaaacatgcatgattctccaagacaaaagaagagagatcctaaaggcaattcagatatccccaaggctgcctctcccaccacaagcccagagtggatgggctgggggaggggtgctgttttaatttctaaaggtaggaccaacacccaggggatcagtgaaggaagagaaggccagcagatcactgagagtgcaaccccaccctccacaggaaattgcctcatgggcagggccacagcagagagacacagcatgggcagtgccttccctgcctgtgggggtcatgctgccacttttaatgggtcctccacccaacggggtcagggaggtggtgctgccccagtgggccatgattatcttaaaggcattattctccagccttaagtaagatcttaggacgtttcctttgctatgatttgtacttgcttgagtcccatgactgtttctcttcctctctttcttccttttggaatagtaatatccatcctatgtttgtcccactattgtattttggaagcacataacttgtttggtttcacaggttcacagttaagaaggaattttgcctctgaataaatagaatcttgagtctcatgcatatcttgtttgatgatatttagataagattttggactttagactttacaattgattccgtaaaaagctaagacttggggttattagaatggaattgtttgaaatgcttgttccccggtgtcataaaggaataggacttgaacataaatttaatttatttagtaaggccattttttacttcctgcagaaagggtacactcactagcagttctgccatgagagtacaccgaacaaaggagacagggtcatttataacctgacatgtccacactactgctgtgtccggtttccactggctggaacgggacctcacattctgtatttgtcccgattggctagcaacttagaactttttaaaagaggcaaaggtagaggagaacaaaggaaggaggaagtaacttgtggaatgctgagaaagataaaaacacttttaaataaggaagaggaacaggctatgacctaacgcttgcttggaccagtataagcatgccagggcaaatatttaggagcacaggtctttgaataaattttgcttctaagagaagttactgtttatttctaattagatggggaggaaagtctttgaagaggaacctctactttactttttacaatattccccctttttttatttcataattcctcctcagtcttgtttaatatgttttgacttaattctttgtccttctaagagaggtaattttttttcaatagggtggaggatagttaggagttaactctgtaagagcagcagagacaagtttttgcataaaaccttgaaggcagggcataatataacagtctacaagaataagtacaccaatagtaagggcaaacgaggtgagaattgaattgaagttaaatttttttttaatttatggttacctaccagaccaacatggatttaaattttgcagctatttgatttttgtgctttaaacttatttggcacttctcacggaccttaataacatttacgtaaacctgaggattaaaggactcaaggagtttcctttggcctgcggtgttttgtttttacctttttagattgacgaaatgccagcgtgaagcggatagccaattggattagagcacaagtactgctccagttatttggccgagtgtccagtaaaggtcttccacagtaccactatacatttgcttggggatggctaagcatggactgatgggcaagttcttggaaaggcttgggcttcttgtatccttttatgctttcaaggaacgccaaattttcctcctgccatgagaggcacaaagtaaacttggcatttagaggtggaagctggattgccctcggaggctgacccgcagggtgttgaatttcaggaaatagcagagagcgctcagtatgatggattatcccaagcagtgggattttgaaaaagaaccaccatacactccatatctggatgacaaggagaccatccaagtggaaaggagataatctgggcctctggcctaccgtgtgtacaagcgtaataatcgcttttatttaaagtgtgaatggattatttaatccatttcagccaggaatttgcatcttgatattttgtcttgatggctaaggtctgtcttagatatcttatttttacaatagacaccctagttttattagatgtaggagcaactggtgtgggatctagaactgaggctactgaagaagggggagatgggggaaaaatccatattttaaaaatacctagggggtcttttccatttatgtcaatccccataccacagaagcgactaagggcaggtctagagttagttaaggtggaggtggtgataaagagaaggacagggttacactgataaggctgacagtgagaaggggtagtccttttagtgaaatagatgaggggttttagatttgcacaaacctttttcgtggaagtccagctttgctcctgggtagtttaagggatgtggtcccatttactacaaggttgccagcctgtaggagcagaaaatcagcatctt

SEQ ID NO: 795 - DNA, 6374 bp, Human
gtgtatgatgagataaactgattcaaaatggccctagtgtgaaaacttcctgttcaaatccgaagtgatacattgatgaggaatctgctttttgcactcttgcctcactctgagctttcacagggcagtctgtgaagatcagagatatctgttttttgttttttgtttttttctgagacagagtctcgctctgtcgcccaggctggagtgcagtggctcccgatctcagctcactgcaagctacgcctcccgggttcaaccgttctcctgcctcagcctcccaagcagctacaggcgcccgccaccacacccggctaagtttttgtatttttagtagagacggggtttcaccggatcacagatgtcttttgtgtcgttaagaggtaacctgacctctccactaaggggcgtgtgactttctgatgacagaaggtatgtgttgctagtctcctgtttctctactagctcatctcctttagtagaaaattgtaaatattaaatgtgatgcaacaaggtaaagttaatacagaataaaatcaaagtagaactgtctgtacatgaataattcagggtgaaaagcaacccaaaatataatatatgtttgaggatttcttaaagtatttacattattgcctgtggagaattagtcaagcacatgcatacatcataataggtttgttaatcaatataatttagagtgaaaccgataaatatcacgacaatgaagaattaatttgaaattttataatcattatagatgtaataatactttatatttagcccagactttaaaaatgcatttttaatggatacatcaaattgtgaatgtcaaacataatttctcatacacatacttatatttaattgaagcagattttatttttttaagaatgtaataatgaagtagtttccataaaatgcaaatctaaacttaattataaataataggacgacctaaaaaaaattgagccaaacaaacattgcaaaaaagatgtactacactgacatgagactcctacctcattagttattttacacactcagtatgaattagaaataataaaatggcaattgtgttaaaaataattaaaatatctaatatgtattgaggactaatgtgtgccaggttgtatgttaagggttttatatacattatacttcataaattattttccccaatctagattagtaaactggtgttgtagacaccaagtaactttgtaaaggtcatgcattatgagtttcaaagctgtaattaattttaggtctcactggctacagagctcattgactagattattaaattatattttctgatttattacaattacttacacaaccaaagtgaccctcgctgccttttaaaacaaccacagggtctttctgaaagtttgaacttaaagtgttctttcatagatggtccaaacttatatttatcattttcagttttcctattttagtcattaaatcaattaccaatcaattctgtaaaataaagagttaaatctttttcagtagtatttagtttatgcataagttaatgtaatgttttacaaggtataaaatatttctttaaaattttaacaatttttctgttttcctcaatcattcagaataaaaaacatttgccaagacctcatgcccttttagtaaacgaatgtaagtcactaacttaatgtattttagtattaaaagttgttctatatgccaacaaattattcctccatctttagcgctcaatccttacattaatgaattttaaaattgtcatacaattagtgcattttattttcaaatttcaattttagttttttacacaggtattctattggtgataaaatatttctgtagaatctgattttaaattaatgaagatatttatattcagttacttcttagttttcacaaatgtattgttttttattgttcccattaataatattatgtcaaatatagaaggccttttaaaaagtgacctattgtttaaagagatttcagtttaaaactttaggaaattagtaccagacttttatattggtcaacagcaaaatgaacattactactcagcctccaacacatgcagtttgcctataccagggatcctgtcaaaatatacaccacttatagcttcttaagtgcagttatcatagagcacagtccctgacatcacacagctgcagagatgaataaacaaagaggaacctactcagaagtgagtctggcccaggacccaaagaggcagcaaaggaaacttaagggcaataaaatctccatttcaggaaccaaacaggaaatattccaagtagaattaaaccttcaaaatgcttcttcggatcatcaagggaatgacaagacatatcactgcaaaggtaaaacattaaatagatcttcaatattattgttctaggatgtgcagttgaatgcagaaaggtggggaaagattagggaatattttgcacttgtgagaatcagaggtcaaagtcaggatctaatattctaatatgaaatctgaagcctgattttattcaggcattgttcaattgtaatttgtgattaacaactcatggagcattatatttactgataatgaaatggtatattctgagagaaagattactagagtagatgtagatttagaggacagagtttatcattatgttttcctgtgcacgtgagttctcttgtacgtaaaccttctcatcaactctctatctcccctctctcagtgcctctttctctccctgcaggtttactgccacctccagagaagctcactgctgaggtcctaggaatcatttgcattgtcctgatggccactgtgttaaaaacaatagttcttattccttgtaagcatattcttgaaagattataagggaacttttcactataatgattggaagcgccttgaaacatttcataataatgaggattagaattctctgtttaatgtatatctctgaaccccaagataatatgctgcttctgaacttttcaaatttataaataacagaataattgtagaaaacatttatttttttgtgtgtactaaatatatatgtatatatgatacacacacacagagatgtattctgatttcatgactcaaagacatgttttaagagaaaaaatatttagaaaaacaaattaatttttgaaagtggttagatcaaatactataagagatggtgaagttttatgctaatggctttaaaaatatttgttttaaagatctcattatttttatagaaaagtcatttttatttcagattgttccaatttaaaataattttaaattttgtatttcaaagtaagcaactgaatttattataatttgtctagatattaattttgtaagaatcactttaatttttctaggtattggagtactggagcagaacagtttttccctgaatagaagaatgcagaaaggtacattatgattgtcaatgttctgatgttagtacagtttatattttgtctctaaagggatgcaaaatgataataaaatgttttgggaaaataaactataacattgagccataaatgtttataaaataaagattatatgagggcatgtccttttctccaataataagtagaaatgctcagttaaaatcattataccctcttgttgcatttaattaactgaaatttcctactactataagatgataagagataaataattttactatacttaaaaagcagttttgttcagtgatgtttaagatgtgtagggtggatttttgttggcgggcttgttttgtatgggaacacaattaagggatgagaggtggaccttttattgtgcatgtgcgtatgagtgactcgttattttaaaatatatatttaacaacttatgaggatgcagatattgtgtacctgtatgtttatagctttgcaaatatataaaataattttcatttgtaaacatattgttttgcatagtaattcatatttttatttagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatggtaagacgtaaatgtttcaacactttactaaaagcttatttctgtcaatatcatatttgtagaaatcatccatatgtttatacatatatttacttcatatatttttaagtctgtgtagtattcaactgacttcataatatttttatattcatatactgttaatgcacatttggttatttccagttttgcttttcatggaaacccatgcttctataaatgtttttatcacaaaataaatataaagaaaactaagcatgtcatggtcatgcatattgatcacaaagtgaatggattcatgatacagggcagatcatgaaatagaagtttccagccccagcagtcctgctcctgtgtatgccttcctcacttttcctgcctcctctccaaacctttgtattgatgtttaatgtgataaataagctttgcctgttccagaatttatgtcaagggaatcatacaatgtgtattttcatgtgtgtcttcttttactcctatatgatatttgtgcaataatgcagttagctgttgtttgttgcttttcattgctgcatgatgtgcatagaacatttacaatctgttcagtcctgtgtctctggatggggaagtgagtctcgtgccctcaggaacaaagaggaacctggatgggcacgtgtagtcatgcggttcctttgctgatccctctcaccgcacctaccctgatgtcttttggtttgggaggagaagcacttcctctagctcctaactggtagcaggcctcctggtaggtcatccttgccagtggtaccaggcttgcctaatgttgctggcaggactccctttcaatacagagtgggaatgggcttagctgacccacctcctgttaccagatttggttctgagaaacagaggactagatcactttcttctgctgagtgggggactgaagatgcccggacactctgttgatccctgattctggggtcccaaactattttgccttcctctttccacctttcagagttttcctgtgtgtctttcattacttgcagagtttagagttgtatttattagggagtagcagagaaaaaggagtccatgtacctggtcaagaccattgttattccaccaaaaccaaatcagataaaagtgagggcttatctagttagagagtggtgtggtgcccagaaaagccaatttttggctgctgtgtcatttatttcctcaatggcaacctttcaatttccttctaaacttcaaggaggaaaagttccactatgagacacatagtggaaaaatacatttatttaatcagaatatctggagaaatacatgcacagtatcaggaaatttatttcagttcttactgtgtctgtcttaccaacacaagcaactgttaaattacatgaatcacaattttgcttgttaaaataagaagaatgaatgtactaagtataaaaattgaagagttcattttaagtcaaaattacaaaaatttgtaatagctttttacactataaaagttgttttcaagtttactattttgtttaaggtatttattttgttttgaaaattaagcatcctttgaaagaatgtattacctgcacttttaaaaattaataaaagtttagaattcaaagaaagcacctaaaaattagtaaaatcttttatagttattatttaaatgaaaattttttatttttcgttagaaatttctgggctccctgtcagttctctcatgggttggcatctctcgtagtagcagtgatcatccatgggtgtcaataaatggctcaacgttcaaattgaagtaagttttttgaatgatgctatatagtagaagaatataaaaggacaggttcagaataacattatgaataaatttaagtgcaattatagccataaataaagatgttgaaagttagtgaaatgttgatataaatgttaaggaatgatccacaattacattttctgtggttttagttacccaggctcaaccacggccaaaaatattaaaaggaaaactctaggaagagaaaatccatgagttttaaattgttcactcttctgagtagtgtgatcaaatcctttatatagtgtatggctccatctcacctgggacatgaatcattgcttcgtccaggatacctgcacagcctaagttccctgtccattagtcactcagctgtcgcagttatgagattgactaaggtggtatggtaccgcttgtgttcaagtcactcttagtttacttaataagggccccaaaatgcaag

SEQ ID NO: 796 - DNA, 16780 bp, Human
  misc_feature (1)...(16780): n = A,T,C or G
aataaatgaatattcttatgaaaaaaatgaatttgcttcctactttgtattagccaccaaaatagttatatgcaaaaatatagatgaatttcacaaaaatttaagcaaaaagaaatacatacggtaataccctattcaaataaaattaaaacaaaattaaactatagtacaagaaaagtcaggattgcagttaatttgggcagaaaaaagtgtttgtaactggcagagggtataagaggagtttctagggagctgggaaagatttcatttctttgcctagagggtgagatggtggtagcataaaaagtagttggacacattcattcattcaacaaatagttattgagaaatcactatatatcaggcattgcactagatctgggtcatcaaaggggaataaatataggcctgatccctgccctggccctgcttacttctgatagcagacagacaaaaacaattaatgaacacagataaatatatacaatcacctcacagtcacctcgtagggtaagtgctctgagagatacccttgtcttgctacacaagggggactctttccttattgggggtggggatgaagaggaaagccattaggtctttcactggactgaatcataaaaatagctcagaattgcatttctcctttttctcaccccaaagaagtagtggttactccttttatctctaatggttccaatgtcattttagatctacacttaggtacacctaggaatcccatctgacatttagaaattccatctcttaatccgaggaaaatcttggcttgaaagtaatggcaccagccccttaaaatggcacctatgtgcgaataccactaatttttagttaattttagggctgttactctaaaacaaaaaagttcttttgaaattctaattcaaaaagcaatgagttttaaaataaccctttccatgttataaaatacttatatgctcattgtagaacatctgggaaatcagaaaactgtaaaaaaaatttttttaaaccctcaaaaatccataagtctatcaatagctatcaattctatctatagctactgtaaacgttgtggtacatctctttcaatatttaagtgccttgatatatttattttcacggttgagatcagaatttgtggttttgcaacccgaattttccatttaaaaatataataagaacttacttccccagtcattaatcttcctaaacataattcttaagtttgtaaaaaatccatcctacagatacacctaaaagtcagtttatttactttgtttccccaggaaagaatcctacatgaccatggtttctgggcctgtgtaagtgctgccttgtgaacagtgtagataagatcacagaatcatcctccaaataaagtacttaaagccaatgtaaaagtttttcgaaggcaaaggggcactgtgaatccagcattttccagtgttccctagacgtgaatcatctcaaagagaggccattattcgagtgcaacagggctccacgcctccagcgatgtcaaagttctgctaagcgtccaaaacctagcaaaaggttccaatgggccattggaactcggcggccgcggcggaggctgctcccaaggcggcagcaaatcacaccgggaccggctgcagagttcccagtcccgcggagcgctagctgccgggcggacgcggaagcccgagagtcctggtcttcccgtccaagtttaatccgcgcctacgcggtaaattcctggaggtgctcccagcctagcccgctgcgcccggctccgcgcctgggcaacccgggctccctcccgtccctggcgccctccgcacccgcctaaggcgcggcggtcgagccctggctgcgccctgtgggcgcgctcctccgaatcccaagttcgggtcgcgagtctgaacttgggaggaacgcgccccgggtccccgcccttcccggactgcccgatccccatcccccgcaaccgggagcgcgcaggcgcagccggccggcagtcccgtcagctgtcccagagcctgtgtcgcgcccgtgccggtagcgcccgtgccggtagcgccgctgccaccgctcaccatgggcccgggtcctcggctgctgctacctctcgtgctttgcgtggggctcggcgcacttgtgttttcttcgggggccgagggcttccgcaagcgaggcccctcggtgacggccaaggtgaccgagagcggcggggctgcaacttcccctgttgcgggcggggccctgggggcgctttggatactgggacctcggtgtcagggcgggcgaggtggaggcttcccgggcgcagggggactggaggcggccgcgggactgggtgggagggggctgctcgcgtgctgggaggccggcgctccgggggagaccctgggggagctgggctgaggccagcctacctccgccgcagtctgcttggacttcttgtcccgggtcggtagtccgaggtgaccagcctgggggtaggagaggcttccggaaccggcgggcccgttctccaggaaagagactgcccaagtacttccttcagcgtggcctgggctcgggagcagaacgagaggaatgcggggaggggggcgggacccgcacaggagaggcgctcggagcccagggcttgcagccgcccgcccgctgcgtggtctccacgctggccgcggtggcttcaggcaggcattaaagcgcctggttcagatgagagactaccctccgcctcttttggggaaccgtcgtccttcccgggaaggggaggtgcgccttcaacttcggcgggcgggcggcccctgctgtgggctacgcgaggccgggcgaaggcggcacctgtagacctggggcagcctccactgcggggaaagggggcggggggctgccagaaagtgcgtctttaaggctttcctcgtacttaactccgcttcagttcttttttcagcgtatttaaccaagggtagacgataatgggagaatgcagggagagggaggggataatttggtgcccatgatcaccacttctagaaaacccactggcaatagtgtcttcgaagctgaagctggagggggcgggctgcagctgaaagtggtcttcatcagtctggggtttgtcaatggaaacgatactaatcaacgagtagaatgcttacatcctcgaccgcagacgccacctgaggacggggaggactagggggtggggaggaggaggtccagctcagcatctgatgtcgcagaaaggccgtgccacgttgtgggcggggctgataaacagcctgatggtttcgagaagctctgatcttactcccagcctcttgatcttgtaggcatgtctaactttgggaaatggtttgtgcaaggccacagagctgaacggggtctcttgggataaagccataaacataaaattcgcacaattatgaaatgttggaggaaataaactgtaatatactttgggtgacatttaaaaatagctgaaaaatgagaaaaaccagcgcagagaagactaaggaggcaaagggaactgcatatgcataggtcctcaaacaggaaagccctccctgcattcagaggatgtggagaggacggaatggcttcagcacagaatgagaggtgacttgagatgaggttggaggggtgagcagcagcggaatcacacagggccttagaggctgcaggtaggcatgcgggtattgaggcaattcttaaaatttgaagtgttattctgcagtcagagccactgaagggttttaagcataagaatggcatgatctcaatatatactcgagaaatttatgtggtcactcagtggagagtgaaatgggaggtcattcagggcaccatgccagagtccagatggtggcttggattagggtggtaatcattgaaatggggagcaagggaaggacttgaaatagattttggagatataactaacaggagttgctgacggtttagaaagggggcgagggagagggaataggattgccaaataaaatacaggatgcccagttagatgtgaatatcagattaacaatgaataaatgtttttagtgtaagtacgtcccctgcaatatttgggaacaggtttcacctgggaaacttcttaaacttactgatgcagtgacccaccccagagcaagtcaatcacaatctgtatgggtggggctcagtatcctatcttttagaagcttttggtgattctgatgtgcaggcagtgtgggcggggaaccactggaagatggagccaagagaggaggaagctggtggctgcaggaggggaagggtttgagcatcctaaacccttgtctgtgacactgtcactgagggagagtttgcatgcaccctactctcagaattgttacttaacatgtcttttttccccctaccaaatttgtcattaagtttttctaaaagctgattgtgtaggtgcgtcttaaacagattctgctctgttaaattactttttcatgaacttgtaaagacaactaaatctattggaaaatgacgttaaaaataatttctctgagtgcagacaagtacattaattggccattgctctagtgtattgttttccccagcagtgtttttgtttacctctgatttcatttaaaaataggaatctgtaaataagagaggtgtgaggtgctattctgcccacatggcccattagtggcactaacttcgtccacagatcctgctgctgggccagcctggcagcttcctgccccagccatagaggctcaggtgggggctctggctcattgggctccaaatccacagaattacatttgctgacctatatttctgaaccaatgccatgggatctgtgcaggatccggcatcgggagtgtatgaaataatgccaccatccttccagctgcacacatattacagcttgcaagcacattagcatgtagtggccaggaggctgtggctagatggccttagacaagttatctaatgtccacagctcagtttcctcctttgtcaaatggagatagaaatcatccctacctgggagggctttgcacattagatgtggtaaagcagatgtcttagtccatttatgttgctataaaagaatacttgaggctgggcaatttatgaagaaaaaaggtttatttagctcacggctctgctatgagctgtaagattcaagactgggcatctggtgacagcctcaggctgcttccagtcacggcggcggaaggtgatagggagcaggcaggtgcagatcacgtggagagagaggaagctgaagggggtggtgccagcttccttttaaaaccagttctcatgggaactaacaaagtgagaacccattcactactgagatggcaccaagccattcatgagggatctacacccatgactcaaacacctcgcattaggccccacctccaacattaggatcaaatatccaaaccatagcagcaggtaaagcacatagtccatagtccctgatttcagaagtcacttgttagtgttatttgtgtttatcttcttaatcctactgtgacagagcagacctgaaaggaatcatcatttattttacagatgaagaaagggagttcagagtttaattaacttgctgaagtttccatggccattgagtggtggagctgcatttgagaacggtttcttccacttcgcagctcatgaactggggtgtgttccctagttactttggaaatggaatcaggattaattccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacatttcttgactgcctcctcctgctgacctttagctggccactggggaactaaaaacactgtttctactccttagggtttccctggctcgacccggagagccctattaacaataaaccagtttagctagaggcagccttgaaattctggctctcacactcatagtagggaaaccttggtaaatcacttaacctccctaattcccacttttctcatttgtaaattagtgataatagttcctgtcccacctttcccagtgtggtgaggatgaattatataagatgatgtgggttacccacactgagaccaccactaagtcatgtttgcttccttccctctttcttcctgctcctcctccagtgtctgcccctttgtttaaacgcctctcctggctgggcgctgtggctcatgcctgtaatcccagcactttgggaggccaagatgggcggatcacttacggtcaggagttcgagaccagcctggccaatatggcgaaaccccgtctctagtaaaaatacaaaaattagccaggtgtggtggtacacacctgtaatcccagctactctggaggctgaggcacaagagtcacttgaacctgggaggcaggggttgcagtgagccaagattgtgccactgcactccagcctagacgacagaatgagattctgtctcagtaaataagtaaataaataaatgccttttctgtctccctcgtacatttccttctgccaccaccccagtgcaggccattatgaccttattcttcaactggtataagagccccagattctctttctctccgtttgagtaacattcccagagcctcgcttgaccttattctttgtcttctctcttttgcctaacaaaactcatgcttacgtcagcatctctcctctgccttctggaactggtgggcagcttctttcctggccccccacccactctaacccctagttgtggtcagaagggcagctttgcttctctgcacacaggtcacatttcctgcctaggtgcattggttccagaaagaagtctgccaggcaaggctcacccccatccttgtttggggagatggctcccctcctcccaggcctgcctcccttcaagccttcctccttagcctcaccgttcctgcaggcctgggcatacagtgtttggggggcatttgtcacacactgccctgtactgtggttatgggtttgcctatcctatctctttattttaaactgccttaggacagggactctcttatacagtttgtgccctcacattgccttttacataaccttgcataaatacttattgacaaaatgagattggattttatcctttccagtagagttggcaaaacctgctgtgtgttcttatgctcactcatgaagctgaaggatatttcaatttggggaaaaaaattataataatatgtgtgctaggctgtgtgtaaaaatatgtgatttttgctgaagagttatgttgggtgacaggtactttttcttcatctgctcatgctgctctcccagatcttattcccttcctaaacattcacaggctttgttttctcttctttattttaaaagtctggaaggctcttctagtgtctcgtatgatgtttctttaaggtttcatctctggcttccgggtgctgcttcgttattgctggttattgaatttacaccttggcttgcaaatccctttggagaaactgcttctcttgtaagccggctctgcactgaccaggcccatgggtgtgttgaagcaccttcctatcccaagccatgctgaattgcactcctttaatacactgccccttctcatgcattctataaagctcttctatataagtaataataaaagttttgctgctttggccatgtaaaaattgtaaaatgccacatggaacactaaatatcacatcaccctgtgacagatgtactgatgtattggcagaagctcttgacttgaactgaagcttgacagtctttacttactgatttttctaaactgtaagacatcttttttctttgacaaccgttcttatattttttaaagccatctcttgaatgtcttttttacccattcaaacagtaaattggttcatataatctaaacgcgctaatagaatgccctttgactctgtggccttttcaagcgttctatttcagaatcatcttaacacagtgatttgtgaagcaaaatgcatataattttgtttcagatgagacagttaaaaacaagtccaagagaacttttatggttttacctgcaaaaggtggattcacactcactcctggctatgtgtcttctttttcctgttgtaaaatgttgggttaggaaaagcaaattctacttgggtaacttgggaacaagaggactgaattcagtgtctgagtttacagggtgacggctttgtcagcgtgatgacccacgcttaatgtttgctgtcctttggaaagctggggacctggtgctttattgtgcttggacatgagtggcaggccttttgaaggactgctgtgtttcatcatttttgccatctcctggatggcagacatctattgagaactcattgcaaatttaggactgtttgaaatttaaaaaaataaattttgatggttagcctgtttcctcacaacttttttcttttgtcctgccaagattagagagcattactttctaagagagcaatattttccattctactcttcatccataaagccaggaaatgggaagtagcagcagcgtttgtctggggtatgggaagagaagaattattgaagacttcattggccaacactgacagagttgagtcagcctttaaactcaatacctggtacagtgcctggcccatgggtggtgcttaataaatgtttcttgaaagaatatttgtgagtgaaatgcacccacacaatagttttaaagtacctttaattgatgtcatgctcctttacaaaatactgatgggcagggcttttgtatgtgggtcaattctcagattttaattttgacttaccttgtatttgtgcttttccaccttataaccttccactttgcctttcaactgcacacaggtcttctttgatgtgaggattggagacaaagatgttggcagaattgtgattggcctctttggaaaagttgtgcccaagacagtggaaaattttgttgctctagcaacaggagaggtatgtctcaattttatttcctttaaattgggtcttctttctttgaagccaaatataaagatgtcatctgagaaaataagtattaaattagtatgtcagatgaaccttaccacatttgactttattttccaattaaatatgtattatttgggcactcagtgcccttaggcttctggaaattgggagaaaatcatcatcaagtgaaaatatggtttgctctcttttaacttattcacattaatactctacttccataacatatttattttttggtcagctaatgataaatttctctcagtaaaccatagctgggatataatcaagttctgtaggcattttgtttaattttctcagtttgtcctttctagatcaacactgagtttatctttcagtatggcctctgttacttgttattcaactgaagtaatctctttagaaaggatatggatataaaggaagcaagtttcatcgtgtcatcaaggatttcatgattcaaggaggtgacatcaccactggagatggcactgggggtaacgtctttgcattttttcctttcccatttaccaaaccgaaatctaaggttaagccagtatatgaacccagtctgttgaaatccagagctaaggaacacagttgtaaagacgactgtacctctttgagaaggatggagttttggggactcatctagcagcatctcgacaggtatgagggaggcgtccttattttaagcaggattgttttggtgtttattgtctttccgtaattgagatgtattcattttgcagttattaaaataccagactactagtcagtagccatacagaaaaatatctttcataggaaggaaaaggtgtggaacatgaagctgcgttcccctgggatggcagcgtgcggcagaggtgggcgttgcaggaggaagacgggcctcatgccaggagattgagactagagttagcagcagggtcacagcgcactttcctccttctttcaaaatctttcatcatattgacaaaacagtgaaaaacaagtccaagagaacttttaagatttaacctgcaaaaaagtgactcacactcctggctatgtgttttcatttttctgttctaaaatgttgggttacagaaagtgagttctacttgggaaacttgggaacaggaggactgaatccagtgtctgagtttacagggtggtggtttcgtcaggacccaagcttactatttgctgtcctttggacaaagctgggaaccaatacttttttaaagttaaagcaatagctgagttgtcaaaattgtaatagaaacaaactcttacaaacaaagttggagttcaataaagtagagatagttaaatttagagagtttcaaatctccttcagcttattgtttctcattcaggattatagctatccagctccatacactgttttctcttaaaagtttagttcttttcttgaacatacaccatatatgtaactccaaataatttaaatttactttagatttaagatttttaattcaacaaatactggtttcggtggatatttgttgtccatttttaaagcaacaggccattttcaagcactatttctaattttatgtttattgcaatggtttgtttataaccaaaaatggctactattaagtgctttgatttgccaggcactttgtgaagattacttctagttcttgcaagaatgctgaggggtatggggatgtagactggagtggaggaaggcatttaggttgccccaggcaatgggatttgctgaggacgctcgtggatctcattggaaaaccctgcagcgctggtgcccgtgccctcggtgctggcatcccaccttcctgccataggaatggtgctggcaggaatggtgactgagcttcactctgccctcttttctgctaccttttttttctcactaccttccctgcccagtgtgcatcttgcattaaaattctctgaattttggacagacaatgttttgggcaatttaaatatagtgtagacccttctgtaggagcactctcctacaaggccacttcaagtgtcactgaccaaccagttataaattgcttggctttgatatccacttctgggctttttttttcttttgagacacagtctcactctgtcacccaggctggagtgcaatggcatgatcttggctcactacaacctctgcctcccaggttcaagcgattctcctgcctcagactcccaagtagctgggattgcaggcgcccgccaccatgcccggctgattttttgtatttttagtagagatagggtttcaccgtgttagccaggatggtctcaatctcctggccttgcgatctgcccgcctcagcctcccaaagtgctgggattacaggtgtgagccactgcacccagcctacttctgggttttctaactgaatcagaattttgaagttggcaactgatagataaggggccctacagaaggggaggtgggcctggtagacccttgaggtattggaggatggtcagatccttcttatggtctgtggagaaaggtcttccactctgcctgccgctttgctagaactccagacttcctgccttgctttggttctcctgttcaaggttgaccactgggtgctcccaattgtcatcatcctctgtgtcctgatgggtcctgaagttgctgtgaccaacaacttccagatcagctgctattgctcttggtgctgaggcaagaaaaagcaccagctttagaatcagaaagtcagatgttcaaattctgctctgctattttcaagttttgtaacctctgtttcccattgtaaaataggacggagaatacctactcttcagggttgttatgagaattcggtgtgggtatatattgaatgcttggtgcatcctggttgggtgctgagtaacacccaatcctggataagtcacaggactgtcctgagctttgagcctcaggaaacaggtgcacagccactaggatggctcaaacaccttttcatctggctttaggatgttttcctgcccttcagttccttctcacttcagagcgaagtcatggacctgcttgatcaaggtttggcccttggtatgaggccagagagtatcccactatcctgtgccatatttaaggctttctttgttcattttaggccctagtgccctgttcccttaaggagttaattttattccctccttcatgtctgcttatgtttgaacatgtcttccccatccctacctcctatagggttctagtaattgattcctctaaggccttatgtttccctttgaagagctgacttttggaagacatctgttgactttcttccttgttttgtctcaggtgtgagcatctatggtgagacatttccagatgagaacttcaagctgaagcactatggcattgggtgggtcagcatggccaacgctgggcctgacaccaatggctctcagttctttatcaccttgaccaagcccacctggttggacggcaaacatgtggtgtttggaaaagtcattgatgggatggtaaattgatacatttttttcctttcaaagctttatatttttattgagagtactttcagtgatttattttaatcttaaaatatgcttgttagagatccattatatagctgactggcctcttcaaaggtgaataaattatatatggtatggcattttaattcttagggtcattggcgcagcagctagggacttgacaaggagaaattaaggactaagttgatttattttactacttgatataaatgtaaagccctttttaatggaaccaatatataccaggaccccatatatacacacaatggaatattattcagtctccaaaaggaaagacattctgaggacattatgctaagtgaaataaaccagtcgtaggaagacaaatactatatgacttcatttatataaaatatctaaagtggtcacattgatagaaacagaaagtagaatggtagttgccaggggctggggatggggtaaatgggatgttgtatttaataggtataaggttttagttttgcaagatgaaaaattctggctattggttgcacaacaatgtaaatatactcaacaccactgcactgtgcacttacaaatgagtaagatggcacattttatgttatgtatttcttaccagaattaaaaataaaatagttgaaaacaaagcaaaacaaaaccaccccagaatcccatctggttcagctcagacacctaggtcacattcacagagacacgcatccaaaaattattgaagagaatttgaatctatactgttgggtctcaaagaatgtcaaagcagtccaattcacaacccgtaggaacacttcttaaaaccctcattccctttctttctcaatatttctgccttacaggtgcctgaagtagctctctcagctcctaaactggttactgtaaagtctgtccatcccaggcctggaccatccttgtctccctttccctcttccatgtttcattttattttgttttcatgtgacttattctacctccctcatccaaatgtaaataaaccagtcttgctcgctgcagttccttcacaactacctgtttttctgattctatctaacacaagtttgggaactgagctagtagcctcaatgctgtctgggaaacccaccaaaaacctactttcttgttccttgcccagtcctaacctacttcagtgtgaaatactgtactgttgggcttgtgaagccttccagggtagagaaaggtgccttcacagcactgtggggggctggggttacattagtattgggctcaacttataggttaatggcttgggtcacctttaaaatggacaaacctagaactaggtccatttctgaatctgctttctggcccatacatgtgaagacctattacaggatggagctgaaactgactcagacttcatgttaactgttacgctggcttataccaggtgaatggaaatgccttttactagagctgggtgtttacaaaaatatctacttttttagaatataaaatgcttatttaaaaagaagtgaggaaatataccagtgtggtctctgagtaagaaggtcatgggtgaattttattatgtgatgtatatattttctaaatattctaagttttccacagttagcgtgcatggtcttagtagtcataaaaaaccaaccaaccaaccaaccttatttccttcccacttgggcttttggagttggctttggtttaacctttggattgctatagctgctggtcagaattaaaccatgtgtctacttttctctcaccagacagtggtgcactccatagagctccaagcaactgatgggcatgaccgtccactcaccagctgctcgatcatcaacagtggcaagatagacgtgaaaacgccttttgtggttgagatcgctgattggtgacacaactggcagaaaacaaggatatgctttggcaggggtgtgtgtgtgtgtgtgtgtgtgtgtgtgtgtgtgtgtgtgtgttgtgttgtctttcaattatttgcttttttttttttactttctttttgtattctatcccagatcacaggaaagttataaaaatcaaaccgtcaccctttagtttgcttgaactttagtaaaccacctgcttagggactttgaacttaaatatatccccttcctcaagtggtgctattttaaaactaaaaaaaactttgaattggctatttttttaatgcaatattttttttctgaattcattatgatccccatattgggtaatgctgaacatttatctgaaacagatgaggatattattattttgtatccaaacagaaattcagataaagggaaatttgactagtgtaatctgagatatgtcatagggatttctttctgacaaaagggtgctttgctgttctttatattaaatacttttagatcaactctttttgcaagactttttaaaaatgtaaagttctttaagaaatatacaaaaatacacacactctagcattaacagtgaacagattagaaagattttataaatcaaactacaaacataattagataactcagaaattatgcccatccacatctcatatacttaaggtgattatttacttattgttattcaatgtaacatttttagaaagttatctttagcccagttgcaataggaatattttttgttacttacataaggggattaagactcaggctataaggcctgggtatggtggctcatgcctataatcccagcactttgggaggctgagacaagagaattgcttgagcccaggagtttgagaccagcctgggcaacatagtgagaccctgtctctaacaaaactaaaattagctggtcatgttggtgcacatctgtagttccagttactcaggaggctgaggtgggaggattgcttgagtccaggagatcaaggctgtagtgagctgtgattgccccaggcaacagagtgagaccctgtctcaaacaacaacgacaacaacaaaacccactcaggctatatttaaactagatgaggccagatgtggtggcacatgtctgtggtcccagctactgaagaggctgaggtgggatgattacttaagcccaggaattcggggctatagtgagctatactgatggggtatctatactgtttggcatcaatatggtggccactggggagcatggtaccaccaggttgcctaaggaggggtgaactggcccaggttggaaacagagtgggtcaaaacttctgtgctggtcagtagtgggatcatgcctgtgaattgccactgcactccagtctgggcaacatagcaagaccccatcttaaaaaaaaaaaaaaaactaatgggaaagtgaaattctacaggggccttgttataacatacctggctataatagagagtgcttgatctctgttcagatgggaagtgttgtctgttagaaaacagtgccattgcttctcctccaggactcaagcagtgaggatccatctcaccgagttgtattctaaaaaaattgcctcagtgagagatgaactgagtattcctactgctgatttgcaaattgctacaacactcttggagagcaatttgttaatttttttccaacaaatattttttgagggtctttgatctgccaagtaccagtttgacttttggggatacaacaatggacagaaaagggcctcatggggcttacagtctagtgggggaagacagagaataaacaaggaaacaaataaaaagggtgatgagtgctgtgaaaaaaaaatatgcccatgtctgccagagaggctgggagagaagcatcgtcggagtggaaggcctcttgggcccctcttggttctcttgggcctctggagggatggcatttgtgctaaggcctgaaggaagggtaggaagcagcaagaagggccttccaggaggaaggaagagaaaatatgaaggtcccaagataaagatgagtgaattccagggcagaagagaaagccagtgtgttagg

SEQ ID NO: 797 - DNA, 21561 bp, Human; identical to SEQ ID NO: 641

SEQ ID NO: 798 - DNA, 6758 bp, Human; identical to SEQ ID NO: 672

SEQ ID NO: 799 - DNA, 75296 bp, Human
  misc_feature (1)...(75296): n = A,T,C or G
actttgtttttcagcagcacacatctaaatattgtttagagaacacctatattctttgcatgcacagagtcagacctgagcacaactgcacacaagtattcaattcctagctctgaaacaatcacctactcatcagtcccaagtagcctacttctacttcccaaagccactggacactttgttgtatgtatcagaccagaaatatttctctctgggttgcaacttttcctataagggccagacggtaaatattttaggcttttcaggctggagagcctctgttgccagcttcttaactctaccattgtagcacaaaagcaaccataaacaatggccaattgtgtgactttattcctataaaatgttagttacaaaaacgggcatcaggctagtttaccaatccctgctctagaaaaaggactcatgagtgagatatgtcatttaaccttccaaaagaacccaagatggagaacccaaatacattgttgaaaagattctagattcttagttggtgctgggtcaattctagtgtttggatcacagacattcgcattccatctcaaggatttccccttaccatccttaactctctccacctgtgtttttccagtgccacagcatacaatcttacttctctgtcctcttcatagcccacattacaaataaagtcctctttaagctcatcctactggcacctaactttgcatctctctgtattatgacttccagtatttgcctttagctccaaacaccttgaactcaggacaaatgaattttattttaggacctcaaagaccaattaaagaaagaaatatgcaaattaaatgacatatattcttgtccaatcaccaaatatttcttttcctgtttatcttctcaggtaatcaagggtgaagctgctatcccagccccaaactagcttcaacactggtctgcagcacaccactctactttctctttaggcccaaatttcaatctttaaaatctcaatgtagtataagagagagaaaaaagactggaaatcagatcatctgtattccagttctgacttactctggccttgggaaagttactaccatgtatattaaactatgtgacctttgagtggtgggttcccagctgtgtttcaagtaatctttagacttgctgagatcatcatttcccaccatgtgataaaaatctaagctgtctaaggaatatttgttttagttgttttctactgctttgaaaaaagtttgaaaaacacttgttttacaaatgagggaccagtgttccaatgaggtatagtgatttattgaagctcacatagctggtagctgcttagtgcagaaacaagactagaatatgtatccacattctcagtccctatagttttttttcttttctattgcactattttgttctgcttcaccttaggatgaaatccattttacttcaatctaaagttaaattgcaaccatttcagagaagcgtaatcatcattacatataaagagcccatttgatcattgctattttaattctttccaaattaaattttctgtttggttttgctggcatatagaaacactttttactataataaacttgtgttgataaatcatactaaattcatttattaattctaatgtttgtagattcttttgaattttctacatacacaatcacattgtctccaaaaacatttcttaaatagttaccaataactattctataatcaaaaactaagaatctatacattcctaaggggggcagcaattttaagcaattaatctaaggattctttaaaatggaaagagagatttctatgcagtagcaatagctactacaatagcccttgaattgaaaactcactgaaaattcaggactctgtgtaacatccaacacccagagtttcagggttactactgattggtgtaatcatttgcaaagttcaagttccagagaacatttattttgacaaccctctaggtgttgctaggcttctgggatatgacagcattgccttgtgttagctagcaataagaaaagaagctttgtttggattaacatatataccctcttcattctgcatacctattttttccccaataatttgcagcttaggtccgaggacaccacaaactctgcttaaaggtgagtaatatgatgatttcattttcaatcttaatatttcaaaattgttaatcatgtttccaacaaaattacaatttcatgcataaaaatatgtaactcagactataaccatttctttgtctttcttttttataattgctttgtttaaatctgaaaagaaccagaggtcatgttttttaaacaaatgtcattccagaggacatttgagatcaagtttctctatgagttaaattagttaaaagtaaagcaaacatactctttagccaaggtcagtcatgcacctggactacccagcttaccttggcgatagtaaaggtagaaagatagaaaggctcatttcttgagcctctgggcatgcacagaaaaaaataataagaaataagaaattcagtaagtttacatggagatgtaaaggaagaacctatagctggggataaactagagcatcctcagaaatctgttgggtaagatatgctgaactgccttgcagacaaatggttcatgtgagtaaaatacattagaaagtgacaggttagaataagatgggcttcattttaattgaaattctctaaatgctcataaagctatcatcaatggttcaatgggatcactgatttttggaaaactcaagaggggatggcaactatgagaaaactgaagaatttctgcttttctacgatggcactgaagtggaagacttttttcctatcttcctctattgaccgaacattcttttattctatgtttgtatgaaaattgtacagtaatgggtaaaatgcctgtgtgtaattttagatacctccagaatgcctagagatgtggaaattaataaataagaaaccatataatacaatatgctaggccatcataacaaaaaaattcagagaagtaattatttttatttgattaaaaattgttgctgggcttggtggctcacgcttgtaatcccagcactttgggaggccgaggcaggtgaatcacaaggtcaggagttcaagacgagcctgaccaaaatggtgaaaccccgagttcactaaaaatacaaaaattagctgggtgtggtggcaggggcctgtaatcccagctactcgggaggctgaggcagagaattgcttgaacccaggaggctgagtttatagtgagctgagatcctgccactgcagtccagcctgggtgaaagaatgaaactctgtctcaaaaaaataaataaataaaaataaaattgttttaacataaaacaatttgtattcctaataatagaatattaaaaaagaaaagctaccaattagctctttcattagtacctcatcaaataagttttaatgttaccatcttaatttatatcaggctccatattgcctcagaacagttatagcttaaagagcgatcagaatattttataagggttctgtttttgcagtttttgatgataattggaataaaactcacccatacctttcaagcttttggaagttaaaagacagtgtctgctgagaactgagaattagtaatctcttgcaatttaacttctccaaattatttacatgaaaatttcaccagaagctttaagaatttgttttctctacaattgaggaaatattctggaagatatctgtcttgtccagcatctaataagaaaaaaaaacaacaacaaagtatctatttagtttttcttgctgaaaaggtccctgtatgagaaaattccaattttggcagtggggggcaagggtgaagggtataggggagtggcttctctagtctatctagtggttgaaaggaaagcttcacattatttgggagcctcagctcccaaatgtttgggactcacattatatgtctgatcacgacttaaattctatctggctactattgtcccaataccctgtggttctgtgttgctgaggaaaaccaggaaaggcgagttacttaccgacgaactagaatcagcttgcaagtggagtgggaaaaaaagcccctcatttttttttattatactttaagttctagggtacatgtgcacaacgtgaaggtttgttacatatgtatacatatgccatatgccatgttggtgtactgcacccattaactcgtcatttagcattaggtatatctcctaatgctatgcctctcccctacccccaccccactacaggccccggtgtatgatgttcaccaccctgtgtccaagtgttctcattgttcaattcccacctataagtgagaacattcagtgtttggttttctgtccttgtgatagtttgctcaaaatgatggtttccaacttcatccatgtccctacaaaggatatgaactcatcattttttatggctacatagtattccatggtgtatatgtgccacattttcttaatccagtctatcattgatggacatttgggttggttccaagtttttgctattgtgaatagtgccacaataaacatatgtatgtatgtgtctttatagcagcatgatttataatcctttgggtatatacccagtaacaggatggctgggtcaaatggtatttctagttctagatcctggaggaatcaccacactgccttccacaatggttgaactagtttacagtcccaccaacagtgtaaaatgttcctatttctccacatcctctccagcacctgttgtttcctcactttttaatgatcgccattctaactggtgtgagatggtatctcactgtggttttgatctgcatttctctgatggccagcgatgatgagcatttttttcatatctctgttggctgcataaatgtcttcttttgagaagacatttctcaaatgtcaagggtctgttcatatcctttgcccactttttgatggggttgtttgattttttcttgtaaatttgtttgagttctttgtagattctggatattagccctttgtcggatgggtagattgcaaaaattttctcccattctgtaggttgcctgttcactctgatggtagtttctttgtctgagcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctagcatttaagtctttaatccatcttgaattaatttttgtataaggtgcaaggaagggatccagtttcagctttctacatatggctagccagttttcccaacaccatttattaaataaagaatcctttccccattgcttgtttttgtcagatttgtcaaagatcagatggctgtagacgtgtggtattatttctgagggctctgttctgttccattggtctatatctctgttttggtaccagtaccatgctgttttggttactgtagccttgtaatatagtttgaagtcaggtagcatgatgcctccagctttgttcttttggcttaggattgtcttggcaatgcaggctcttttttggtaccatatgaaccttaaagtagtttttaccaattctgtgaagaaagtcatttgtagcttgatggggatggcattgaatctataaattaccttgagcagtatggccattttcacgatattgattcttcctacacatgagcatggaatgttcttccatttgtttgtgtcctcttttatttcattgagcagtggtttgtagttctccttgaagaggtccttcacatcccttgtaagttggattcctaggtatttcattctctttgaagcaattgtgaatgggagtttaccatgatttggctctctgtctattattggtatataggaatgtctgtgatttttgcacattgattttgtatcctgagactttgctgaagttgcttatcagcttaagtagattttggactgagatgatgagattttctaaatatacaatcatgtcatctgcaaacagggacaatttcattccctcttttcctaattgaataccctttatttctttctcctgcctgattgccctggccagaacttccaacactatgttgaataggggtggtgaaagagggaatccttgtcttgtgccagttttcaaagggaatgcttccagtttttactcattcggtatgatactggctgtgggtttgtcataaatagctcttattattttgagatacatcccatcaatacctagtttattgagagtttttagcatgaagtgctgttgaattttgtcgaaggccttttctgcatctattgagataatcatgtggtttttgtcgttggttctgtttttatgatggattacatttattgatttgggtaagttaaacagacttgcatcccaggggtgaagccaacctgattgtggtggataagctttttgatgtgctgctggattcagtttgccagtattttattgaggatttttgcatcgatgttcatcagggatattggtctaaaattctcttttttcgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtttattcagggattcaacttcttcctggttttgtcttgagaggttgtatgtgttcaggaatttatccatttcttctagattttctagtttatttgtgtagaggtgtttatagtattttctgatggtagtttgtatttctgtgggatcggtggtgatatcccctttatcattttttattgtgtctatttcattcttctctcttttcttctttattagtcttgctggtggtctatcagttttgtcaatcttttcaaaaaaccagctcctggattcatttattttttgaagggttttttgtgtttctatgtccttcagttctgctctgatcttagttatttcttgccttctgctagcttttgaatgtgtttgctcttgcttctctaggtcttttaattgtgatgttagggtgtcaattttggatctttcctgctttctcttgtgggcatttagtgctataaatttccctctacacactgctttaaatgtgtcccagagattctggtatgttatgtctttgttctcattggtttcaaagaacatctttatttctggcttcatttcgttatgtacccagtagtcattcaagagcaggttgttcagtttccatgtagttgagcgttttgagtttcttaaccctgagttctagtttgattgcactgtgatgtgagagacagtttgttgtaatttctgttctacatttgcggaggagtgctttacttccaactctgtggtcaattttggaataagtgctaagtggtgctgagaagaatatatattctgttgatttggggtggagagttctggagatgtctattaggtccgcttggtgcagagctgagttcaattcctggatatccttgttaactttctgtcttgttgatctgtctcatgttgacagtggggttttaaaatctcccattattattgtgtgggagtctaagtctctttgtagatctctaaggactggctttatgaatctgagtgctcctatattgggtgcgtatatatttaggatagttagctcttctttttgaattcatccctttaccattatgtaatggccttctttgtctcttttgatctttgttggtttaaagtctgttttatcagagactaggattgcaacacctgcctttttttgttttccatttgcttggtagatcttcctctatccctttattttgagcctatgtgtgtctctgcacatgagatgggtctcctgaatacagcacgctgatgggtcttgactctttatccaatttgccagtctatgtcttttaattggggcatttagcccatttacatttaaggttaatattgttatgtgtgaatttgatcccgtcattatgatgttagctggttatttttcccattagttaatgcagtttcttcctagcattgatggtctttacaatttggcatgtttttgcagtggctggtaccagtttttcctttctatgtttagtgcttccttcaggagctcttgtaaggcaggcctggtggtgacaaaaatctctgagcatttccttgtctgtaaagtattttatttctccttcacttatgaagcttagtttggctggatacgaaattctgggttgaaaattcttttctttaagaatgttgtatattggcccctactctcttctggcttgtagagtttctgctgagagaactgcttttagtctgatgggcttccctttgtgggtaacccgacctttctctctggctgcccttaacattttttccttcatttcaactttgggtgtatctgacaattatgtgtcttggagttgctcttctcaaggagcatctttgtggcattctctgcatttcctgaatttgaatgttggcctgcctttctaggttggggaagttctcctggataatatcctgcagagtgttttccaactcggttccactcgccctgtcactttcaggtacaccaatcagacgtagatttggtcttttcacatagtcccatatttcttggaggcttcgttcatttctttttactcttttttctctaaacttctcttctcacttcatttcattcatttgatcttcaatcactgaaaccctttcttccatgtgattgaattggctactgaagcttgtgcatgcgtcatgtagttcttgtgccatggttttcagctccatcaggtcatttaaggtcttctctatgctgtttattctagttagccatttgtctaatcttttttcaaggtttttagcctctttgcaatgggttcaaacatcctcctttagctcagagaagtctgttattaccaatcgtctgaagccttcttctctcagctggtcaaagtcattctccgttcagctttgttcctttacatgcaaggagctgcgttcctttggaggagaagaggtgctctgatttttagaattttcagcttttctgctctggtttctccccatctttgtggttttatctacctttggtctttgatgatggtgacgtacagatggggttttggtgtggatgtcctttatgtttgttagttttccttctaacagtcaggaccctcaggtgtaggtctgttggagtttgctggaggtccactcctgaccctgtttgcctgtgtattaccagcggaggctgtagaacagcccacactgcagaacggcaaatgttgctgcctgatccttcctctggaagcttcgtctcagaggggcacccagctgtatgaggtgtcagtcggcccgtactgggaggtgtttcccagttaggctactcgggggtcagggacccacttgaggaggcagtctgtccattctcagatctcaaactccgtgctgggagaccactactctcttcaaggctgtcagacagggacgttgaagtctgtagaagtttctgctgccttttgttcagctatgcctgcccccagaggtggagtctacagaggcaggcaggcctccttgagctgtggtgggctccaccaggttcgagattcccagctgctttgtttacctactcaagcctcagcaaaggcgggcacccctccgccagcctccctgtgccttgcagtttgatctcagactgctgtgctagctgtgagagaggctctgcgggtgtgggactctccgagccaggtgcgggatataatctcctggtgtgccatttgctaagaccattggaaatgtgcctcattagggtgggagtgtcccgattttccaggtactgtctgtaatggcttcccttggctaggaaagggaattccccgaccccttgcacatcccaggtgaggcgatgtcccgcccttcttcagctcacactccatggactgcgcccactgtccgacaagccccagtgagatgaacccagtacctcagttggaaatgcagaaatcacccatcttctgtgtctctcacactaggagctgtagactggaacttttcctattcagccatcttgaataatgcccaaaagcccctcatttttatgactgaaataatctaggactctagcagcatatctatgagttggagtaaaaagcttgggtaaaaagcataggtagtattttcaatttctttctaccctcccagacagtgataaaggcttctatttctttgtgtctcattcaatgcctagcagcatacaatgaatacccaaatgtgtgttcattccattttaaattgaaagacatattcagccatacgtcaatggatttggttacttttattctggcatttttctttgagcttgtagaagagtttaaaaagcttactgataatcccagcactttgggaggccgaggtgggctgatcacgaggtcaggagatcgagaccaccctggctaacgcagtgaaaccccgtctctactaaaaattcaaaaaattagctggatgtggtggtgagcacctgtagtcccacctcctcaggaggctgaggcaggagaatggcatgaacccgggaggcagagcttgcagtgagccgagatcacaccactgcactctagcctgggtgacagagtgagactccatctcaaaaaaaaaaaaaaaaagaaaaaaaaaaagcttactgatttattaacaagaaataccctagtttctgaacatactgaaaaaacaatttttatatctgatctcaagctcttgacttaaaccaagatttatgaaatgatgaaccccatttatttttactgaggtatcctttcatgaaaactaagaaacgtaaactaatcacgtagaaatataatcagaaactcatcctctgggacatgagagagccatattttagcagggcaatttggaaatatctattaaaaatgtgtgaccaacagctactattaaatttgtaacattcttaaaagttattactaatttgaaaagctagtatttattaagtgatgattctatgccaataattgttctaagcagtttacatgaaccttcttactgaatcctaacaaaagctttatgaggtaggtattactcttattttatagatagtgaaactgagacagaaaaattaggcgaatggcatttaactttttaaagtaaaagttactactatattaattacagcagaattattgatatgtatgcatatattaataatgttgcatgtttcattagggatataacgattaaactggcaataacggggtgggtatggttttgcaaataactcatggatcttcaagaccataagtgggaaccactggtcaaagatttttccgctcaacctgttgtggcctgagtggtggagctccaggcatcttgatactgcagtaacacagtacttaggattgttagaaactcagtgaagggcttcacctcattcaagaaccagggtttgtgagctcctacttgacctgcagcctcaacactattgcactgccttgagcctcattttatctccataaaatgaaggagtttgacctggaggtttcaaagatccttactagctcttatttctctgactttatatggagtcagtgaacgttctctttagcaggtttccagcatgtcaggaaatgaaaaagagcttccagaagaatgatccaaacttctttcccagtcccagaaaagtaggaacagctgaaatgtacttgaggctattgctcacacaaaaggagcaggtgttttgagaagggtaagactgtataaatctaaaatactttttggaatgaaatggattacaaatacatgctacatactttgtcttgtagcctatcactaaccgtttgaagaaacttactagtactggaggttgtgcctatggtaatctccaccctaaaaatctttaaaaataggatttgtactcacgagcatgtgaatttgtaggtgttgacttgccttaaggaaggcagaaaaatgcaaatattttctaaaatcacatttgaatctctgactcaggatgacttgtgaaggtttacctcaaaaaagcatttgatatgtgttatgtattctttcattttagggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacaggtgggtgtgagctttgtggcttttctttgtgtcctggaaggactcaaggatgaagtcagcaacatcaggagtgcaacactaagcaatgggaacatatatatatcaaagtaagaacttacaaatttggatgaaatttgaagtctctctcttatgaggttgaaaggaagtctacttttgttctttctacaagaacgaggggtttcaaagaaatttaattaagaatctgtgcaacactttcagttgaatatttaacttgcttagaatcactacccaagcttttttcaatcagcatacaactttgcttgcctatagttagtgagttaattatagagaattttctactcattaaatcgagtctaacaggacctcaattgagcagaactgctagctattagcttgattgttggcatatacaaaatggcaacaaaactgttctttcttgataacatttaataattcagtcttttcaccaattcagacttcttgtcccccacagtttctttaactctgttaaatgtttctgtaccatggaaatgctcacatgttaggggagaaaagcatatatttaatgtgttttaaccattagagaattttttaggatccttattttagaaaactatgtttacatatgtagtgtgaatctcattaaaattaccaatttacttccccaataaaccatctactatatatgtgaaaacagatttgtttacaatattcctctattcaagagtccttcagtagctccctgctgcctaaaaagaacagcaaatattcctggccagtcacacaagctcctccctggagagctacctggacatgctctcatctgcctcaaatctttgcacatgtcgcttcctccaaattcccttccctctgttacctggagaattcacgtgaattattcaggatgtttctctcatgccactttctctttgaatctttagcctcacagccccctatgttgtcctcctccaagcagtttgcaggatctttctctcctttcatctttccttgccttccagtccattagaggagctccagcatggctggcttcatggtgtaacatgtgcagccacacaggccccacacttagaagggcttcatgcttggcttaatgatctgcctttgctgtcttgaagttcttagttttgagcaagaggtttcccattttcattttatgctgagcctcacaaagtatgtcctgagttctattaagtggtgagaactgcatatatgccaacctgcctaatttttccatgaaaattttctttcttttctatttattgtagttaatgctcaatgatactttgattatggagcaggatatatggtgaatacactcattctaagcaacttcttcttcatggttacagacaaatagtagtagataagtactaccaggaaaacttttgtgaacagatttgcagcaagcaggagactagagaatgtaactggcaaagatgccccatcaactgcctcctgggagattttggaccatggtcagactgtgacccttgtattgaaaaacaggtaggcaaccatgggcatttccaggaaatatgaatcacaatagagggctctgattccctgacaggcttaacagcatagtaatgctgaattacttcaatttctgaaaatcaactgtctcagcttccattgagggaaaattccatttagcacttttgtggggggaagagggggtttattttatgtattttactgtcttaagaacacaaaaaggaaattttgctcccagtattgatattgtacttacccagttctgaattccactgcctgtgccttctgagaattctgaaagcaaaagtgtatacagattgagtaatccttatccaaaatgttggtatcagaagtgttttggattttggatgttttgtggattctgaaatatttgcatatacataacgtagtagcttggggatgggacacagtctaaacatgaaattcatttatgtttcagatataccttatacatatagcctgaagataatttatacaatattttaaataattttgttcatgagacaaatttatgataagtatttacatatataatactccactgtggcatcatgttggtactcaaaaatttttagatattggagcattttggattttaggttttcaaactaggtatgctcaactcgtactaaaaaaaaaaaaaaaaaaaaaaacaacaacaacaacaacaacaaaaacagggtttcagtccaagattttaaaccagacagaaatgagggaaatgaatcaaaactttcactccttgcccttcctctacattccctctcctcacagcagtccctcaatttgtttattgttccccattgaaatatttacccaccacaaactcattcctgtaagggcatcggccaatgtgaaccacagttagggccgtgttgagcatttacacagcagggaagaaaaagaaactcatttgtggaacagctactttctgaggggaactgttctaggtccctttcatgtgtcatcttattcaaacttcacatcatattgtgtttctctacccattttacagatgagaaagttattgctcatttggggttaagtaatttgcccaagaatacacccattaattaataaattgaattttctgacttcaaagtcagtactttttagtcctatcatatttctattctcccttgactcaccattttactactcgccatttaaaatctttttaaagtgtagactacattcgcattggttttcacagggactctcttatgcaaaagaacctcaaaattatttcacatttatcccttcacactatctttaagatacagaaaggttactattatggcctggaggaatttactgtactcaagagactctcagcaaacatttatatattttattttgaaaacgtataaaccatatggtttcagagttataagaagccttagaaacctttttaacccacttcctcattttactggttgggaaacagagatccacagaggtgattatttccctaagggagcataataatggaattggaagaatcattagtaaaaatataagaaatattaccataggaaaaatcactgttgtgattgaggagcccagttttcttaggtacattttgaccttgaccctgcctcagagttatatctttctcttctttcctttcagtctaaagttagatctgtcttgcgtcccagtcagtttgggggacagccatgcactgagcctctggtagcctttcaaccatgcattccatctaagctctgcaaaattgaagaggctgactgcaagaataaatttcgctgtgacagtggtaatgtatttttgtgaaatgttcagtccccactaaaaatagcttgactaaatcaaagttactccaattgactaacagtagaatccatcacagagaaatcccaccacattttaagcagagtggaatgggaatgttatgctgccaattcccaagatattccactgtaaaattatggcttttcagttataccattttgaccacttacctgatctgcacaaatctataatcaggataattttagaagaaatgacatgttttaaaagatttttaatataatttattatgacaagaatattaagatatcatgttggaagatgactagagatgatgtagaaaactttcttgactggctctaaaattaattccaaaagagtaagtcaaaagcacatacacaaatgagcatggctatatttcaataaaattttctttacaaaaacagttggccatagttcaggtcagttttagcctacaggccatagttcattgacctcctatctaaacagtcaacttaaagttacaataaaattaaatttcagatgaatgaaatctctatcatttctgtgtactctgagatatcctgaaaagtaaagtatttataactagatagcaaatttccaattccacagaaaattgacccaagaccttggaacccaagttttcccctcttactccctgcatcctgccctcagctttgccagctttttctgaatgtcagacaggaatgctggggtcagggttttcccctatccacctccaccccaaacctggaatttgagagcaggatgtgggtagggagatatactttgtgtctatatgaataaggtcatgtcacaaattgacaaaaaagggaatcagagaaaaatccgaatgagaatggctgagggtaatacagacctgatcattatatccagagtatcaaaatcaagctctagaactgaagtataactatttgaagcttgaaagatggtttttactacatataagcaaaaaagactcttattcagtagatgataaatctatgaaaaattacaaaggatctgcattcaggccaaaaatacttaaagtttgagaagccttgagatgcatccattggtcaccaatttataatgaacaattttagaaaggttagcagtgtaagcacagctgatcgccagttcatcaacagttatgtccataaccactgattttcaaataactgtattatgaagatgtgtctgtaatggttgttaagcggctgctactccgtactccctgagtaacccatgccctgcttcccagagcccaaaatccctagatcttttcatgatccaggaactgattggtaaatccttgtcacagatatagttggcatccattcggactgggtgatgtcatagccttttggttgttaaatattccattgaagatggtatactgttttgctctcctaaaagcatctactaatgccactgtcaatgggagtaagaggtttatgaatgattgtttttctgactcaagatgatacttggctctcaattaacaaagaactatctctcctgaaaagattgaccatcttgcctttcctccattatgactgatgttcagagtctcccaagagtccccaagactaaatggattattttgatgtatacgtggatttttaagaattacccattatgttaattcccatgcaatataccaactcttctttcagagtcctaattttaagcataaaagactagagaatttgcagctggttttaaaaaataatactattgcagtgacacaaatcgcttccaatggataggaaaaacgtgcaatttctaaatgattgcatggttccaagtgtaaatgtatacatgcatgtgctggctaagcatgctgacttctgcaaatcctgcaatattcaaactgtcctttaatttctcattccttctttggtatagaatatatttatggcttacaatatctctccccttatgctttctattccatagagtttttatgacctggaaccattctcacccatgtcacatcaggcctattcctaaacatccctcaagaggtatcctcttcccttcatccctacccttgctaatggactctctaagatatccctataagtactaaatggatagaatttcttgtattctcacaaatctggtactctgctcacaaagctaagctaatgagaactatactctacatgtgtatccctccttctgtctaacaaagtgagattttagtgtaaccatatcaaaaataaacctttgcttaaatttgtaagtgctaggttcaaaactttttaaaaaatgtaatatgtatagattcatattttaataaatagcctctctatttcaaactaaaatgcccattctgttctgtcctgaaaacaacacaaaacaaaaaaactagaaaggcactgtttaaaaatagagcatctttcaggttaagtcatgggatgaacagacattcaattcaatctgcatttccagtcctgtgtgattatagtgctcgtagctataattctttataataatagtcctgacataatgcaagatggaaaatgtaattattttaattacactctaccttctaagtgaagattattaaccaaaaaagttgaaaccaagtactttcttgggaacccactattaattaaaaaaattaattcaacagaatgcccaattttcccaagaattttagtcaaaacagtcatgcataattgtagtgagatgctaatcacatcttaaaataatcaaccagataatctcaagtaaaacctttaatcattgtcagttggacctgtacataccggtacagatgccaacatcattgactacaggcaagaaggtaaaaggcaggagaggagatatctgtcattgcacataagtatttcaatttctataatatatagttatatactgattccaaggatccttatgaaattcagtaagtcagaaatggaaggtaattatttgggtacatggaatttgtaccattttctaaatttgctcactctacttgctactgtagtatctagacacttaacttgtccaaaaaatagatatagcaaattatatgcaggaaaacaattatatacagtaattatatatagtaaaatagatagtagatatatttaatatatttaataaaatctgtactaattatatatagtaaaatatgcaattctaagtgtgcaattttgctttcacaaattatgcaatcatgtaaacaatcctatgtcaagatatagaaaatacagatttctatatcgagatatagaaaattcccataaacccaaaaagctccctccttctcctttctagttaattccccctccttctccctggacatcatataaaggaatcacatgacatgactcatgtgtctggcttttttcacccaacataaaatttgagagatccaaccatgttattgtgtgtgactgtgcatctgtgtgtgtgtctataaagttacaggtttttaaataaaaacagtgaccttgagtctcccatcctagatcaaaacaaaattctgaacctcttgttaattttctcctactgaacatgatctctatagcggctcactgtaatgggaattatattctaggattatttctctttttaaagacaatcagcaactaaataattctgtggtgacccttataatcttacaagtggaaatttatcagtttatcgctccatttttatgtgctccctaaaactctatcaaaaacagtgaagacttgccttcaactttaccttgaaatttaaagcatttgagtttcaaattaataaatactttctaaaatgataatttgttgcattgattttgtttgcttttcttgactaggccgctgcattgccagaaagttagaatgcaatggagaaaatgactgtggagacaattcagatgaaagggactgtgggaggacaaaggcagtatgcacacggaagtataatcccatccctagtgtacagttgatgggcaatgggtatgtaacatctttttatcatcttggggagaacaggtatcagaacaaatgagtcagagggagcaatgagatacatcattgtccatcttcctcattaacttcttactactcctaccagccctatctctgatacttagctaccatgttcaggaggtatgtggccatgatcctcactcctgagaagtaaaagttagcatttccaaatatagtttgtgccaggcaatgctatgggcccttcataaacatggcttgttttatttctcatacatctctcagaaagttttggaatggattagagcagactggtctaagcccatcaagctgggaggtgccagggtggggtcctggaggtaggccttgaatgggtgagtaaccactcagaaatgtcaggagcaaatggagaaagagggtgtgataaaagtatgcctatgggtgggttgaaagccaaaacactagagaaacaaaaccagtcttccagcatgaaaagcaaacccagagtcaaataatgagcgataaagccaaaaggaaagaagttaagcaaatatagaaaaaaagagagggctaagcaacaagggtgtgaaaacgtaagagagtaagaggtgaagtgaatatagctaggtattctctcccataggctgtgtgacgtgtgggtaggtcagcagagcctaatggcagaagccagacctatattaccatccagtctcagcttacaaactgagaaacgagtcccagaaagcttacataacctgaccaagtctaccaactagcaaatggtggaaccaggattcaaatccagacttcaaaacccaggctttttccatgatttcatgctgattcaggactacatctaccttacaaatgagacaccctggaagaaacctcaggagatcacatagctctttcttctagtgttcctactacaggaatacccaatcatgagcacactgggggttttaccaggggttctaaattcattagactgaacctgtgttttagatgatgttaggaaatataagagaaggctatgaaaacagaaaaactgagccttaatttgaaacataagaaaaaatcagtaaagataatctcctatactctcccctttacataataaagaaacccctcttaaatttttggccagaaggcagatagtttgctatcaatttctattgcttcatattggactttagaaaattagaatcttcacttaatgctgccagagttgcataatatgaaaactcgaggcaccaaagacaaacagccacaattgcaaatacaaccttatttgatttagaataaaacccagaaaatattgaaccaaacccgaggacaccagtaaaatggaaaaaccattagtctgaaagtaagaggagctgggttctaaataactcagctggttctaatgtagaactagaaccagttctacattatctcactacaccacagccgagttatttaacaactctgggcctcggtttcctcatctatatgttggatgactataaactgatgtgatgttctgtcctaagaatttctaattagtgctgatttcgatgaaagtgcttcaacaacatattcttatccatgtgcagaaatggtttccttctcttggtttgcctacaagaaaacgtcagccaaaaactcccactgataatcacattttctaatgttctgattgatgaagggtgacattacaaaatcaccttttgttcagttgatctagactctagagttacagatggggaggaccacatgctatgtgtactttggctgaaggacgacgtggccctctgccaaccagagctgttgtcccagtgattctgagaaatgagcaaagcctgccggctcgggacaaccagtcctctccttgcctccccagagactgagagttttgagaattgcttactgtaatcttgttctaatctgctggccttagaatctctgcctctccaatcctgctatccaacatatttctaaccccaaaaaaaaaaaaaaaaaaaatagcttcctgagtggctgaccttcttaactgatatttctccaagaaaaattttaacaagagatataaaaatttctacattgccaacatcagtcactaggttctaaatatgaagcaagaatcaggcaataatagcatgctatttgtttttacccaggcttagtgtgtgtatagatacacacacagttgaaaggacacattcatctatgtggcaaaatagtgagatctgtgagtagggatcacacacatatatatgtgaaaatacatgcatacacacaaatatatatttttgatttatatatttctagttatattcaaaaagttacaaagtatgacacataaatcagattagatcaaagcactttagaaacaatgctgtatgtgaaacactaaattattttaagtcagtatcaacatctgagaggaggaaggaaagaataagactgaaaatttcttcatagctggcttaactcctaaaagatttctcaggcatggtctgctggaaatacctccataaaatcctatcttcaggttctccacaaatagctgtcaccttcatagattcctcatgacctgagagccatttttctcaagcccttttttgcttgtgacaaacataagtacatagtgtaaagcagtataaggtcaatggttttttagtcctcgctgttatgctttcagctatttgaatataatatgcatcttagacaacccacagaattcactcattttaaaaaacagccttattgagatgtaatttgcatgccatacaattcatccattgaaagtgtctaattcaaccatcttcagcgtattcaaagacttatataaccatcaccatgatataattttagaatgttttcaacatacccaaagtaaaacctttgtacatattagatagcaagcttcatttctttcccccttctacctgactcctaaccctaggaaaccactaattcactttctgttcatgtaaatttgtgtattctagacatttcataaaaatgaaattctacaatatgcagcctgtgtctgcctttttgcacttagcataatgtttttaagattcatcccaatactcacaattggtactacagaaatacaaatgatcattaaagactattataaacagcaatatgccaacaaatttgaaaatctaaaagaaatggataaattcctggatacaaaaaaaaacttaccaagattgaatcaagaagaaatagaaaacagaccaattgtgagtaatgagattaaatcaataacaaaaagtctcccaaaaaagaaaagcccaggactggatggcttcactgctgaattctaccaaactttgtaagaactaataccaattattatcaagctatcccaaaaaatcgaaagggaacttttccaaactcattctacaagactagtataacactgataccaaaaccagataaagatgcaacaacaacaacaacaaatctactacaggtcaatatccctgatgcaaaaatcctcagcaaaatactagcaaacagaaccccagagtacatcccagatatctactataattaagtagtatttaatccagagatgcaaggatggttcaaaatatgcaaatcaataatgtcatcacatcaacagagagaacaaaacatatgatcacctcaatagttgtggaaaaagtatttgataaaattcaacatcctttcatgataaaaactctcaaaaattagaaatagaagaaacttaacacaataaaggctgtatatggcaaacccacagctagcatcatactgggtagagaaaagttgaaaacttttcctccaaggactggaataagacaaggatacctgctcttaccactgttattcagcatagtcctgtaagtccttgctggagcaattaggcaaggaaaagaaataaatggatccaaactggaaaggagtaagtcaaattgtcactgtttgtagatgacattatcttttatagagagaacactaaagactccaccaaaaaaaaaaaggccctagaaatgataaatgaattcagtaaagttgcaggatacacaatcaatatacaaaaatctgtagcatttctatatattatcacgagctagagggaaaagaaatcaagagagctaactataagagctacaaaaaaatacctaggaataaatttaaccaaggagatgaaagatctctgcaaggaaaactataaaacactgatgaaagaacttgaagaggacacaaaagaaatgggaaggcatcctgtttttatggattggaatattactattgttaaagtgactcaactgcccgaagcaatctacaaattcaaggtaatccctattaaaacacgaatgacatgctttacagcaatagaaacaaagctctaaaattcatatggaaccacaaaaaaccttaatagccaaagcaatcttgagcaaaaagaacaggcctggagtgctggctcatgcctgtgccagcactttgggaggccgaggcgggtggatcatgagttcaggagttcaagacaagtctggccaacatagtgaaaccccatctctactaaaaatacaaaaattagccaggcgtggtggtgggcatctgtagtcccagctacttgggaggctgaggcaagagaatcgcttgaacccgggaggtggaggttgcagtgagcagaggtcgtgccactgcactccagcctgggcaacacacagagactctgcaaaaaaaaaaaaaaaaaagccaaaggcatcacactactacatttcaaaatatacatgttacatgtgttacatgttacaaagctatggtaacccaagcagcacactattggcataaaaatagatgcatagaccaatggaaccgaatacagaacccagaaataaaaccatgtatttacaaccaactgatttttgacaaaggtgccaagatcatgcactggggaaacaagagtctctttaattaatggtgctggaaaaactggatatccatatgcagaagaatgaaactggacccccaccactcatgctatacaaaaatcaactccaaatagcttaaagacttacatgtaaaattccagaactattaaactattagagaaaaatgtaggggaaaacccttagaacattgatgtgagaaaacattttatgaaaaagacttcaaaagcagaagcaacaaaagcaaatgggattatatcaaactaaaaagctttttgtacagtgcagaaaacagtaacagagtgaaaagacaacataaacatacacagtggaaaaaagtatgtgccagctattcatctgacagggagttaatatccaggatatataaggaactcaactcacctcaaaaataaataaataatccaatttaacggattaagttcaccagtgaacttaataagacatttaccaaaaggagcccaacaaatatattttaaaatgttcaacatcactaatcatcgggaaaatgaaaatcaaactacaatgaggtatcatctcactacagttgaaatgactattatcaaaaagacaaaaaaatagcaaatgctggaaaggatgtggagaaaaggaagctcatacactgttggtgagaatgtaaactaatgtagctcttatggagaccagtatggagattcctcaaaaaaactacaaacagcactgccatatgatccagcaatcccactactgagcatacatccaaagcaaaggaaatcggtatactgaacagatatctgcatccctaagtttatttgcagcactgttcacaataaccaagatatggaatcagtctaagtgtccatcaacagatgaatggataaagaaaacatgttacatatacaaaatggagtactattcagccataaaatagaatgaaaccttgtcactggagaaacatggatgatcctggaggatattaagtgaaataagccagaaacaaaaacataaatactacatgttctcactcacatgcagaagcttaaaaagttgatctcatacaagtagattagaataagggttacaagagactggaaagagtaggggaaggggaggataggaagagattggttaaaggttacaaaattacagctagataagaggaataagttctagtgttctatagcattgcaggtgactatagttaacaataatttagtacatattttcaaataccgagaagagaaaattttgaatattcccaacatgtttgaggtgatgaatatgctaattaccctgattttattactatacattgtatgtatctaaacatcactacgtaccccataaatatgtacaattatgtgacaatttttaaaaatgtaatattaaaaatcacccatataaagcatatgttaatacttcattccattgtatgagagaataacaacccattgtatcattctatcacattgtgttgattcattcatcagctaatgaacatttggtttgttcctactttgactagtatgagtaatgctgctatgaacattcatgtacaagtttttgcattgatatatattttcaattctctttcatatatacttaggaatggaattgcagggtcttatggtaattatacatttaatttttgaagaactcccaactattttccaaaacagctgcaccatttttcatttcccccagttacatatgattgaaaatcaacttctccacaccttcatcaaaactgtttctgttcatcttttggttaaagctattctaatggctatgaactggtatctcatcgcaggtttgatttgtatttcctaatgactaataactttgagcattttttcacatgcttattagtcattttcatattttttcaaagaactatatatttagatactcaaattatttgctcatggtttaattgagtaatttggtttttttatttagttccaagcattttttgtatattctgggtgtaagttcctcattagatatgtgacttggaaatattttctcccattatatgagttgtattttcacttttttgttggtgtcctttaaagcactaaagtttttaattctggtggagttcaatatatttatttcttcttttgttgaatgtgcttttaatgtcatatctaagaaggctttgtcttactggagttcacaaatatttagtcctatattgtcttctaaaagttctatagtttcagctcttaaatttaggttctattatctattttgattaatttttttgcattatgtgagaaaggggcccaatttcattcatttgcaatataaccattaggtcattacagcaccattcatttaggactattttccccattgaactgtcttggcacccttgttgaaaatcaattgaccatagatgtatgggtttatttctagatgcatttctgttccattgatctatatgtctgtctatcctcatgccagtactactacactgtcttgatgaccctaattttgaagtaaattgtgtatcaggaaggtaattccttgaactttgtccttctttctcacgattctcttggctgttctgggtcttttgaattttagaattgtcttgtgaatttttaccaaaaaaaggcagctgagattttgataatgattgtcttgaatctataaatcaatttgggaagtactgctatcttaacaacacaaattctgccaatccactaatatggaatgtctttctattcattgagatttcacttaatatctttcaacattgtttatacttttcagtatatgagtcttagacttcttttgttaaataaatacctgaggattttattctttgagaggctattataaatggaattgtttctgtaattttatttttggattgttcattgctatttgtagggaaatacatttgatttttgtttgttgattttgtttctgcaagcaattacttttgaacttagtatgcaaccttttaataaaattaaaatatactttccctggtggaaaaaatgggagagttagtatgtattgtttcctttcatagggcaggccaggcctgtgctagtcactattaatttccacaactactataaaaaagcaattagctccattttcaagtgaagaaaccatttcagaaacttaaaagctgtgtgtgtgtgtgtgtgtgtgtgtgtgtgtatgtgtgtgtctgtgtacttttacattaacacaattttattggtagagaatttacaagtatttatattagccttactttcttttcagtattctaacatcactttacaactttcaaactatccttgctcctctttgatagaaaaatattgtgccccttggttagaagcgcctgagtaattggtcgaattttctgctttaaatccaaatgtctaatagatcgcaaaagcctcccatagtgaactgcttcttgattccctcacaaatgaatgagtctatttgtctttttttcagatctttgtgatagttacaaaacttaatatttcagctctggtaaaggtggtgcctttcaggtacattttgtcttgtgagttaatgccatagaagtacaagggaaacagacatgtaagtggtcaatgacattcttgaggatgtttagagttcccttgagcccccacaactatcagaagggatgggtgtactgaagggtcatgagaagggaagggcattggtgctattccttctgctacatggaattttccagtgatattctgtagaactacactacatgttctatgaaagacaaggttatttggtcaaatgtacttggagactgacaatttatatttttaaggctgtgacatgacctgtagaaaacgatttttataatctatgtaatacagcattaccaaactgtttgacaaaaaaactacttttttcacagaatacatattaatatctcttagaatttggaaaagcattagcatcttggagaagtttttttatctataacaaaataacctcttaaatagttgatttatgctaagctaattaatctctatgtgcctcaatgtcctcatttgtaaaacaggtataataattatatctacatcatatggttgtaataaatataagttattattagtaaagcacttaaccaagttaatatttgtaaagcacttactattgcttggcttatagtaaatagtatataagcatttgttaaataaaatatattttaaatattatagtcagttattagtaaaactataatattattacaattccattaaaatattgctgttactattttattatgagctctctattagaattccactcagaaagaagtagacctgggatagcatttattatataataacttatttcataatctgcttccaaactttgcactggctttgtaagtcataaaaaattataaatccagattttgttgtatgttgaaagccaagaacaattaagtaagtggaataggagaacctaatagagccagagaagctgagtttgggctttccagcttccttgcatgcctcaccatggactaggaaaaaaaagcggaggtgtgggggattccttcaagtcatttgtcttgaggcaaaaaggtttagaagaggaattcctttcatataactaaggtaaattttaaagattgttctacatctgttgaattcctgaaaattactttgtttctaggtttcattttctggcaggagagcccagaggagaagtccttgataactctttcactggaggaatatgtaaaactgtcaaaagcagtaggacaagtaatccataccgtgttccggccaatctggaaaatgtcggctttgaggtatgacagcctagcatggtggcaactccaacaccgtcagtgattataagctaaatttctcatgcaaaattagtgatgaatgaagggacagaataaaaaggtggtgaaccattttaatcacgtgttatgtgtttgtattttatccatgcacacacaatgaggccagtgttatcaatttacagatgaaaaaactaaggtaactaattttccagaagtcaaacagctagcaagaagtgaattcaagattcagggccaggttttcctgattcgagtccatgctttctccattgaatattcagctctaaaatagctccacacagataaacagtttgatttcttcagaattttctcctaacctaggtagtgctcttagataaccacaaaaaatagactttttttttaaagtgccaggctcataagaaaaatcatgatgagtcagtctaatgagatagttctgcttacttttcttcctattttattagttggtttggtttatttgtttcttttagtaaattataatgagcagcatactacctactctcagaatctaactcatgctttacacgtaagtgctccatactcgttgcactaaagtgagtaatctgcttcttttaaattgtgataagaacagaaaatacacgttttaatggtgacgttcatgcatagaaatttgacaagctagagagaatttcagagttgtaattatttctgagaaccactttatgggtaatatgagttcagcaaaaactcatttaatccttcctttaaaaagacctttatatacatataaatacaggcattttccaattcgattcactcaatttaaaaccatctaatatatactgataggtggggaatgtctttgggaactaaccgtcaaatttgaatacctctgggaagactgataatactgctcttaagatatattgtatttgaacaggctttgtagacagagctaaaacctaaacatttatatgtaatattgttctgatggaagttgctttccagttccaaaacaaccaatccacaagtttactttcaaaatatggtcatttcacaaaaggatattgcctgtattttcagcaaacatctatttcatgtagttttacaagtaacaaaataaaggaagtatatgaggctggagcaaattgaggcttagataacacttcatactcatatgataccttagagtcttcaaagtactttcatatattgctttacttgattcccataacaacctccccagaaaggtagaaaattgtttacatccacattactaacagaaaatttaggcttagccgggtgtggtggctcacatctgtaatcccagcactttgagaggctaagggggtgcagatcacttgggtgtcaggagttcaagaccagtctgggcaacatgatgaaaccctgtctctactaaaaatacaaaacttagctgggcgtagtggtgcacacctgtagttccagctactcaggagtctgaggcatgagaattgcttgaacccaggaggtagaggctgcagtgagccgagatcacgccactgcactccagcctgggcgacagagtgagactctctcaaaaaaaaagaaaagaaaagaaaagaaaatttaggcttattggagttaaacaactctctcagagttatacagcaaataaatggcacagaaaaataaggattcctggcttctggctcttatagtcggaggcggcctatgttagatgagacgtttgtagtatatcaagaaagacattaaaactccacacagtgggttaaaagtctgagcaccttcataaactatcagttaaaatgtatcccccttgaagttagacaatgatgtgctggacccagctctttgagttcacaagagtcaactgttaacttttcaggaattttggaatccaattgtgaaacatagattttttttttttctttttcaactttcattttagattcagggaatacatatgcgagtttgtcacctggctttattgtgtgatgctgaggttgggggtacaaatgatccctttacccaggtactgagcagagtacccaacagtttttcgactcttgcccctccctcccttccccccctagtagaccccagtgtctgttgttgccatctttatgtccatgagtgcccgatgtttagctctcacttataagtgaaaacatgtagtatttgtttttctgttcctgtgttaatttgcttaggataatggtctccagctgtatccatgttgctgcaaaggacatgatttcattctttttatggctgctagtattccatggcacatatgtaccacattatctttatccaatccactgctgattggcacctaggttaattctatgcctttgctattgtgaatagtactgcgataaacatgcaagtgcatgtgtctttttggtagaacaatttgttttcttttggatatgtacccaggaatgagattgctgggtcaaatggtggttctgttttaagttctttgagaaatatccaaactgctttccacagtggctgaactaatttacattctcaccaacagtgtattagcattccttttctccacagccttgccaacatctgttgtttttttgactttttaatactagtcatcctgacttgtgtgagatggcatctcactgtggctttgatttgcatttctctgatgattattgatgatgagcattttttcatatatttgttggtcaaaacacagccattattaaatatcaaatatattatctcacaggtaaacacattaaaaacaaaggttataattgctcaaaattgatcacttttcaattatttggctacattttaccattatccatgctattggggttatttacatctattggatctgtattatgaaaatactttgtaatttgccactgtgcatctcttcccaatatgaattcagggcatcacataggtagcttgaaatcagccatggtaggaatatatgcacaatggaaaagaaaaatgctatagcaaatcagggctttcttccccttcccagagagctagttgttaaacatttactaacagatcactgggttaacccacaaagcttgataacacaagcctggataacaagttacatgaggaaatacagcctgaaaattcttttacagcagattaaactcatttccttatcaatgtagctctaagacttgtccaaccttatgaagctacctgagctaatctttaactctgccatagtggtatggctgaagtcatagtgatatggctgaagaaggtcatagtggtatttcttcaaacaaaaatttgggaatgactagagtcaaggtcacaagctattggttttcttttaactgatctctgtataacttcattctttaggcatgcttttagcaggcagctatgcaaacctaagctataccttattgaaaacaatagaggaggagaaattcagcaggcatctcacttcccttcttttgtagtattgtagcttatgaagatagatgaaataattggctggctggtatacaaagattaaagagactcatgaaaggaagagaaggcaactgggcagggagttagaagaccttagaataactacaggacagatgatggaatacagacaccagactcagcattttaatcaagacaagttaggttacactgcaatatcaatactaagatgtcagtgtcttaaaacagtgccactcatactgtacgttctactgataatagtcacttagaaagcaagggacttaagggatcctgctttgacacatcctgactggtgtgatgatgaattgcaaaaaaaaaaaaaggggcggggggaagtgacatattgcccatcaactcttaaagtgacagataccatttatatttacattttattggccaaaaagagtagggaaatgcatgctttttatgtgcccagaaagagactagagtagttgtaaacagcgtaatgactaacacaaaggtcaatcaagagttgatcagcactgggagctttggtagcaggcaatgggaacccaacctcagaaactgtgatcccgaagtcagactcgtctcttgaaaaagtataaaacaaggtgggacttggttataaagaacaagcccagttgtcagaactgaaaagtatcttagttagactgcacactgcatcaaaatcacagacatgctaaaaataaccttcattgtttatcaccctgttaagtctcagcttaggtggcatttccttgagggagggtttcctgatattgcctctcagggtcttatatttcctgtgggattccactggtcacacagtacttacctcattaagtgttggtgattatctttctctctaactaaactattaacccctcagtgcaggaaataacactattctttgttctctagcaaaatgtgtcctcaataaatactggctgagtgcataaataaataaatcatcatttcattagatatccacaagtcgctccagtatttcctaaattatattttattttacatggatttttctccaggtacaaactgcagaagatgacttgaaaacagatttctacaaggatttaacttctcttggacacaatgaaaatcaacaaggctcattctcaagtcagggggggagctctttcagtgtaccaattttttattcctcaaagagaagtgaaaatatcaaccataattctgccttcaaacaagccattcaagcctctcacaaaaaggtatcaaaaatggtttccaaccttttattctttcttgaaaattaacagtaattccagtaatcatgcaataagaaggggagagttttgatattgtaccagtatgacttctaatacagatttaagtaatttttccattttttgttatatctcacttcaaaagttatagaaatattatgtatattaatggttccattttgcatgcatttgactgttattgttatgttttttatcttcacttttttttcatattgttgtaggtgtgcttcttataaactccatacaacagaactttgacctttcatgtaatatgacaatctgtattttatatttttgttatatgttatatacatatttgtatagatgtatatatttgtacacatatacaaatacatatataaaatataacaaaatgtgtattttgctacatttatgtaaacacacgcacatttacctatctccatttttttcctcttatattccttttcttgagatccctgttctcattcagttgcctttttttttttttaattcctcatataggacacatgcaaggtatattctctaaatcttttgtatctaacattgcctgccttttccctgagcaataaatataaagaatatcctgactgtatcataatcttcttctcttgatagtagatgttattcaattgtcttctaatttccattgctgtataagaacaatcatattcagagcaaattttttcattttcttttccctgcttgaaaagttacaattcttttttgcacttggaacttagggtatgtctaagtattggacttttcctgttaatcttgccagggacttagagaacccttttaatatacaaagctacagcttcatgtgttcctttttctcctattattttcattttaaatctcttagatatgtctcacagtgtttaaatgatttagaagacacatttctatctgaaatttttagacatttacaaagatattttaaaatactgtctattgctcactacaaccaccactctaagtagcatttgctctttcccaagagatgaatgagaagaatgagccctgaatcatggaactagagagggaggagatagaggtaccaatgtcagagttaatgagatcagcaactggaggccaccatattacggttgctcctacttttatcgtattgctcttctacttttatttagtcaaccatttatgcacttatacaaatataagacctaaagcactgtgtggatagttttcccaagtatttcatttatcctcaaaaaaattctaagagattatcagagtcaatatttaaacatcattttgcagatgaatagattgaaattcatatatgcatttttaattcaacgaacatttatcaaatacctaccatgagtcaggcactaactaaagtccaagaagctaagtgacttccagtgatcttacagtaaataaatgctagagttgggaactgaaatctgtttgtcttatttttgcttacttttcttattcattgtattacacttcaagatatttgactctttattcattcatttatttattcataattttagcaaaatacagaaagaacacagttctggtgacacagacatgtaaaaatgacaatgaaatagattcattttatgtataaattatatataactatatataatttatatatataatataacatatattttatatatatataacttagtttagaatgggctgtgggtcctatagagccctccaaacttaacaaattatctttgtaagacaagatagtatcagaatttcttgtaagtaaaaatacacatctctagcactttcccttaatctactaattcagaatacctgggattgggcatgggaatatggccttttttatttttagctccctagctcagtataatatagcatgcaggattggaaataactgcttataaacatagtcaatgatgaagggagatagatagacatgtttgtatgagacataggtacagtcctatgtcttgcttcacgtatgtgatttatatgtatttcaaacatgctannnnnnnnnnnnnnnnnnnntttgtaaaacccttatatgtagataaacagctattgtttgatctcctaatagtctgtcccaaagttaaaaaatttagagctattcacaatatcaggttggaacatattaaactactgttattcaaccatttttgatttacaaaattgttagcctcaccagggacggtggctcatgcctgtaatcctagcactttggaaggccaaggtgggcagattgcctgagctcaggagttcaagaccagcctgggaaacacagtgaaacttcatctctactaaaatacaaaaaattagccgggcgtggcagtgtgcgcctgtgatcccagctactcaggaggctgagacaggagaatcacttgaacccgggaggcggaggttgcagtgagcggagatcgcaccactgtactccagcctgggtgacagagcaacaacaacaacaaaaaattgttagcttcatatagttcaatccaacatcattactgtcatctttgattagttctgaacagaattaaggaatttcagtctaaggaaatgaggctgggcgcggtggctcatgcctataatcccagaactttggaggactgaggtaggcagatcacctgaggtcaggagtttgaggccagcctgaccaacatggtgaaaccctgtatctactaaaaatacaaaaatttgccagacgtggtggcgggggcttgtggtcccagctactcgggaggctgaggcaggagaatcacttgaacccaggaggcaaaggttgcaatgagccaagatggcaccactgcactccagcctgggtgacagagctagactccatctcacaaaaaaaaaaaaaaaaaaagaaaaagaaaaagaaaaaagaaaatactactgaagcctctcttagtcttcaagtagagaaaacaagataccacaaaattgaaaatcaatccaagtctttcagtagagcataaagctttagttgtttcgtcattcacagatcaaactagacatttgttggacaaacagtctgtttccaagcaaaataccagataactcagtcaggttcagtattttcttgatatactttacaaaatggaaaccacaataatattattaaaataaagcaggacctcacacattgttgaaatagattatatgtggtttaataacctatagtaatgtatttttttaatctaaaatagccagtttcaggtatcatgaaccagcaagtagaacaccatggaggttattgtgctaagttgagctaccaaagtttaacttgtattttccacgactgagaccttaaagaaacctggaaatattgaaccttccagaaagggcagttcagatactcagggagtgagtgtgcttcttattaaaagcacaagggctctccaacttttgaaaactatggttctctgacaaaattcaagtattaaacttaaaaatagaattaatgagcacttactaaaatggaagttccacaaaggcacgaactttgtctgccttcttcacttctgtatctacagcatctcagataggtaggcaatgaatgtatagaaggccagaaggtagaataaaggaagagagggacagggaaaaggaaagacagaagggagattaatgctgattctttttcaatccttgggattattttttttcttttgtgtcagcagtcatcttttgccatacttatagcaaagaggaatacggttaataattaacagttataatacagttattttgctaaaacatggtccttactctgttactattactacaatttgttaaaattgagagatcagataaagtatataaattttttttaaaacaatgtacataaatacacttataaacctcagtggctatgtagaaagataatctgaggaaatgagattttaagcataatattgaccagctaattctcaattaacctgacataaaaagaaatgataaataaataagtttgtaaacaaaaaaactcatatatttctgcatatgggtggaggagagagaatataaataattttacttaatttcacccactaagtaatttagaatcagcattttggagttgaaaggagatgtgaagtgttaccaggtgcaagccctcatcttatcatttgacaactgaagtctagagaatcgaaacgctttttccagaatgacaaagctgtaacttgaatctcacttgcataacctccatctcagttgcataacttccagttcaaaatgcacacaattctttttcaattattcacattagcaaatattctaaataaaaactcagtagaaatgcagccatgattggcaatcaggagagaaagatgacttttttgatcactgatttcttctttcttagagaacacgtgcccccattacacagtttacattattgagataatcttacctgttttgcacattggacattggtattggaaagcaaaatgaaaattataattttgtacgtgagaacatgcaatagagagtgagaattattgtaattctgtggtgggaatgaaactaatgataaatcaatgacatttaaatgctaggtacttcaaactttcattacctttaatcatctttttacttctttcttccatttaggattctagttttattaggatccataaagtgatgaaagtcttaaacttcacaacgaaagctaaagatctgcacctttctgatgtctttttgaaagcacttaaccatctgcctctagaatacaactctgctttgtacagccgaatattcgatgactttgggactcattacttcacctctggctccctgggaggcgtgtatgaccttctctatcagtttagcagtgaggaactaaagaactcaggtaactttcttcagtcctcactctttttaactggtatgatagcatgcaatacatttttctcttactctatcattttaattattctgctttgactttatttagatcctgctttatttccaaaatgatatgaagaatgataaaaaatacacattcaaataaataaaacaaaaatagaaaactaagaccaaaaaataaagaaaaataagtatgcttaaccactgtgattttaggcatcatatttgtctctaaatttcctaacatctgggaacatcataagcttacacagtagtggttacccaaagaggaagatgcatgccaatatctcaagggaaaccaactttgtactggcactaaattctaaaagataatttatgaataacatttttataggatataatttcataaagcaataccttataacgaattaaatagcaattttttcctgtaataattttaactacaagccaagatgaaacatatgatgaaagaaaagttaaaaacttgacaagcgactaagctagagtgggccagatgagcacttactggtgatgaaacctgaaactaaatgcaaaagatttgcgttattgtaggctttccacactgcctgcatgctttatgtttcctttcagttatcctttccactggagtaactcttgcatgtgaatttgatgtcttctgctactgcaaatagtatcaacactaatgctgagcagaagtaattaggggaaatctctgctcttgacttggttttgtctcaccctcagaagaaattattctggtcacttctgctatagcccagaaaataatttcccacttgatgagtataatcctcatgcattcagagcagagcccctaaatgcttagggatcaggtcagttgagaactgggtgaatctttaatcaactattagttaaagccccatcaccaaaatgaagagtgatgagctatactttcctacggaaaccttctcacattccatctctttctctgtagaggtagagactgacagttacatataatgaaggaaagaaaaggagtttgggatgtgataggaaattccaaataaatacccatgcatatccatatatacatgcatgcacacagtacatacatacacacacatacactgtatgcatgtattgacagtgtgtctatatatgcatatatatgtgtgtatatatattcagtaagatgtattctggatgtgaggatgatctagctgtgacatctgtcacttctttgatcgccagggttgatttggctgatctggctggctggatgggtgtccccttcctccctcaccactttatgtgtgtccctccaaagctgcatgctcagtcaaagaggatgaccacctccaacagaggaggactggtcttaggtcaagggtatatgagtagctgcactcccctgctagaacctccaaacaagctctcagtaagatgtattcgatattcttgtattcaataagtttatatggaataatttatctgtaaaattttaattgttgttaaaatgaagcacacccagacagaaatgacttctcaagaaaatgaaattctccagttcatgtgcttacctggctttcccaactctctagataaatatgtattctggcctcttcccttttctctcctcctattctctctccctttacctcatcataacatgaaactaaagtatagatttaatttttgctatgccttattcaataagaattatatcccctgttgttaatttttgaaaaatgacttgaatatttcatagtactttctttccctcaagaaaaagaaaacaaaattaaattgccttttatttgcatgcattgatttatttctctattgttcaatgtcccatagtcaagttaaaaccttgaataaaagttggcattgcttcagtgtgcaaggtgaaaagagtttcataaacacagtgaaaacatcaaacaataaaaatatcctaatatgcaagaggataattttaaactccttttattgggaagtcatcttctacactgaattggaggttaaaaattattcaccacactacttactaatgtgaaattttcaactaacactcctgtcttttacgcatcagggtagctaaagacattactgaaatactcattcctgtgctccacagcagaggaacactgaggtttaagagatgaggtactgcagtatcaagtagcttgttagttcatacagatagaggtccagcagcaaaaagctggacatactgcagggaagaaaaggattgcacagaaattcattgataaagtccagatattttaatcactgcatgaccaatgtcataaaaaatattcatcattcaaatctttgaagattcatctatagccctcaaaaatgaaattaagtttatagttaattcattatgttatagttaattaactggacacatacaatttaattattacttataaataataagagcctaaagaatggttaagaaaaggagtcatgcactataaatgcattacattcgtagtatggcctaaatatttgactaacccacttataaaaacaatcctactagaagaaaaatgaattatatttattcaaccagactgaaacaaccatctttttgttagggttgaatatgcaaactaagcatgagggcttcaaaccaagaattttttactcccaaataacaatgcatctcttcaaaactgtcacaaaaaatgaggtagacaggcccagttcacatctacccagcctcatttctcagcgatctatgccttcagatttccatttcaatatcacacctaatcagaacctcaagctctaaaaacacccatccctgctattatgacctgcaaccccaaatactagtatttgataacctactttgcttttaggtgcttaagagcttatattaacagctctacctctcatgtgctcgtattctgcaaggcaaattttaactaaacatcaaaagagctggattttagttttgatgtttccagcagtgagtcaggtgcctggggaagctgttaagaaaaagaaaatgttgatttccctcaattaccccagatagtactaactcagcctacaaaaatactacatctgtttccctgcactcttccactaacacacagattctgaggccattgagaatgatcacaggactgtggtgggagtggttcagatgcccaaatcttcaacaaatgatgctagagagtttgataaaggagaataatgaggactaaaggtattaaaaccggatggctgagcctcagagcatcaaggttttcgcaggttataagaccatggggagtcatccaatgaaagcagcagtgagaaactaggaagatatcattcccaattcccatacatgaatggggtgagaatgtggccttttgaacttctgctggagatgacagtggaaacagtatcaagtacaggcttgaattaacatgaagagatagaatagccaaggaggagtctgaaaataattcataggtcaggaagtcagaatttctgagattacaataaaaaggatttggaggtaggggctgagtgagcaggtgaattaaggagaagaagcccagagaggtatgagaatgagtgttcacggaagaagcatggccaagaagatttgcattttaggtgacaaacagggaagcaattgaagtggactcaggtctcacagaatcagcagtggcccggaaagtaggtcttggagtagagaacagatcagagcacgtcataatcttttgatttgcagggctacacagtgcagcggccaatagaaagggagagcttaaagctccattgtgttaagtggcaacaagtggcaggcaacaaggacaggacatcaccatccccatgggaagggccaaaatggctcatatgtgcttctgagggtcagtgctgaaaggggagatgatgggcactcacgggactcctgttcaggatcatctctgggcccatgcaggattgaatctataggtaaaactaacttgagctgtcacttaagattatggggactggggaagagaggggctaatataaagtatctgtagatccgaagtgaccagagcaccatgttcctctttgaattgtcaatggtgcattctcagtggtttctgtttgtacttcatctcctaggtttaaccgaggaagaagccaaacactgtgtcaggattgaaacaaagaaacgcgttttatttgctaagaaaacaaaagtggaacataggtgcaccaccaacaagctgtcagagaaacatgaaggtaacagtactctctcttagcagcttatccagtgtgccctgagcctggctgtcatttacagaccatattggatgtgactgtgctatttttagcttttcatttatttcatttctcttcctcagaaccctgtgtgttggaataggggatacaaataaaatagcattagcattacctaaaaaaggaaattgttaaggttttctttatctcatacttaggctgtttaatgaataatttattgattttgctcatggacagaactcaatattaggcattgtgaagtgcatatggctgtgaaccaggaccttacaaagtaaagaaacatataaacatccattaaaaatacagactgacaagggtctaagagaggtatagtttctaaaaggctataaaggactatgggcagaagaaaatcctgggattgaaatacatcagattttgtgaaaagaattattttggggccatgcattaaaaatggctgaagactttggcaaatggaaagagtgagaaagaaaatccaggcaaaaaaatactgaaaaaagaagatacaagttatgttttgcagaatgatcttactccttcccaattttagccactgctttcactcttctatcccaatccccaatcccaataggctttcacttttctatcccaatccccaacccagacatcccttctgaactccagacatctactgtccactaaacatctctaccggaaagtctataggctacaatgcttcacatattctctccctgctgctgttggttctcactcatatctaatagcatagcctttacattatagcccagtaggactgttgtgaagactaagtgacatggtgtttataaggagccttgcagagtgaccagcagtggttggctcctttcacctttcctctccttcagcagtcccagccttgatgatggcatcaccgtcaactaaatcagccaaaccagaaacctggctgctgtccttgattctaccctctttctatatctaataagtaaccatgcacaattcattctacctcctgaatgtctctgcaagttgtcttcctctttttatttccatggatataaaaccttcaatggaaggcaaactttccattcagtatttccaacctggattatcttagaagccccctaagtggtcttcctgcttgtagtctgttttattccagtctactctacacattttattgagaggaatcttctctatggaaaatcttattcatgaaaccttcatacttagaacatgtcaggtttcacatggccttaagcataagttcctgtccttctctgcacagctaaactttatacagcctcctaaacaagtcatgctctctcctatgccttgccattataaataactccttcctctctgtaaaattctgtttccttattttgcttgactacttagaataaagggaagcagaatcacagacattcccaaatttgaagcttaccttctcatggagaagacagacaagaaacaaataaaatataatatttactataataataaacagataattttaaatatgatatcagaacaggtagatggtctacatacacatgactgtgttatgcataagcaaaatgagaagaactggcttgacaactgcacactccttatagcaaagaagaaaaagagggcacaaaggcatatagcatgcaaagcaaataatctggtaatattaaccaaaatatgaatacagattctatatcagtttatcatgtagtaaaataatttaataagaatatgagttcaataaatcaagaactcagagatagacagattaaatacaagaattaattaaaacagatttcaaagctaaggtacaaaaacaaacattgagaaacataatcattataattataaataaattatacaatgcaaggacaaaatataattctttaaaaataaaattaataaaattaatcacatacaagaaagatatcaagtaatctcaacatggaaaaacatttagatattattaaagaaaatttgatggaaatggaatgacaaatgtaatttaatatgtgaaaattagtatccgtgaaaaagagatctcagtaaatgaaatagaaaaactgtatttttaaaaaatgttatataagaatatgtctctgaaataaaggaagaattttttcttgattatatacagggaaatattgttcaaatatgcaacttcaagacaaattctagaaatacagtattaagtcctactggaaaaaaactactcaactataaaatctatgcaacaaagacatgaatgaaaaaccaattggaataattcagatgttcaaagctaggatattttaatggaacttaacatagctttctgatatggtttggatttgtatcccttcccatatctcatttagaattgtaatccccaatgttggaggaggggtctggtgggaggtgactggatcattggggcagaattcctccctgctgttctcgtgatagtgagttcttatgagatctggttgtttaaaagtatgcagcactttccccttcaccctcctcctaccactccagtcatgtaggacgtgactccttcctcttcaccttctgccatgattgcaagtttcccgaggcctcccctgccaggcttcctgtacagcctgtggaacggtgacccaattaaacctcttttctttataaattacccagtctcaggtagttctttattgcaatgaaagaatgaactgatatactctcaaattcctatttcttctaagtggtaaaaagtataaaattgccagtgtaatgtaacccagccgttctgggtttcagttttcaattttcagtcaaactcaggattccctcacctttctcctttgctgcttgtcagggataatttaagagtgcgtgtgtgtgtgtgcctgtgtgtgtgtgcgtatgtgtgtatgtacacatgcacatgcatatgcatatgcatatgtgttggggaagggtggccagatagtatcctagagtcacagggagaatgagacctttgttagcatgtttctctttgccttggctagcctcatctgataggtcatttgcctcctctggttctcacaatcatgcactggcacctattgccaatgttgatggtcctgccttggcttttggttactagatccatatcctttgaatcttcctcacaaaaaggccaggccatcttttgtctaccactctttctcaagactttctcaccttcttcaggctttagggaacccttgcctgttttctgtacatcacagtgaaatgtgagggccttgagactactaaggaactacttgcttgggtgccatgttggatacaaaagattctctacaaggcttgccattcccttcctactacttgagaagattaaatgtacatgagaggacttcaaaaagttcacagggaactggaagtaaaagataaaaatagaaaatataaactttatttatcaacataagtttcatcaagttgacacatttgttagcaatgatgccagccatttagtccatccgtaaggaactgagggtcctaggactttaactgtgtcaatgcaatcttcttcacattaataactgaaaaaaagggtgccctttaaagacatttttaagattagaaaacaaaagaagtcagaaggagtcaaagaaagactgtaaggtgaatatctaataatttctcatctaaaaaattgcccttgtttgattagaggaatgagtaggagcatcgtcacagtagagaaggtgtccctggtaaagctttcctgggcatttttctgctaaaagtttggctgtctcaaaacactctcataatatgttattattctttgaccctccagaaaatcaacaagcaaaatgcctcgagcatcccacaaaaccatttccaagacctttgctcttgactaggccatttttgctttggctggcccacttccacctcttggtagccattactttgatagtgctttgtcttcaggaccatactagtaaatccatttttcatctcctgtgtacatttcttttttaaaagtgcttcaggatctgatcctacatgtttaaaatttttattgaaagctctgctcttgtctgcagctgatctggacacagtagttttggcagctattgagtggaaagtttgctcatctttaatttttcagttatgattgtgtaaactgaactaattaagatttctacagtgttggctcttgttcccactgttaatcatcagtcttcttcaattagggcaggaataaggtaaattttttcctcacaaattcatgtagatggtctactgctaggagttttctcttcaacattatttcttcccttcctacaatgagttatgaatctgtaaactgctgattgccttgaagtattgtccccataaacttttcctaaggcatcagtgatttcaccattcttcctcccaagcttcaccataaatttgatgtttggtcttacttctattttagcaaatttcaagttgctctgatagggactcttttcaaactgatgtcttatccctctttgtgcctcaagcttgatcctattcagctatgttatgataagttagtatgagtttatttttgtgcaaaaaaatttgaaagctatgcatttttttcataatacacattttccattaacttattgcagagcctcttatgagcttctatcaaacttctacttgtcaaactattatttccaagattttccccaaagtggtggaatcttaggcctgcactaaggaatccatcaagtctatattttagttaccacatgtccaatattcccccattctcccagctgctcaaaatctttcctacttttgagaaggaaaatggctgttgtatacattttttatcattctgtggttgatgttgtaaattctgtgattctgaatcctaaaatgtgtggctcttgatattttagttcaagcattaaggactcaagaattctttttctctctcaagagcctggcccttgacattaaaaaccctagccttcaaatctatgatttttgctagatttataaaagtatacttgagatctcgaaagacaaaattttgctctttttctctcttgactctctccagcctgaggctgtatatatagaaagcccatgattcagcttcaattatgagagaaataatagagataaagaaaatataaaaacacataaaaaaattaatattaaaacattaatccaacagataaatatagagcccaggagtaaagaaacagtgagcaaagatgaagcaatgagaactggattcatttactgtataaaactaagactaaacaacaaggggaataattattgtgcttttctgcattgcttaagtgttaaatatgctaaagatgtaatagctattttgaagtaacaaaatcttgaaattgtaatttcaaaattgaaaaatttcaaaattgaaatttttagcagacagtccaagaagtcttacctgattaccatctctattgttgttcataattaaggttaggtgccctcctagacgtactcactgcaacctgcattcacaacatcatagcactcatcacactgtattatgtttactttctatttcctccacagtatgcaaattcaggacagtgacatggtctttatgtcctcagtacttcgtaccatgtttagcacattataaatgtttaatagatgtgctcattgaacacatgaatgcttgaaagaataaatgaatgggtaattaacatttattgaactcttgctatgctccaggcactgtcctaagtgttctgtgtgtgttaacttctaattctcacaacaaccccatgagactggtacaattattacccccattttatagatgaggacacagaggcatagagaggaaaagaatgaatgtgtaaatgaataaatgagtatttctatttagcttgagcataaatttgtgaaataaagctgacaaggtaggtttagtccatacaaaacagggcttgtatgccttactaaaaaaattagacttaatcctattaaatattgtcactatcccacatatcatctacagaatgttaataggtgctgcatgtgaaaagggagttccatctttaaattgaaaaactttgagtgtaacagtgtttaagagaaattctcagcttttaaaattataaagaacattgtagttttttaagaagctgatatactatgcagttttcccctaaaataccttgccaagaaattcacagacttactattgagcagaacactttactggattgattcagtgggaaagcagtaaaaattaccaagtaggaaagtaaaatgttatttatagaaattatttcatgctgtgatgtattaagttcattgcatatcgcctaaattttcaggctagattatattcaagtgttggctccactgttgattggctatgtaatcaacatcaagagtttaatctttcttcttgtaagtaaaataaaaataataatagtatttacttatgcttattgtgagaattaaataaacaatccatataaattgatgaggacaaagcctaggctatactaaatattcaatacatgtctgctataattattttgtagttgcacaagtgacatgtagtaaagacatataatataggaaaattgtagttgaaattgtaaaataagcaaaaatatagaataagcccttcacaaaagaacatattttaaaaagcaataaacatgaaaatatgataaagataactgggaatcaaaaggataaaattaaaaccataaaataccacctcatgcaaatgatgaaaaaatttaaattaacaagtattggcagtagaacttcacaacctgccatacattgctggtaggagtataaattggtaataccattttggaaactatttggcaatatctactaaagtgaaacataaatgcacgcacacatatttatgacttagaaactctactaatagatatgcgccaacaaaaatatgcacacacatggatcaaaaataagaaaagccacattgttcatttattggatacaactcaaatgtctatcaagagtaaaatgagcaaattatgatatgaattaactactactacaaacaagatagatgaatgccacaaacataaaactgagcaaaagaaaccaggcacaaaagagtacatgttttaaaaccttacatataaagttaaaaatatgcaaagctaatctatagcaataataatacaattggcgtttgcatttggggatggaataatgactggataaaagcatgaaggaggctttccggtgttgctagagttctatttccaggcgtgggcagtgattatatgggtgtgctcactttttacaaattaattgagctgtatgcttaatgatttatgtacatttctgtgtcaatattatacttcagtataaaaatttacttaaaatataagaaaatactagactggaatcagggcaacttaggaaactgagttaatgtagaggaattgacatgagaaaatatcacatatggaccccagttttcagcctgtaggaacaagaggacattgcaaagttagagaccgttgcaataggctccaagctggcttttcaattacccattgctacccagatgacacaatactgctaatattcctgaatcattttaaatccccacctcaaaacctttcattgtttctagggaatgcaattgtttctaaacctgaagaatgaagtctaatttccttggctttacatccagactctctcatttctgctgttcttccccctccctggaccttccatttcaactcaaactcatgcctatatgtgctgtctccagagcatggcacaacggccctgactccaggtccttgcccatggtgtgcccatgcttagaaggccattgtctccctaatattagggccatgatctccctaataggtctcacctttccttccaggaacatgtcagtcttccttcagagcgccatcctccttaattgccaaagatgacagaattatttcattttcctaactcagtaattgttcattgtttttaccattgagtaatactaagcaaaaactattttattggtctttttaatttcctttcttttcttccattttccctccctctctccctccctcccccctttctaccttccttcctttcttcttttccatccttgtttatttctccatagtcttgctagcatatttatatacctattccatatactcattgagagtctgagttcttaacacgatattttatatttatctgggcctgacatatagaagattctcaacaaattattgatgacaatttgcctaaagtcaaagtcacagacacattgaagagcaaaacacacacaagaacatagatttgcctatttctaaccctgagctatttcagttaaatcattggacttcagacttctcaaatctgtaattatatcatttttaaaattttttgaggatatatcactaatttatacatttttactaaagaattgtagaaatgtattattcaaaaatgtgcattaaaatatgcaaatgtaaaaaatggaaattgttttttaaatagcatatatgaaacaaacagaacttttatcttcctcatagtagtggctgcacacacttaaaaacaaagttcaggctgggcgcagtggctcacacctgtaatcccagcactttgggaggccaaggcaggcagatcacaagattaggagaccaagaccatcctggccaacgtggtgaaaccctgtctctactaaaaatatgaaaattagctaggcctggtgacgcatgcctgtaatcccatctacttgggaggctgaggcaggagaatcacttgaacccaggaggcagaggctgcagtgagctaagatcgcaccaatgcattccagcctgggcggcagagcgagacctctatctcaaaaaaaaaaaaaaaaaaagttcattgataaatacatatattacaaaagtttcttgaaatttttgacatgcttttggtcagctttggtgttcatcttacgatgtggcttctgagaagattgtataagtagaaatattcattctgtcttttactagtttttttttttcttttgtttgcattattggcattatcttcaatctgcattttctttctggaatctttttaaggcacttgctcacttgtgagagtaagctaatggaacagtaaacagacttactctttcttcaggatcccatgcccctcacagataacccttaccagtgtcaatccatttatgaaatacatggtatcaatctaaatatgaaataacatgacgaagccactgtcagtctgtacatgatatattggcaaactctaatttggcttctacttttccatgaaaaataaatacaaaaacctctaaaattttccttgtatacctttgttttgttacgccttatacctgtgttgtgttatgcacttgactctaaaagcagccatactactttcttcataggaagacagttgcatccatttcctaatcattctagactatcttactatagaattgctaaatagtgggatcatagctaattcttactgatagacaccaaattaatgccactaactatcgctcatatcactagccttctttttatttgctactatttcttatggcaattccttattactcagtctctatccctgttagttagagttaccatttggttagtggaaattgttatggcaatttgtataaaagagttgtgctatatactttaacagtaaatgtcattgtgtctaaagaaacattgtgccaactcttaacctgatgggggtttttttctgtgttagttgtgctttcacctctgtctttaaatataaaatcattccaccattttttccctgtaattgggaagtttcaccatgacagtcaattgactggctatcagaagccatgtgacttatcttattctgggcacccaaaacatatgctaacataaatcagaagcagggcggttgacattaaagagtaaggggcagagtagtcaaggactgggctatatttgcatcctagtcctgtctcttagtaaccatgtgttccaggacaaattactttcggcttcaatgtttataataatacctacttctcagggttgtcatgagaattatataagatgtgtgtaaagtgcctggcatctaccagatgcttaataaatggtagctgttagtactgttattattatttctattattaaactccctacagggaggaggagtgttctcttgctttttcacttagctttcttaatggagctacatactgtaccatctacttctcccttctgtacaaataggtttttgtttgtttgttttagaataggaatttgcactaaaattaaatgggcatttttattgaaacaccttgcaggttcatttatacagggagcagagaaatccatatccctgattcgaggtggaaggagtgaatatggagcagctttggcatgggagaaagggagctctggtctggaggagaagacattttctgagtggttagaatcagtgaaggaaaatcctgctgtgattgactttgaggtaagagtaaaaattattccaggtaagagatctaaagtagttctctagcagcccaaattgcacatcacacaatttattttccattttcttctcagacaatgaaagaaatgcctttctttagtattcatgcacaatgtacctttttttaaatgttaaattgcatgtctaatgcgtttgctattcaaacaagcattcaacagtacagtatttagaattcctagcatgcatgaaacaccaggaaatggaacttagtgaataaaaatgctcaaacttgccttgagtagtactttttattttttcatgtatacaataaatctggtttctgtgttcttcttgcaactccttatttgatgaacactcctaagtcttcatttgtagctctgtgagataaatgagattttagatccatttctattactattgattgaatttaccagttttgtatttgttgtaattacattaaaaggtgatatttattatttatggaatactttacccacgtatcagccatatgccatttagaacctgttttcccccaaacatatccatatttttaaaaggcctccaaagaagctgttatgttcatttcatttaaatgaagataaaaggtttcaatcattatgaaaatagaatcatttgcctgcagcgtgaagatgtgttgagctctacatgttatgggagaaaaatgagacccagctgcccctccgggtacttgcaagtcatattgcactagaaggtcatttctttgaggttttatgatgttaataaaatgagcactgatttatcattagcctattatttgttactgtaattcttccattcatcctactggcaagtttatttcttcattttctcccactccacattttctcatctaactccaacaaaagccaaaactgtcctggaaaaaaagaacatggaaagcttctcttatcctctctaaattttttgctgcttgaatcaaatttaatgaggtttcagtagagcaggaaagagttgcctaactcttggtcacctatctcagtgctttgatgcatgcatagaatacttaataaataacatgatatataaccaagtaagcaacacctcccatgcttccttcacagtaaaattgtagggaaggtaagtgccatatacatcacacctgtccacaggtagaaggcttttgcctactggttcaacaggtgcaatactatattctgcaataatccctttgaagtgtaaaattttcaggctttccctctcatttcagagaactgggcagtaatggcaacctattaccaaaggggatgtgactggacctcctctctcccattttctcctagcttgcccccatcgtggacttggtaagaaacatcccctgtgcagtgacaaaacggaacaacctcaggaaagctttgcaagagtatgcagccaagttcgatccttgccagtgtgctccatgccctaataatggccgacccaccctctcagggactgaatgtctgtgtgtgtgtcagagtggcacctatggtgagaactgtgagaaacagtctccagattataaatccagtaagtatcaggaatctattgtgaggtagataagttttcccctccaaagagtattctaagttggtcaattaaaaagaaacaaaacttctattagcaacctccaccttgtacaggctcagagggaagataaacctgcaaaaagtgtgagtctcagctgtaacctaccaactatgtgagcttgggaaagttacccagcttccctatgcctcaatctgttcatccataaaatgaggataacaccagtatctatctaaggaatatgaatatattatatgcgtatttatatatcaagaatacatatacaatgctcataacataaaaaatcaaacataacatcaaataaaatatatgattctgatattataagcctcttatgtattgtaatatagaaggatggctttgtaataaaaaataaattaagccacaaccaaagttttcatacaggactaagtatgttcatagttacctcaaatcctccttagaaacagggtaaggcatgggagtaagaatgtatactacttcctttaaaagtgtaatttaatatgcattctgttaagaagatgtttatatttatacacatatgagtgcacatttttaaaaggcctccaaagccaagaatacagaggtttcttaacagttgaaaataattcataatgattgccatttgttgccattttatttaggcttatgggaacaaagtctaaaaggaaatcaggcaatgtgtcaggccccttgcacaggtaatttcttttaatccttagaagaaccctatcatatcccacaaaggaagttactgagctaaaaagtgaggaaaccaggttggcctcacttccaaacccaaattcagctgcaccatgatccatgggagtgagtcttcctttgttccagatgcagtagacggacagtggggttgttggtcttcctggagtacctgtgatgctacttataagagatcgagaacccgagaatgcaataatcctgccccccaacgaggagggaaacgctgtgagggggagaagcgacaagaggaagactgcacattttcaatcatggaaaacaagtaaggccgggtaagggaaaagaatgggtcattttgccctaactctcaataacattgagagttcaaatggttattagtctactgctaagtaaagaaataattagaactttacctatgccaacacagaatattaatgagccactgggtctactgccgtgcctttttctgtgtgtaatgttttctatttaatacatatatgtatgcaatgtgtacacatgtatacacataagcatatacacacatgtaaatgtgtgtacatacatacatatacacacatatttatgtttcccttttagtggacaaccatgtatcaatgatgatgaagaaatgaaagaggtcgatcttcctgagatagaagcagattccgggtgtcctcagccagttcctccagaaaatggatttatccgggtcagcatcctaaacctcacttttggtttgtagttttaaaaacctcgaaaagtatagcttgtcttttaattagagttactgttttcctattcgaataatctcctgttgactttaaaagtacaaaataatatttagaaacactttgccactcttccatcttgaatttcctagagatgtcttcatagccagttgttagactaaaggatagcagattgcttgggtttcttggaaaggtaatagaacttcagtataatataggattgtatgacttgtgagaatttgcaagtaagatctggctatttcagagtctgagcaaactgatacccttacctaaggaatgtttagagaaacacactagactggctataatcatggaggtgttaattctgtattgtttttattaggttagaaacctgtagaactcttaatcagtcaaaaccattttcacatacctttaagtttcaacttttttttttaccaagccacaacatgtttctatgatttttttaaaagctgaatacattttgtcagacagatctatgccctttgacataaattttacaggtgatacatgatatctaaaagtgatcacagaagtcatgcttcctatttcattttacctttcttaaacttagtaatatctttacattaatcttttcccaactgtatcacacttatgataaaagatcaataacactcaattctctaagtccagcaaatagttttattcatggagtgtagtctgggctaatgtatcttccatattcacttatcttctgcccatgcataaggaccataccttaaagtttatggggaggaaatatttcagaggaaggtaattttaattagtctttactctagaaaataggttctcaaactcaacaatgcgccaaaggacctggtaaaacacagatcattgggtctcactcctcgagtttctgatccagaaggttttgggaagggcacagaaatatccattgctaatacattcctaggtaatatggatgctgctggtttaggagccacactttgggaacaaattctcttgaacaagagccatcaatctatggcccaaaggccaaatttgacctgccacttaaaaaaaaataaagtcttatttttattggaacacagccacattcatatgtttacatatcgtctatggctactttcatacaataatggcagaagtgagtaatttcaacagatgccatatggcctacagatgactatccaggccacttatagaaaagcttactggcccctgccctagaacattatccttaaaatcacatattggcagatccagataccaaaataacttttaatctatttgttctggctgcatacaaagaccgttaaaattattgacattctcatttttaaaacacacgaaggctttcaacagtgatgcattattcttctaactcatttcgtaaggttagattatatattcccattttcatggataaattcatttcttattttattttgctctttactaaaggcctggtctctgtctggcaatagtttttactcaaatgtaataaaattttattttttcctaataagcatcttctggaatttctagtggcaaaatgccccttgtatagattcaaatagaggcagatatgcctaattccaggctagagcaatgatgttattgcacacaagtatatttatttaatgagtaacagacaagtccaacctctgtaagtgacagggacttttggcaaggttttttgtttagtcagtctactagatgtacttccctaagtttgattattgcaacatacacttatatgttacagattcataagaaacaagaaatagaaacaaaagtttaaggcaaaaatttatttcagaagaaatgcaagaaaaaatgtgcagcctttgaagaaaacatccaaatcattagtccatttcccttggaaacaaagccatatcagtaataaccaacagtaggatggtagttttgtatccagaaaattaagaatcttctaggagacaagtttaaccatatggccaagtaacaacataagctgacaattaagctttcaccgctctcaaagttcccaacttcaattctcagaagaacaactgcttagtcaattcttggtactcttgcccctctcagtaaaggaaaattgtattgcattactagctccttaagaaggataatgttttgtattctttcagcaaagaattaaggcctgtgtaaagatttatgagacagagatctggttgtggagttgccactaaaggatcaggggtggggctgataaacgtgataaacactataaaaatagagctttgcatgagtttccctcagaactgaaaggacgttgtacctcaagatactagggaaatcaaagatttttgcaaaggatgttctatttgagctgggtcttgagagaagggaagagagaaggtgttgaggatacaagaaacaaccaagtggagacatggaggcatgaaaaagaagtttatgttcgaagaatggcagggttttgttttgctagagcataggttttatgggaggaaatggcaggaggtgagggtggtaaagtaagttaaaataaatattccaaactaagaagtctaagacccactttaccttgaaaattgtagtgaatcacccccaccccccagcaacatgaaggtagttgtacaatccattaattgggaaaatatataatgaccaatgggttactaggaattgagtaacatttttaaatgatctgcactcagtcataatagcaactgcatatgtttgctttatatgtaagatatattatttattcagtttatagtcactacatggtgagtatatggtttttctattctagcaatagtaggacatcccatatatagttttttggtttcttctattttttttttgttttgggtttttgtttgtttgtttgttttttggtttttgttttgagacaggatttcactctgttgcccacgctgaagtacaatggaacaatcatggctcaccacagcctcaaccttctgggctcaagcaatcctcccacttcagcctcccaagtagctgggaccacaggccatgccaccacttctcgctacttttctgtatttttgtggagacagaaaatactgtctggctacttttttgtatttttgtattttgtgggttttgccatattgccccagctggtctcgaactcctgaactcaagtgatccatgtgcctcagcctctcaaagtgttgggattatagtcacaagccaccattcccagcaggggagcaagttttcaagttaaaaaaacaaacaaacaaaaccctaaccaatttagggagatggattagaagagtgaccagttataaagttgccctagtaagaaagaataaatatcatgaagaaaaacaatgatggcaacaggaagcagagaactttaacaggtttttagaagtagaaattgagaggacttggtgactgagtagatccagaagtgaaggatagaaaggatcagtgtgagactaaagagtttagagagtgttattcatagcattaataatttctggtttctgctttaattaagaatgaaaagcaactatacttggttggagaagatgttgaaatttcatgccttactggctttgaaactgttggataccagtacttcagatgcttaccagacgggacctggagacaaggggatgtggaatgccaacgtgagaactgggcaaacaattttgcttgactactttacagaatgaatgtgcccaatataaaaacagtaaaatcacatccttagatcaatacattttactagtttttagtaactctggtgaaagattttgtgaagcagaaaataaatagaagggctcatttgctaaaactggatttccagattatctccatatttcagtgttcctgctcctacctattactgtcacacacataggactgtgaagtatgcacttcaaaagaaatccaggaagtctgcaagctgtatctaaccacagacatctgctttgcccaatgttcaaattgacgcaaaatgctgagtctcaagaagatgatatttacactctttatgtaacagaaatgggaatttgtgtaagatgggattttgtgtaagacgtagttttcgccaagacactactccttggttcatgttcacattctttactgagaaagagtgaatgagctttaggctctgcacatatctgtgctagagtaaagtgaaaaacaagattcaaataaggcttgaatgagagtccaaagacttattgtgggagaccatgaagcagagttgagaccagtgtcaattagaatgcccatcactctgcatcagtcatagcgtggtaacttgcatttggagaaatccactagggataagagaaaagaaagtgtttcttgaaaggaaaaggtcccaatgatttcataaaagttggatgtgtctggagccagttctttagcaagggaatctcagataatgaaactaaagggaatttttcaatgaagggtctgagggaaagcccaggattcttatcccccaggttttctgatcaaaaggaggcaccaaagctgaacagatgcagtaaatctcatcaaaatcacctctttggttgcacaaaatttgcctaaatttgttgtttattctgctccactaaacacatatgaaatgttgctctcttgcagggacggagtgcatcaagccagttgtgcaggaagtcctgacaattacaccatttcagagattgtatagaattggtgaatccattgagctaacttgccccaaaggctttgttgttgctgggccatcaaggtacacatgccaggggaattcctggacaccacccatttcaaactctctcacctgtgaaaaaggtgagtagcagctcagtgttctggggtctgataaggtggtgcaccctgagattggtagtatagcctctatagccattatatttcttaagcactgagaggctaaaaaagatgcaagtttagacagtgtgggtcaaaccggaactatgcaatagctctgctaattccctaagctcattgccatcctgcgtcctttattctcttctgggcttttataacgtgtgaaagaaagggagaaagttaaccttttgaataaccttaaataaaattatcagtaaagcgatctcatggaaattagtgagaacttcaggtttaagtattgtgtcttggtttcactagactcctgatcataataataaattacaaggaatgtaagtgtcagtggaatgaatgtatgtggaagccatagacttcagaaagttaggatctttaagacactgtaggcagtatcctcataagggcatatgcatgcatgtgcacacacgtgcccttagattagaaattaaaattataatccaaactgagaaataggaaatgttccacagctagataaaggaaatacatagcctatttcatatactttctctccaataatattgacagaaagaccaataaggggagtcacagaaagagaaagacaatcataaataaaacccgacactgtgaggtaaagacactttcaggcagggaaacattattaattctttcaatgtgaaaaagttctgcttcatgaagatgtgagatgctacaccgttacttttttccttcctcccagacctggacacctcccttagcccttcagaggatcctcttgccctgagcactttacagactgtggagtatttgttgctcctgtgctgggaggtgtgggcagctgagtcccagcactgcttcaacctgaggctgattggaagagcagattccttgcataagatcattgacaatttcaaacctgtagtgatagaggaaggctgtgtgccacttgaaagctgaattgattctttttggaaacaatgtataccttgctgctcctcccaggcctaattacaaagggcaaagaggcacaggtaaacaatatcaccacaatgtaaaccatagtagctaaagccttaccggaaggataggtctccaagttcaggagagttccgggccaagtttcaccagataaaatggtggtaatagaaggaaaggaaaacaactgtgaataagaaacctaggaattttttacatctttatttttgcttcttacgtgagccacctttccttatcaaaccttctacttgataagctaagaggaggaagagtgagctgagcctccagtcctgccttgacaattaacttgctcacgaggtcattttggttcttgggatgcctgaatagtcagatccagatcaagaaaatgtgtttcattcaatagactgaggagttcggcttcaggtccaggttctctaggtgggcctcaacatgagcaaagaaaccaaggttccctctttcataaatacacccccagtgtcactccctctattttcatccccctccctcaccgacatgctattcagttcctcatcttggttcaagtgtaatttccttatgaatccttccctaatcttcccagttggagtctttatggtatgtggtctcctgaaaccatgttccctttcttcagaatacttgtctcagccctttattataaatccgttattataattacttgattaacatctgttttctctttcttttttcctctcctttcctctcctctcctccaccttcttccttccatccttcctttcttttttttttcccaccataatgtcctagtgcctagaatgccatgcagggattaatagctacatttaggagctgcatttctccactgattcttgtaagaaaatctgaatttcaagccattcacatccatattgctaaatctaatggactttttttttttttccttatcttctgtggcctttcggcagccttcagcaatgttgaccttctgcacatatgttctttccttggcttcatattcttgtttagctccgacatttctggctgttgccctctatttttggtaggctcctgccagtgcttggacattaatcactggagtttcccaagttttggatctgtcccctcgcctcacactgcactctcctactgaagaatctcatccacatgcatagcttcagtgattcccccatagacaaataacagatttaaatctttagcacagacttcgccactgagatttagacatgaatatctaaattcctatatatctacgttgtttggatgtcttaaagataccataaattcaacatctacagtagggaactcttaattcatcacccttccttcctaaaactaagcattttctaatattttctatttcaggtaaggcactaatgtatattcttttatgcaaatcagaaaccgaagaatcatataattgacagctctcataacttacataataggtaatatcacttgttttacctgctagctgtgtctcaagtttatccacttttctccatttccacctctggaaccttggtccaaattatcatcctctttcacctgaactaccacaataacctcatagattagctccctggagccctattgaccaccatgcctcttcaaatccattctctgcacagaagccataattaatttctttttttcaaaatcgagggctgattttgttacaccactccctgcttaaaacctatcagagactgtctactatttataaaatgaagacaaaacccttcaaagaccctattagcctcccacacagcctaccagacacctacctctctggccacatcttgttccatcctcttgtttttcagcacttcaaccacactgggttctttcagttccaggaaactcacatgctgcctgccttttttttttttttttagacagagtcttactctgttgcccaggctgggtgcagtggcacaatctcggctcactgcaacctctgcctcccgggttcaagtgactcttttgcctcagcctcctgagtagctgggactacaggtgcatgccaccatgccctgctaattttggtatttttagtacagatggggtttcgccatattgaccaggctgttctcgaactcctgaccttgtgatctgcctgcctcagcctcccaaaatgctgggattacaagcgtgagccactatgcccgaccactgcctcccatttgaacttttccataccttatgtttcctctgtattgaacagcctcacctttcttcattttactttttctaatctttctagctacatcaattttttattatatgcttctctttgatagccctaagaaaggcaacaattctatatttatattagtgtgctcatttgattaatgtctgtctgcacccacaagactataagcttggtgagcacaggatctgggtcagtttatgctcaatctactctctccagaaccttacagagtgatgagaatatcatgtatactcaataaatatttgaaaaacaaatgaacaaaaatttcaacagttccattttctttagttatctgaacataatcgcaattttaggttggaaaatgacacctcatgtgcactggaaaggacctttcaggtggaatatttaatgacaatgtatttagagaagccaaaatgaatgatctaactccaagagataaatatgaatcctttaccactgcctcttctctgaattcaagcttatcacttagaatccatgctgtgcactgttcttttctccttttttcttttgtttcagatactctaacaaaattaaaaggccattgtcagctgggacagaaacaatcaggatctgaatgcatttgtatgtctccagaagaagactgtaggtaagagataccctacagactgtgtctggaaattgggaaaaccagtctagtgtaaccaatttgatggaagagctgagctttttgaagcacagacatgaaataaatgaattttccacataactgatattcctgtgctctgctgaattcctccttccccattgggtagcaagtttcttaattatctctcagcccagttccctgtttaaaatgagattgttcattataacagtctcattttggttttaaagacttaacttctgcacatgtaaaaactttaaactcagttatatcaacactttcctgttcctctcactcaagcccagggcttggagtggggtggggaaaacaggcaaaagaaaactggttggtgagtgaacacactacattggctacgtgccccctgtttttttctgatcttcatatagaaatgcttgctttcctctcttgggcagccatcattcagaagatctctgtgtgtttgacacagactccaacgattactttacttcacccgcttgtaagtttttggctgagaaatgtttaaataatcagcaactccattttctacatattggttcctgccaagacggccgccagttagaatggggtcttgaaaggacaagactttcatccaacagcacaaagaaagaatcctgtggctatgacacctgctatgactgggaaaaatgttcaggtaagttccaatggtgaccatactaaatgctctcacttaaccttcatctcagctagtatatcatctttcttaaaaataacctatccttaatcaaaaataattcctttccattgtaaaaaaaattcataaaatgatttaaacagaaaggaaaattataatcacccacaagtagaaataactactgtagtaatgtggttgtatatcttgccaatcttttctctatgcatatgtaatcagtaccacccttaggccccagtgggaagagcacttgtcccgatctcgtgtttcaggcatccttccgagtcccagctttggagggccttcaccagaattgtctaagtttccttctagtgtttgggactgtctgaggccaatagtgctgtccaggtaggactggattttgcattgccaaagcatcttcctgaaatttctttcagtcttctttcagtgccttagtctagccaaggctgacaatactattcaggcaggacaccctgagcccagacagcatcccacatgaacccaggcactgttatactttccagctctctactgcttctcctccccaccatgcgtggggtcagccagatgccccaaagagctctggggctcatgcctgtggagtcatctctggcccagactagaccctcattctcagaaaacagcttggtgaacaaattgctgctgctagccagcagggcattcttgctcaagattgcttgaaattagaaagccagtatgatgctgacactctaatttggggtgactctaatagtttatagataagcaccccataaaaaaattggcccctgggtcttgaacatttcaggagtggccccgcatatactacaaatttttaaaatataaaatcggagcatactctacatgttattctatatattgctgttttttcacttactatgtcatggaactgtttccatgtcaacatatattattcggccacataattctcaatgtctgcaaaagtctatacgggtattctatgatttatttaaccaatctctggttaggcatttaaattttttctcctgtattttgctatcataaatagtgccatcatacctaaatctatcacaaataaatctgtgagctaagattacatccttcagatatagcttagaaagggacatttctaggtaaatattatttttaaattttttttattgatacaatatgttggctgcctatccagaaatgtttttgccatattatatttcctagaacatatagtaaagactgctttcccacactctcaccaaaccttggagttatcactcctttgtatctctgccaatttaatacttaaggagtagcattctatttccattttccctaagtttactggccatagacattacagttgtgaattatttcgaggcagggacttcacagcagtacatttgctccaagatgaagtttgaccctgaaatagcccaactaagctttatttctttttcaaaagacggattggagattacaacagaacccaaacagttagagatatttcctttgtggaacattttccaaaaaaattatcttaaattggagcataaagtatgcaaaggaatctttgctgaaaccaccttacttttgcaaaaagaaagacaaaaaccatattgttcctcttgactcttttttgactttgtggcccagtgttcttcagctcagtcctggaaaggggagaggtcttattactcaaaaccagttcttttccgatccacttaaggttgattatcaagcttcagctcccttgacaggccacaagattgaaacatgacagagggtggacatagctggcatctgatggtgacaactcaggatgccagtatctggggttttcaaccttcatgccatgtctaaacaaagcaattccatataagttacagaaaactagggcctgatatgcacgttgcttaattctaatcactattaaataactttttagacaaaaactctactattcatttttttgatgcttgatcaacaccattactcaactgacgtctcttgcaaacaataatctgtgatagaaaagagctgaaagtattatacaacatcatttttattttaaatatcaactttttatctgagaaatgtagtataagaacattattgtcaaaaatacatagagaaaataaaatttggtcagcagggaagttaagaactgttccctgactgtactgtaatagataggtcaggcatttggggctgtatttagtgttaccttccattcttccttatttatcatagagaagcagtcttcagagaactcttctattggaaataatttttttttttgctatcttccctttttttgctatcttcccacaaattttttttcaaatctgcctgagtgaaaaataacagtttacaattttatcgaaatacctgtctttactattaccgctttgctgtacacatatctaaatcctcacatacttgaggtgtttaactttgttttaaaaaaaaaagtactaaaaactgtgaaattaacagaatgctttgggtagtcaaactaatacatgaacacttcttaatagaagatatatttaggcaatttaaaatattttttggttctgcacacaatcaggaaactcaaagcatttttttcctctaaagatatgatctttctctgctagctttctttaattggtgagcaaaagtaaatgtcacagagggttctgtttggattagcactatagaaaagtatcaatatacaaatgatagcatttatgaagacagagaaagctaaaaatgtactttatacccaggccactcatgggaagttggaatattagtaattttcagttcaattgaatgtcactttgattaaactgtgttcttgattacattgtgctcttagctactcttttccttctctatctaaaatggaattttaaaaaactttaaaatagaacttcaaagtaatatgaaggtcacctttcaaaagttacaacatgaatgaaatcccccagaagcctattttatagatattaagtattttatctgaatttcagaaatatctaccaccaaccgacaggaacgggaaattttttcagccaacatccatttagcagccatgatgatggttttaagatgaggcaccctttttacccgtcaaatttttggaggagtaacattagacaataattacatgaatcactttagtgcaagtcaggatgtgataagagcattaagagagagaaatatcttctggtctggaagggtttcttaagtatagaagcgtgagaactgagtgttgaaggatgaattagtagaggtggtgggaagggtcttttggtgctggtagttctgaaaataattaagcaaagaacatttaagctatatccatactaaaagggtagtgaccatggcccttccaaaaacctaaggaactgatgtcctaaccagaggtggaatagtcccctgtctttcaccaaactccatcccttccatcaatggacaagaacattctttccaacaatgaacaagaatcttctctagctggttgatggagagcatagtacggaaatgcatgcttttccataaaatgtttcctaccaagggcaagatgcccaggcatgtggtgcatatgagtatctcctacttcctttccctatttttccccatcagttgagacacatgggaaagaatcgatgtctgcctaaaataagctattcattcatgacctcattgctaatactcacgctgactcaggtattttggcaacatgaattattccagatccattaaataaatttcttttttgtacacttatacctgcatgcacaattcagaatttcaagtcggttgatccagaagaattaattgagcgccttgttaagagttgataggacagatgagccacactgctctccaaaaaagcacttatcattgtcttggggaaaagacatatgaaaatctaactaataagaatgtatacaaaaatgtcagtttttgtaaaatgacaagtttacaccactaaaatttagctaaataaaagatctgctttagttcaaccattgtggaaagcagtgtggcgattcctcaaagaacttaaaacagaattccttgaaggacttaaaacataattaccatttgacccagcattcccattactgggtatatacccaaaggggtataaatcattctatcatagagatacatacacaggtattttattgtagcaccatttacattagcaaaggcatagactcaacctaaatacccatcaacaataaactgcataaagaaaatgtggtacaaatataccatggaatgctatgcagccataaaaaacaatgagatcatgtcttttgcagcaacatggatggagctggaagccattatcctaagcaaactaatacaagaacagaaaaccaaataccacgtgttcttacttgtaagcaggagctaaacaatgagaacatacggacacaaagaaataacagacaccagggccgacttgagggtggatagtgggagtagggagaggattaaaaaactacccatcatgcactatgcttattacctgggtgatgaaataatctgtacaccaaacccttatggattcaatttacctatataacaaacttaacacatgtatccctgaaactaaaataaaagttaagaaaaagaaaaaagagaaaatctggtcagacattgtggtccacgcctgtaatcccagcactttgggacaccaaggcaggaggatcagttgagctcaggagtttgagactagcctgggcaacataatgagaccctatctctacaaagagtaatagattaggtgagcatggttgggtgcacctgtagtcccagctacttgggtggctaaggtgggaggatctcttgaacctaggagttcgagggtgcagtgagccatgattgtgccattgcaccccagcctgggagacacagtaagaccctgtctcaaaaaaaaagaaaagaaacgatcaaaagatcagaatatggttatgttgctatgaaatgcttcattgaggaggcaagacttgtagaaactggacgtatggggagaagtaggaaagagcacatcagtctggcaaaagaggcagatgacataggagaaagaacaaaaactggagcacttttggggtcttgttggggaaacagacagttaaactacttgaaatggagaaagtaaaaaagataatgttgaaaatggaagttgaggccaaacagtggaagactttgacctttgactaaaacatacatgtagaatatatgagcctataaacctttgttcaaaattaatttgatatactcaactttggtaactttatctctaaatgattgttttaaacctatttcatgaacataagacttaaatgaattatgaagtgctttggtgattccaaaagcaggcctcataggagaatcactcaatttaactgcctactaaaaatacagatccccaggcataacccaataatattctagaaagaaagaaacaaatgtgatatggagttatgttaaagagctcaggcctgtgagtcatgtattatttaaatcctgcttctaccatttactaattgtgtggcaatgcgcaaagggcttacattctttgagctcagtttcctcttctgtagaattagtatgatagcctattcatatgtttgctgtaagggttcaaaaaaataaagcatgtaaagtgcttggcatattgtgtggcttcacagtacatgctctacaaatgataacgatgaatgtagttaggcaatgccaatgttaaaaataaaaataaaataaaacagaaaggacaggctgaagacattggagaaatggattgataggactagtgcctgattgaatgtaggcagtgagtaaaagggaggtgccagagatagtgcaaatcctcattggatgtggacagtgagacgggggaagtgccagaaataggccaactctttaagcttactggcttactagtgccctctagtctcttatatacagatctctctattcagtcacagttgggtctttggggtcattgcctttggtgggttgttttgttgtttttgttttgttttgtttttaatttttattttttggctttctcattcattagagaaagctttagaccaaacttaatttaacaccatcaaggagctcgccaccctggggatgatttagataaagccaaaccctaatgtactgtggtaagtcacactgtctctctctctctcattacagcctccacttccaaatgtgtctgcctattgcccccacagtgcttcaagggtggaaaccaactctactgtgtcaaaatgggatcatcaacaagtgagaaaacattgaacatctgtgaagtgggaactataagatgtgcaaacaggaagatggaaatactgcatcctggaaagtgtttggcctagcacaattactgctaggcccagcacaatgaacagatttaccatcccgaagaaccaactcctacaaatgagaattcttgcacaaacagcagactggcatgctcaaagttactgacaaaaattattttctgttagtttgagatcattattctcccctgactctcctgtttgggcatgtcttattcagttccagctcatgacgccctgtagcatacccctaggtaccaacttccacagcagtctcgtaaattctcctgttcacattgtacaaaaataatgtgacttctgaggcccttatgtagcctgtgacattaagcattctcacaattagaaataagaataaaacccataattttcttcaatgagttaataaacagaaatctccagaacctctgaaacacattcttgaagcccagctttcatatcttcattcaacaaataatttctgagtgtgtatacaggatgtcaagtactgaccaaagtcctgagaactcggcagataataaaacagacaaaagcctttgccttcatgaagcatacattcattcaggggtagacacacaaaaaatgaaataaacaggtaaaatatgtagcatgtttgatggtgataattgttttggagaaaatacaacacggaagggtgagtcccatccttaattatcatcttatgcaaggaaatattccataacaataaacatcgctgtaaggatgattgagctccagtggaaattatcttgtttaaagttgttaagaataaacttctggagttctattctctcagaaagtagaaaagagattccctttgcctcaactaaagtgcaccttaaagttttaggctgaagtgtgtgatggatagaaaattgtcagagaattttgaaggaataattttttaaggtaagtcatatcttttcattaggccatacaaagcagaaaccagtttattagcgaggctagggtgtcaattttaattggagaagagaggcatctttggagcagcagttctcaaatattagggtgcattagaatcacctagagggtgtgtgtgttcagatagatgcctggaaccaccccagtttctaactcagtagttctggggtggggcctgagaatgtgtgtttctaacagcattccaggtggtactgcttatgagcatcaggacatcacattttgagcataccgaatttagagatggagtcatcacacagctaactctgattaagtaattgatctcaaaaccatagccaacctccaagcaggtgagtggaagcagattcccttccagcaaaactcactgggatccccacctcttggaaggagtctatgagccacagctacctgccaaccccatccccagaccttatacatgcagctcctcctccatctcattgatcataggatgtccgcaaaatctaacatatattataatattaaaggagaagaatggggaatgaaaacacctataaacaaaaaaacattttcctggtgtaacagaggttgaccatgaccttttcttttcccaggagtcagtaacccatctatttcccagtcataccaccccactctcttctcactctaagtggtacaggccactcctgtaagcatcataagccttcagcacacccgagacatcagctgagagcaaagaagtattaaatactcccacatcctaaggagagtcactaacaattaaatcaataaactttccctaggattgaattggctctgtttgacccaactctcatgccagctctacaactttccaggctataaaatgggactagatgagtagggaaaggagtcatgggaatctgcagccacaggaatgcggcattcatagtggaagtcccgttcttctcctaagtccattctctccctttggtgaggaggaggaggaggatgctgaaaatgtccactgaagccaggcaaccaaagtcccaagacaattaattgtagggtgtgatgaaaccacgtttgctaaaattgtaacagtgagaaaattatgtctgtgagagagatctgatctaaccaacccccatcttgcctttagccttcaaactactcttaattattcctgggcttgggccaagctaactttgggagacatttaatttatagtgtaaatgataatagcccctcccccaaactcagtggcctttgtaaagctaatgagagaccaccacactaggaggatgagaggaacctggattctgctaaggtgtggacatacatgattagccacacattattccagatgcacaagatgtacaacttccgccaattactcctgcaaataacatcactattgtagaacctaagattggtcttttgagatgtcttttctggttttttgcatctgatgaccaatggttccacctggaaccaccaactgctcctgtggccccatccaaaagtgactcagtgaacaaggggaccatttcccacactcctgtaattgtactcccaacaaatcagcagcaagtacccattgcctagccatcctccctcttcccccaaactatctctgaaaaatcctggcctttgaagttttagagagactgatttgagtaataataaaactcaggtctttcattcagc

SEQ ID NO: 800 - DNA, 10885 bp, Human; identical to SEQ ID NO: 682

SEQ ID NO: 801 - DNA, 23797 bp, Human; identical to SEQ ID NO: 620

SEQ ID NO: 802 - DNA, 209632 bp, Human
  misc_feature (1)...(209632): n = A,T,C or G
tccgtctaaaaaaaaaagaatcagtgttgcttggagaaatgtctgattccaggattgggagaggaaaagtgcaagttgaggctagaaaatctcattgtatcaaaatgtgtggacatgctcaaagattcaagaggacatgccaaaaggatatgagccagattgtaggggctcccactggccaaaacagagaaaatttgagcattgaaataactatagcaaaggattatagcatattgattaaaacaagaattcatgaattcatagtgaaataaataaatgagaagggaaagttcttccttacagtagaaaggcaactcataaatatagaggaaatgaaggaattagaaaatcagcatttggtagccatcctaattataactaattgaagcaagaagcaagatactaaaactggtaagcaaaataatgtgtgtgaggcataataggatatttacatattctcaaattatctctccataaaatatttattaattacaagaagaaaatattaaccttacaatgaggaaatgtttaccttaacaaagttatcccataagaaagcaattcagcatcatgtgcctcttaataggaagcaccgagaaacatacaacatcactttttgtggtattcctgcacaaatccataacctctatctaattgtgaagaaacatcaaactccaattgagagattttataaaataactagcttgtactgcacattatgtgttcaatacatagatggaaaatagaattaactcttcaatttgcacatttccagagcactattaacatatgcttttattttaaaaacataggacgtaagaatctgtgcaagtttagctagtttcaggggaagttggttaaaggaggaattgttcctgcagattagcacccatcaattatttcttcttaatttttatcaaggagaataggaaggattatgggggagaaagacacaaaaccacagcggaaattctcagtccttcaaggtcttctacagggtgtttaaatgaaaagttcaacccttgacataatgagtcaaacagttctctcaaaagttattctttgaatttaatgctaaaattttcacttttttctgctaaatttcattgattccactagagattaaagtgcatacaacataaactaatctacttcatgcaaagaaaaaaagtgtatgtaagaggcaaacatttcatgtgttaaaggattcttggggaaaaaaaggtaaaatcatgaccctcatacaaatataaaagtgaatacatgattttatttaactcattaataaggaaattggtaaggtgttaaaaccaattcaaaggacaatccaaagaacagatcaggaatactaaaataaatgtgcaagcggaggtgaaactgttttccttggtagtggtggaggggaaggattgctactccgctggataaagttcatttgtgtatatataaataagaattattttccattgttatttatctataacttataaagttgtaaacaacttccacggaatcagactcaacctggaagggtatggtctctaggcaatgcaaaaattttcccctacacctgttaacaactataatatctccagacagagtagacagaaagtctggatggcaacgggaatctactggtcatacggctaacttcctaattcaataagcacgtgactaaaggattttttccttccactcacagatatttcaggctaactagatactgtgtgcttcttagtgtcactgcttagtgggggagccagctctgagtggggtcatatccggacaagcgaatgagctatttattcaatgaccacgcaacactccaaatcctcccagggcaacttgaaagtaaccgcaccttccaaagggcaccgtgcaatcagactgtgtgtttggcctcctgtttgctagtggggaggaagcggcttcatgggtgtacactacgcataaatgaatgtgaaaggctatttagacctctgccttttcaccgtcctcccacctgccacaggctgggctcttgtgctagaaatgacttgctagctagacatcatggttcaggatctgagtcagaggtttaaccatttataagcttttttcttatgaaaaattggcactaattataatgtctaactgtcagagttgttgcaggctttacaggagacgcgggctgtgaagatgctttgtaaattgtgaagcgttattaaagaacacatcttttttttttaggaaaccacggtgcaaatttaattgccggggaagataacgggccttggtgccctccaagcgtcagctgagtttccaagaagccgggcagcgggcgcccgcgggttcgtctctggctcctcctccgccacagcagccgggggcccgggtcggaggcggcgggggccgagcgcccggcctcgcaagcccacggcccgctgggggtgccgtcccgcgccggggcggagcaggccccggcagcccagttcctcattctatcagcggtacaaggggctggtggcgccacaggcgctgggaccgcgggcggacaaggatgggtccgcgcggcgcggcgagcttgccccgaggccccggacctcggcggctgctcctccccgtcgtcctcccgctgctgctgctgctgttgttggcgccgccgggctcgggcgccggggccagccggccgccccacctggtcttcttgctggcagacgacctaggctggaacgacgtcggcttccacggctcccgcatccgcacgccgcacctggacgcgctggcggccggcggggtgctcctggacaactactacacgcagccgctgtgcacgccgtcgcggagccagctgctcactggccgctaccaggtacgcggcgcccccgccgcccgcgccgcccccgccccgcctttcgccggcgccctgccgctcctacccggcccttgaggccgcgggcgctggcaggcggggctcggaccgccgacccagttatgggtcccggcggcttctcgccccaacctcgctcttccaggccggcagcccgccgcggcctctgcgcatgcccggctctggcgccccgcggacccgcgccccggccgccgggttgggcgggtggctttgtctttcgttttctgaagctccgggcgaaggggtttatgggaatgccgggtgctgggcgccgcggccggcaggcggagcggtcctgaggtgggaggctggggagggcgtgggctgggagcaaagacgaggggagaggtaaaatgaaggggtgctcgccgtgggtgcgaccctggcccgtgggaacccagcggtgataggttaggagtgtcccaccaaagattatttttttccaggttctcaacacccctggaatgaaacctgatgctaggttgatttttcttaggctgctgacattcctttcacatgtaaccttgtattgaactcttctgagcatcttcattatcgctttaaaagcttccctttaggaacggctccacagttaacgaaggaaatataaatgtagagcgtgcatagatgttagatggctaagaatatcaagaacatttgcatagcactttgttgtttttaaagtgaattattgaaacagtgcatgaggtagttgtttttaccccgttttacagacgaggcaggaagcctgtaaaggctcgttggcataagaatcgcacagctagaaagtggtcaaggcagtgtccgttgtgcttttcctgcatccactggtcgtcccgggcttatgaaattggccttttttcccctcaatctgaatacgattgtcatatttctaagaccctgaagttattatgaccatattaaatacagtaaatgggaactgttggataccacctgcatgccttcacagagtacatatgctgtttactcaacaaaaatattttgagcttactgtgctactgacaggggatatatatttgaatgttgccctcccaagtgtgtgttcgcataacctgtcagatcaaccctagcctcacgtggtcctaagatcaagagaagggagggcttacttgtgataaagatatgcgcagtggtctgaaggcttttataaagaggaaagattgggtgttgctaagggtgagaaatagctgtagccaaggttagaaatgggagtaaaggatgcttcccttcaccatccaccttagtacttttggcggttctgaccttggctgctacgtgtaattaggaatcccctacattgtgtaaatctcaccctggacactttgtgggagtaaagggatgtgccagtaaagaagaagaagaagggaaaggtgaggtttgcccaaagggttctgcatttgctttgaagtaagagaactgaactcagattgcaaaagaatggaagggccattcatttctccaacttcctcccttccaacagagttggacaggaaagcaaataccaacttcagaaacccattcctgggccgggaacggtggctcacgcctgtaatcccagcactttggaggctgaggcaggtggatcacctgaggtcaggagttcgagaccagcctgaccaacacggcgaaaccccgtctctactaaaactacaaaaattagccgagtgtggtggcatgcgtctatagtcctagctactcgggagactgagtcaggagaatcgcttgaactcgggaggcagaggttgcagtgagccgagatcgcaccactgcactccagcctgggcgacagagcaagactccatctcaaaacaaaataaaataaaaaacccattcccgtaatcagttgcttttgtcccctaacatcctcccccaccagtcaccaaaattatgtcttggagaacaaactttagtatttagagtaccccatggttatgaagtaaaggatgagtagagaagctgggcactctgaaaggtttagaggcctctcagtgtagctgattctaaagcagccttgcttccccaaacattttttttcctccagttttctcacccactttattctcttagagttcatgagacccaagtagatgttacccagggtgagcaagtgtccacttttaatgaagtagaaatttcagggaaggctcaggagtctccgtcagatactatatgctggtattgttctgagcacttacaagtgttaactcatttgattctcacaacaactctatcatctctgttctgtaacaaggaaactgatgctggaagaggttaagaaacttgcccaaggttacagggctagtatatgttggaccaggatttgacccagggcacgtggccctagggttgatgcctataaccactaagccatattgcctactcaaaattattaaaaataacgtcccaaggactgcttcatacatactaaataatccctgtattacttttggacatttgggtcattcctaaacatctcaaggtaaagaatcaacccatcatatttctgagttaggaattgcctatattccgtgtaaaataaaaatagattttatttctgagtcatttgttatgcataattttagacaataaaatgaaggaattttttgactgtctcaaaatgagttacttgaaggaagttgttaagagtcatatctatgaacttggcagtcatgctttaagttaatatttacagacccctttcccataattatttaactttagaaaagaaaagcacaagttgataaacaagcctagactgactggactttatactctcatgaaatcctgagttttagtttttttggtttcagaaattatttattgagtaaagaggactggttaggaactgagatgtaggttttggtcttggctggtcagactgtgacctcgctggccatcatttccacatctgtgaaacagaggagttgggctgaactctagactttgtctagctctaaattaatttaactctaaggctcttgtgtccattagggcgagtttctaacttggcaaatgcacattatcatacctatcatactaaccccatctactggtagaaagattaatcttgcccaacacagtgtatcttacaaattgcgtgtactacttgttctgctgctaggaacttacttaattcagccttttatagtgagacatttaattgttcacagccctcacaaatgaactattttaaatgtgcatgctatggtgaaatatgtgtagggactgggtacaggttggaggcaatggaggagactaattagcagatggggtaagtagttactggtaaattcaagaactagaaattcaagtctctctacactcaggctaggggccttcccacagccctatgactcattcattcattatttgtgaaatctttaaaaaaatctgtattttatttttaaaatagaaaatacattcacatggcttaaaaacttaaaagctgcaaaagggcttacagtgaaaatctaccaaaacacacacacatacacacacacacacacacatacacacacttccttagacattcagttcctatgtttgtagacaaataatgctctgaattatatatttttatatatcatttctctcttttttctgtatgaatggtaacatactcttcacactgatctgcagctcctattttgtttgtttgtttttacttaacatttgcaatcattccattttgttgactaaagattatcctcacagcttttagggctgcataatattttgttaaatggatacattgtagtttatttagccagttgcatactgatgaacatgtaggttgtttccagccttttgatatatcaaagaatggtgaagtgaatactttgcacatatgtcattttgtacatattggaacgtatatgaaggataagttcctagaaatggaattttctgggtttaaggatagatgcatttgtaattttgataaatattgcaaaattgcatcttaagggattgtaccaatttacattcccactggcaatattaagttatagttcacatcctatataatttaccattttaaagtatccaattcaatggttttttgtacattcacaaggttgtgtaaccaatattttcatcacctcagaaagaaaccactcaactattagcagtcactcttcatttcctcattccaccagcccttggaaaccaccagccttcttattatctatgtgactttacctattttggacatttcatataaatggaatacaatagatgtcctttcatctatgttgtagcatgtattgttcccttttatggctcaataatattccatgatatggacatgccacattttgttcatacattcatcaattcatggacattaggttgtttgcactttttggctattatgaataatgctgctgtgaacatccatgtacaagtttttgtatgagcatattttttaagttcttttgggttaatatgtaggagtgaaacgccgtattgttgcaggacttctccttagttcagctaacgatgaggtccttgtctgtcccacggccatgaaaattcaggctcgcagatggtttgaagggtgagtaaagcagggttttattgggtgaaaaggaaaaaagggggaaacagggacccactgaaaggtcagagtccctgctacagtgcttccctcattgcccgtttgaatcccaggtgccataggaagaggagaggccaggcgccacctccgtggctccaccccagtgcacagtccagctggagttttgccagggaccccctcccacctggctgtcttagtatcatgtggtaactctatgtttaactctttgaggaattggaaattgttttccacagcagctataccacgttatatttccactagcaacgtatgtgggttttagcgtctccacatccttgccaacacttgtcattatctttttgattatagccttcaagtcatcctagtgagtaggaagtggtatttaattgtagttttgattttcatttccctaatgactaatgatgttgaacatcttttaatgtcttattgatcatttttatgtcttctttggagaaatgtttactcagatcctttgcctgttttaaaattgggtaatttatcttctcattcttgagttgtaagatttctttatgtattctggatactattaaataaacccttactagatagattatttgcaaatattttctcccattctgtggattgctttttactttcctgatagtgtcctttgatgtaaacaaaagttacaaatttttatgtacaacttacctatttttctttggttgcttatattgttggtaccatgtctaagaaaccattttctaatccaagattatgaagatttacctctatgttttatagtattttatagttttcagtttttacatttaggtctttgatccatttggagttcatttttatgtacaatttgaggtatgtggatgcatgtaggtgtccaaatatttcagtgctatttgttgaaaagagtgttctttcctcattgcaccctttgcacccttgtcaagactcaattgaccatagacgtatgacttacaattctattccattgatctatatgcctatccttatgccagtgcctcactgtcttgattgctgtagctttgtattacaaaggtttcagaattagaaaatgcaagtcttccaattttgttattctttttcgagatagtttggctattctcggccccttgcatttccacataaattttaggatcaacttgtacatttctattaaaaaaaagggaagtggaattttggtagacagggatttcagtgatctgtaaaactatttggagagtattactacctcaacaatataactcttccaatttaagaatatgagatgtctttctgtttatttagagggtttttttttttttttaagacagagtctcgctctgctctgttgcccaggctggagcacagtgttggctcactataacctctgcctcatgggttcaaacaattctcctgcctcagcctcctgagtagctgggactataggcacccaccaccacgcctacctagtttttgtatttttaatagagatggggtttcaccatgttggccaggctggtcttgaactcctgacctcaaatgatccacctgccttggcctcccaaagtgttgggattatagacgtgagccaccacacccagcctatttaggtcttctttaatttctttcaacaatattttataatttttagtgtgtaagcattgtgctttggttaaatttattcctgttttactattttcagtggtattgtaaatggacttcctttcttaattttattttcagtagttcattgctgttacatagaaatgcaactgatatatgtacattgatcattttgcaaccttaatgaacttgttagccctaattgtgtgtgtgtgtataatctttagagttttttagtgcaagatcatgtcatctgcaagtagaagaagttttacttcctcctttctaatctagataccttttatttcattttcttgcctaattaccctggataggacctccagtgcaatattgagtagaagtggcatgagtggacatacttgtcttgtttccaatcttagaggggaagctttcagtcgatcaccattaagtgtgatatattcattcattctttcattcaacaaatgtttactgagcagcaagttacgccactgtactctgggaatctcttggtgcttataatctgaagggggtgaggtaaggagaaggagtaaccaagagggaagtgaaataaatacaaacaggccaggcgtggtggctcacgtctgtaatcccagcactttgggaggccgaggcaggcggatcacctgaggtcaggagtttgagaccagcctggccaacatggtgaaaccctgtctctactaaaaatacaaaaattagccaggtatgatggtgcgcacctgtaatcccagctactcatgaggctgaggcgggagaattgcttgaacccgggagacggagattgcagtgagccgagattgcgccactgcactccagcctgagcaacagagcaagactccatctcgcgggggggaagtggggaaagaaagaaatacaaacaagtaaggtgaatttaaatagcatgacaatacatgtggagaagaaaataaagtaggtcaagtgatcttgactcaggaaggtgtcttcaaggaggtagtatgagcagaggcctgaatgaagggagtcagccatgcacatatcctagcaaagtttaacgtggaggaaggagcaacagaagcaaagctcttgaggctggaacgagcttgttgtaagaatgagatggtagctgagtgaatgagggtgccagaggcaggccaagagctagaggagggaggctgggtctccctgggtttaatgctgcccacccattaaaaagtgttaaaacttgaactttttttgtgtcagtttttatagtaaggtgacattgaggctattatacactaaagaacatttcgaatctaacagtgttctaaatgggcatattttaaggaaatacagtcaagtgccatgtggcattctttggatgcatgtaattccaattagaattaattgtacatattctctctttttctttaaaagaaataagcttggctgggcgcagtggctcatgcctgtaatcccagcaatttgggaggcctaggtgggtggatcactggagtccaggagttcgagagcagcctcggtgaaattccatctctataaaaagttaaaaaattaaccaagtgtggtggtaagcgcctgtagtcccagctacacaggagactgaggttgagacccgggggcaggggggtagatggcgggaaattgcttgagcctggggaggcagagtttgcagtgagccaggatggtgccactgcactccagtccaggtgacagagtgagactctgtctcaaaaaaaaaaaaaaaaaaaaaaaaaagtagcctgtttttaaaatcatctccaggaaatacattcaaaaccttcaaatataaaagatgtaaaaaatataaacatgtagatgaggatcttttcagcctgtctccccaccctccttcccataggcagctcctgtttattggtttcttgatatcgcttggaggcatgttatgcatatgagaaaatcgattttatatttatttttcccttgtttaaaacctcaagattaaaaatattaatttaaaaattctccagcttttctaatagaatttgtgtactgcatttagttcaaatagaaaacttaatattactaattttccatattcttacaaattgactttattctatacaaaatattcattatacctttgttattcctaatacatattttaattgtgataagtggttctgaggtctgacttctccattagattgccttgtctgtctctgggctaaagaagcactcagtgttggacaattaaatgatcaaatgtgagaagcacttttacacagttcgtgaaagagctcaccatcttaattaaactgcttgaaattgccatgtcatttctaatgcctttacttcttttttaagaaattgaaaagattaaagagtaagaaagtgataggccttaaaggaaaacactcttctgggaaaatagttaagaaaagtaactctggtcctcaactgggaatgtccttaccttgggtaccaagggggccactccaccagaactccataaaccttggcacagaatagaagcaatgaaagatgactccaaggtttcattcttaagggatccaaaccacatttttcttaatcacactgataaatggacaagacattttcacggcttttcactcacccctgaggcggaaccttggacaggaaatataggaaggaggctgtgctggagcatcgtgggtaatttttgacttttgcttcaagtttgcttcaagaaggtgagcaggaaagatgcatgctgcaggcagaagagggcatggtggtgcaggcgctctgcctgagcatgccctccctttcctgcttcttgtcctcctcgccctcactgtcctgcctgctcctcgcctgctggcctctcagtggactcctgccagtggtcgcctctccctggactttgaggttcagaagtggggcacaggagagtgcagagctggaagaaatgtttacagggtgcagggattggggaaagtgcatgtctcaaggtgggcgctcctaggatcccctggcaaaggcacaggaggagggagctgtcagaggaccatgtagccttgagaccatgggtgcctcctaagagaaaacagtgtctttatttctgtgctcctttagggggagaaacaaaggatgcattagctccatagggacaagcaagatggcctcactaaagcacagcagagccctggggtgactttcatgggtttgctaaagccaggtgtccttcctaagcctagccaaatccaagagacattttcccaggagggaaggggagtgcggaggcctcattctgcaaacattgcagctattttaaagaaacaattccagattttatatcttttacctgccaggaaattgcaaatgaggaaataaggaaataagtttggagctaagtggaatatgaccagtggagttagaggattttctggttgcttgatttacgaggtttgtcatttcaggaatcactttgagcataagctgttgctctctggtcattatcttttgtttgcgtttccttaatcatatcaccttttgagagattcctttccctcagctttcttcatattttccttccttttccatttgggctttctttggaattataatttaaacagagggaggcactgaaaccctttctgacttgtttattcttttttacaaacaacatccctttgtgggtttagtcagagatttgcactcttcactaatcaacaccaaaataaatagactcttaaaactgtcagtgacacgggccagttctgcagcccgagtcctgaagggccaagccagatggcaaagccaggcccctagcacacataatgcgtgtctgtaggctcttggcttcagcagcatgggcagctgactgcttttcagatggcttctgtggggagggagcagattttccactatccatttgttctttgggcatctccaggaataaaccctaaggtggcacaagtgttacttgaccgtgattaaaacctgctgtgtactggccgaggcacaggctagaaattctgaactcctgctttgccaccagcatgttctgtgattgcgttctgatcatgaagcttcccataggctctctggtgtataaggtggaggggtagagtggcccatttttctgaatttttaagtactgcagcaggaggtattgcacacatatgtgggcacatgaggatatgagttcattttgctcagaccagactgactggacagaacctcccttctgttcaacgggatattatctcaacactgttgaggtgaggagagaaagagcatctatcgccttctgtgcagcagtggtttgcttcgctcttgggagagtttgagtgtagctgaaatattgtgctctgaactcccatatagataactaatcaattgactgtctggacctctgaaaggggagttgaaagagattctgatatgggagctgccatcttcctctcccccagcaagagattggattttctcctttaagctcatgagactatactgcaaggaactcctaggtgtgcagaagacagaataacacactggaccaaataaattgttacgtgcaaccaatatgtaaataaggatctctcagttatgtcacagaaagagcctagaacaagccaggtcctccactggatttgcagaccttttgcctttgtggagaggatttttgatggtcaagtaaaatcttaggagaagttgttttttgagagaagatttggtttaatgaagaggagacagccacacatggtagatagggaagtaaccccttggactttcgtatattacatgtagaaccttctccattcacacacacttctttggacattgcagatgggtgttagaatgaaattgttttatattctgttgtgtttatcagggcacccttatttttttcttttgattcctattggtgcccggttgccttcctgccccttgcagcatggcgtggctctgtagttctgtgctgaagtgctgggttggaaccagttcggcatttgcctgtttactgcttctctacacattacagcttccttccttcagatagtgtttgaacagaccgaaaacatgtttttggatgtcatccagggtttggcttctgcttcccaataatgccataaaaatgctctgtcaaataaattctcaggaactgaaaagaacacattccctgctccatatgattgtcagtaatggaggaaggcttcagctgaccacctggcttggtgcccacggcttaggaaaaccaaatcacacaacatctcttggcagtgctttctagcaatcagaattaattctctgcatgtgatggatgagctttccatttaagggaattttcgcagagcatttatctccactggggcttttggattccataaaatattatctttacttatcctgcctggttgccaattagcatactatatgctatgaagtttttgagtcctagggtcaattttctcttcagtaagcttccagagttaaccatggaaagaatactttgatttggggtgtgtgtgtgtgtgtgtgtgtgtgtgtgtgtgtgtacgtatgcgtgcacatgtgctaagaggaatgcttccctttcccagcctggatattataacatccttatcattcagggtcccagctggagagaggtggcacattcaaattagggagggtttatttacaaagggaccattttaaaaggtgtgaatgtgtggggcaaaatgctagggatagtgtagtaatccagtggagctgttactactcctaaaccagaagagaagaaaggaagggccaattaccagaacctagaaggagagaggcagatagagaaagaagtctgcttccagagtgacctttggtagagagactcatgtagccaggctaagcagcgtgtcaggtgaggccatgcactctcctctttccctctcactcctgccagggctccccattggctaagcccaatcagaaacctgaagacaagtgtcctttgacttgatcctcataggtcagcctcctagggcagagagcaggactgagaaagcagcgtggatttgaagggcaaacagaaggtatctgacacatctcccaatgtagataggtgtctaattatttctaggagaggcataacaatctcagtaggaaacttaaactcacttttatttttaaacagttttattgagatatgattgacatacaatgaactgtacacacttcaagtatacaattcgataaactttgataggtatatacctgtgaaaccatcaccacatcaagatagtgaacttaactatcatcctcaagataaacccactttaacttaacacttaagatattccatgtggttcttttaggaggatgtggaaagagatcatgcagtaaagcaatagcaggtgcaattcctaacttactaaagttattgaagttagtgagttactgaatgaagttactgcccggggttacaaagctcataagtgataaagccaggatgggatttaatcctctgagccttatgctattccactttaaattataaggcaaataaaatactcacaaacacttataaaaatcatttgttagcaacaagtttcttgctctccaccttatagctgatgaagggaccagccgtggcctgggttgagaactggcactcttacctcctgtgtccccagagcctgtttattctataaatcaagagctcccagggctggggaaggctggtgtctggtgcagagttgaatttgagaccccagtcccactttctacaaagaagagcatctccctggctaagccaggacaaggaggcaggaggtgttaagttttagggaagggtgggactgggtagacaaggagggataccctgtcatgccgcagcaggggctacagtggcacccaccagcacaagagctgtgacagggccaaactgggttctgggcgggccttttgaacttgtctagtaagctcaggtctcagggcctttgaagtttttattccttaggtctggattgctcttaccccggatttctccaagtctcactgcctcactttattctggtcactgctcaaatatctcctcttcagaaaaggtttctttctttctttctctttttgagacagggtcttgctctgttgcccaggctggagtgcagtgcagtggtatgatcacagctcactgcagcctcgacctcccaggctcaagtgatcctcccacctcagtctccttggtagctgggactacaggcacaggccaccatgccttgctaattttttctatttttatttttagtagagatgagatcatggcatgttgcccaggctggtctggaattcctggagtcaagctagcctcctgccttagcctcccaaagtgttgggattgtagggataagccaccccgcctggcccagagaagctttcttttgccactctatcacaagtgccacctctgtcactgtctccctctccttctttacttttcctcatggcaatgatcactgttggacattagagtatcagttctcaaactttttggtcttagggttttgcacttgcttaaaaattattgaggaccccagggagcatagatttaaatgggttgttaccattcaaaatttgccccataagttaaaacaaattataaatttttttattcaatgaaaaatagtaataaacccactatattaacataaataacttatgaaaaaagctctatttttcaaaaccaaatagttaagtgagaagaatggcattgttttatattttttgtacatcttttctactaatagaagtttgctaggttgttgtatctgcttctgcatttaacctgttatgatatattatttttagtaaaagttgaagaaaaatctggccccacaaagatgtgtagttggaaaagggagggctattttaatatccttttcatataattgtgggtattctactcaatattacaccaaaagttaagaagtggtcattgcttaaagtttagttgctgtatggaccttatgccctgggcatacttgtgtgagccactcccaagcagcagtcagatggccgctttttataagaaaaagttgaacactctcttttgagataatgatttacataaagtagaataaaaaatgcaataatcgttttattatactgttaaataactcagccaggcacggtggctcaagcctgtaatcccaacacattgggaggccaaggcaggcagatcacctgaggtcaggagttcaagaccagcctggccaacatggtgaaaccccgtctctactaaaaatacaaataaattagttaggtatggtggtgggcgcctgtaatcccagctactcaggaggctgaggcaggagaatcacttgaacctgggaggtggaggttgcaatgagccaagattgcgccattgcactccagcctgggcaacaagagtgaaactccatctcaaaacaaaaacaaaaacaaaaccacttgtaaaaaaatcaccaagttttcgaagattacagaagtgtcttctaatcaaacaccaacttcttgtgtgcccaaaattggaacgcttttttcttgttagattcacaccacatattattgctactttttttgaggcaaaaagtaacaagttaatggtttctaacatagtgccttgataaatattgaaaatatctgttcgttggaatggttttatttgtctttcaaatcctgtttatgtccactacttcatttgaataagagaattctgcctttcagaaatatcctcaagccagtacaggaatagagttaaacatccaagtcaacagatatgatcagtaaggtagaaggccattttatctgcttgttcacaatatttcaatgtcattaatctataattttatgtttatctctgtaagatccgtacaggtttacagcaccaaataatctggccctgtcagcccagctgtgttcctctggatgaaaaactcctgccccagctcctaaaagaagcaggttatactacccatatggtcggaaaatggcacctgggaatgtaccggaaagaatgccttccaacccgccgaggatttgatacctactttggtaatggaaatgcacatgtttctttaacaacttagactaactgcagccatctcataaaacacacccaagtgcaatcaaatgaaagaactggatatttgaacacagagtgaatcagtcggcactgtaatggggctgctttctaatgttacctctgtaaacagggctctgtgctgaccttatggtgggcaaacccattacctttgttggagttctaaatgccaccttagggccttgcaagagtttactatccacgttggagaccgctgtactctcagagacccttattaccaaaaagggatatggattgattttttatttttttaatgcctggcaaaacctaatgtaagaatatttccaggctgggtgcggtggctcacgcctgtaatcccagcactttgggaggccgaagcaggcggatcacgaggtcaggagatggagaccatcctgactaacacggtgaaactctgtctctactaaaaatacaaaaaaattaaccgggcatggtggcacttgcccatagtcccagctactcaggaggctgaggcaggagaatgggcatgaacccaggaggtggagcttgcagtgagccgagatcatgccactgcactctagcctgggcaacagagcaagactctgtctcaaaaataataataataataataataataataataataataataataaaataaaaaatgaatatttccttcacaaaggtttggtgtgtttttttctccctgtggaatgtattcacaatttttcctttttttttgaagggggtgggggaagactcttccattggcattcttccacctgtgaaatctgtttttgcaatcacaaagttggggaagataggttttaaaaaacaaaggaaaatgaggaggccaaataaatggtaataagaaggataataagaaataataataagtattttataaacttgatagccctatgaaactaaatgtgaaacctagagtttgttttaaaatatgccctctttaaacctgtaataacctgtgcctgaattaataacctgtgtatcttgccagtagctatatatctttctttcaagttctttttatagtgagctatctgtttagctatttagctacctacctacctcccatctgttcatttatttatttacaaccctccgtagccaaaaaggaacacatattgaacatagaaagtttaaacaggattaaataatcaggatgagtagaaaaagatggaataggttaatggcatcaaattacagaaaagttgcatggctctaggctgtcttcatattcatctctgatatttgaaatttctttttttttttttttatatacggagtctcgctctgttgcccaggctggagtgctgtgtcatgatctcggctcactgcaacctccgcctcccgggttcaagcagttctcctgcctcagcctcctgagtagctgggattataggtgtgtgccaccacgctcagctaatttttatatttttagtagagatagggtttcaccatgttggtcaggctggtctcgaactcctgacctcgtgacccacccatcttggcctcccaaagtgctgggattacaggtgtgagccaccgcgcccagcctgagatttgaaatttatttgtccgaagagggagaaagaaaggaaaagactataagagttacattatttacaagataaatggaaaccagatgttcaggaaaagcaaaagcattttctggctcttaggcctgacagaaatttctcctttgggagaaggagaaggtaaggtggacaacatctttaaaaatgtcattttaataatacgttaggtggttttcttgtagatgttttgaggtattttcttctgttcaagctagggccagagcaccaaagtgcaattcagtaaaagtaattatatgggggccaaaacaatgcagctgaagcacatggctctgtaatgcctcattggattcagggttaaaatcaagatgcaaggatgtcagacaggagggtgtgtgtgccccactctcatccaggtccaccagcagacctcactactcaatcttagcttttttttttttttttttaaatggacccggatgtattctcagtacctcaaatagctgttaaaattagacttgatgtaagatcactttgtcatcttggaaattctagaggagcaaacagcctgtacatccttagaaatttttcaatcaggcctttgctaaaagatgagtcaatatctatactctgggaagaggatgggctgtagatattttgaattttttattaaaaccaagttaggtacttaaaaattcagctggacagaaggtagaaatgatatccttttatgagaattaagaagcctaacctggatttagatgaacacacaccccaaattcatttgaagggagacttgcagccaagaaggttatgatgaccacacagctcttctcactgttacatctcagctcttttgctaaaaatcaggtgatggtgggatagttgcacaagcctgtgaatacactagaaaccaatgtcttttacactttaaatgagtgacttgtgtggtatgtgaattatatctcaatgcagctggtacataaagcatcagagaagatttggttgttcaagaagcattttctatttttttcccccaaaagcataggctgccatcatctttaggctcagtattgaagttcaaatttgtgaatcattattatgaagaaaagcttcatgtgattgtcacatggttgcttggtattagttttgccaagtatgtgaatagttttatttctggaattctcctatctgtattatcttttaaatatttgtagttcatgcctttgctaatgaagtgtatctgtcctatattctgctaactgatagaaagcagctcacacttaacagttaaagaacctgaagtgatttcctcaagctttaatgcccagtagttattaaaaaccttaaatagacctccagtgttctgacattctaatcacccatgtaagggctgaaactatttttatggatacatttctttctctgttacacattaattaacaagtactttgtatttcgttttccattatatacataggagaaaagattgccatataaaagttattttaagaccaaagtattaattgtattcaagatcttgaatttattgagtcatagaaaaggagaatttaatttaaaatgaattgatttattatataaactatgtaaagctcttaattttcattatagggaaagttcaggactgaagaaagagctaggtcaattttatcatcctcattttaaggttaataagcagtatatgtcaggagatagctaagagtctagcaaatatttctttttaataactttatcaaagtataattcacatatcatacaattcacccaattaaagtgtacaattcaatgatttttaataaattcagaaggttgtgccactatcatggcaatccaattgtagaacatttttatcatccccaaaaaagaaactcatccacctcagcaatcactccccatttccccctagtccctccagccctaggcagccactaatctattttctgtctctatagatttacatgttgtgggcatttaatacaagtggaatcatacgtagcacagcttattttaatactttaaaatatagaaatataatattttaaaatatagaaaagatggaacatttgcagaaacaactatatttgagaaaacccattttcttccatgtgaagtctaaattatgggataggccgttgatgccatttaaatctggggtgaaattgagatcattttaggtagaaaagtcttatttcagtgctcactttagtttgatctgttggctctgttatgtctagagatcctctattaggaaaggtttgtatctttcaccagtgggtgtcagcatctgactaaagatgactcttcctagaaccacttctgtaaataaccttgaagccagtctcgcaacatcagtaacaacaaacattgtttgaatcctgcactcatttatgtgatcaccttagagtaaaaacctgtaacaagtcacattaactgtacattatttttaccattatatagctttgaaggattgagattttatcacccttactgagtttcaactctgataaaaaaaaaaactgttagtgttacatgatagcgcctatattctaaaggcgaatgaggaatagatttgagtttttatgcagtaatgttttaatgccttctgccaccagatatagacatgttgagaaatggtgctgattagccttgtcatttgattagcctcgtcacgggtaatcaattgcattaggcaattaaatgctgaaacattagtttgtttaacaagttttatgctatgctgactattttcgtcttccattcttgcaggatatctcctgggtagtgaagattattattcccatgaacgctgtacattaattgacgctctgaatgtcacacgatgtgctcttgattttcgagatggcgaagaagttgcaacaggatataaaaatatgtattcaacaaacatattcaccaaaagggctatagccctcataactaaccatccaccagagaaggtaagttttgcttctatttactgatagcaaaatcttgttacactaatgtcttttcagacaaatgtaggaaaaggccattgttgtttagggaaaaatctaataaattctagggaagtccttttcaaattatacagtatcccagaatcagcctgggaagcttgttaaaaaggaagattcctggagcccacctctagggtgtgatttattaggcgtgggagaaatccgtacatcagcattttagagaaactcttaaaaggtgattcttaagagtggtccccagatcacactttgaggaatactatgttggtagtatttcaatagaaatatagtttaaaaattttggtatattatgtgcatgtgctgtgagtaattaataaaatgacttaaaaaatgattggcttaggtgtaaggtgaggctttattatgacaaacttttggttaagggatccataaattttgggatcagggcagttcctctaaccttgtacttcctccctacaagaatattttgctattctagatcttttgcatttccatgttaattttagaatcatctagtcaatttctatatgccagctcccccctgcccaaagtgtctgcttggatttatatttgaaactatagaacaacttggggagaatggatgtcttaacaatattgggtcttctaatccatatacctggtataccaatgagcttatttttcacatttactatactgatgcttttgtgtaacacatgaataatcttattattatgattattttgttaacctagagttaacttcatgaggtaaagtttaagctaagttctctggatttagcttataaatgcttttgaaatgggaacaaatatttgtattgtcagacactgggctcaaaatatggcttcattaagaacacccataaaaataatacttcagtgggaccctgacacaacaaattatagaatatgcagtgctccctggttcttccaatttcctgcactttgcctctttgacaatgcctgaaggtccttggtgcaggtctgtcttagtctgtttgtgttgctataaaggaatagctgaggctgggtaatttataaagaaaagaggtttatttggctcgtggtgctgcagactctacaagaagcatggcaccagcatttgcttctgggtaagggcttcaggaagcttccagtcatcatggaaggtgaagttgagctggcgtgtgcagatcacatggcaggagaggagagagagagagatgccaggctctttctaacaaccagccctctcaggaactaatacagtgagaacttataactgcaaagatggcatgaagccattcgtgagggatccacctccatgacccagacagctgccattaggctcccactggggatcaaatttaaacatgaggtttggaggagggtcaaatatctaaactataagaagatcaccgtgtggagtctggttgacatacctgtgtggacgtggtatgtggcggctggttccccttccagtttctgcctgtttgaactcagtattggaaatcttcccgtgagatggaagtttaaaatggccaggaattttgcctggggcaatttgcccttttattttgacttccacaagctaaggtaaaatctttcagaagacaactttacctcgaacttcaaattatatttacactatcaaatgttatacaactcctgacattcattaaaaaataatagaaaccccgtctctactaaaaatacaaaaaaaattagccgggtgcagtggtgggtgcctgtagtccagctactctggaggttgaggcaggagaatggcgtgaacccgggaggcggagcttgcagtgagccgagatcgcaccactacactccagcctgggcgacagagcaagactccgtctcaaaaaaaaaaaaaaaaaaaaatcgagcacatgtagaagtgaaaacacagatagaggtgtctgtcctcagctgcgtcccacttttggcgatcactctcctatgctgatatcttgaagcaaccatgctttctgtggaacacgaagaaatgggaacattctctcaaatatgtggaaatacacagattttaaatttaaatctaaacaaatattcagataattggaaaaatagttgctaggtaattggcttaaatcctcagttttcttctacatatttgacattttatggatgcaccttaacacttaacaaggtaaagtcttaagagaactgtgtattattctttgagggagccaccattttacacataagcaaactggcttagagaagttaagtaacttgttcaaggtcacagagctattgagagtcagaatcagaatttaaactcatgctctctgactccagacctcatgtacttaatcagcctccctagttcacagctaatatccaagaccagagattctgagtcccagctcatgattcaccttaatgatttcagtcctgaccatatattagaatcatctgggaaacttataagaaatactgatgccaaatattgtgattcattggtctgaggtgggacccaatcattggtgtttcattattcctcctcctgggctcctaccagtgattctaatgtgcagtcatcactgacacctggtgcagtgacagccattctcggatgggtcattcagggcattcctctcaaatatggagaggcaagcagaagccagctacctattacaggttcacaatctgccataccttaatctgtgcaacaactgtaatctgcccacaatacaaattcattcctactgaagaacgatggaatattccctcacagggttccataacattaagcagataagaggaagcaactggagtgaaataatagatctttgtgggtgggctctcttaactagggtggtggggaaaacacggaactgaggacaataggaggccctaaaagcttgctagccatggaaggagtgttattaccatagccgctgttcgtaggtaactgtttggaaattgccagatgagaggatggtcattttcctattgtgtctgaaacatgctatagcagtatccagcattcccagtatcttcaaaggaaagtttcagtcatagacataagtgaatgaaataatcaatagtcaagctgtaacccaagaatgtttaagacagctaatacatgtttacattttcaattctgtataaaatgatgcaactcaccagtttgaggagctgagcttttcacgattttatcccgatgttgaatctaattctgggctaatttctcaggtactatatatagattgtagcataaggaacttgttctaagataaaaatcattaaagaaagccacatgaagaatccacaggctaacttaaaattgtgcctattttaaaaagcacttaagaggaaaaaagcatttggaggcagttcataactgaaacacagttgctgatgctggactcaggaaggtactgctaattaccatttcacatatgttaagaaggaaccttctttctctttttcagcaggataattccccatactagtgacactacagactgaaagtaacatattcataaaatatctttcttttaaaaacagccccccgtcagccgggtgcactggcccacacctgtaatcccagcactttgggaggccgaggcgggtggattgtgaggttaggagtttgagaccaccctgaccaacatagttaaaccccatctctactaaaaatacaaaaattagccaggcctggtggcatgcacctgtaatcccagctagtcaggaggctgaggcaggagaatcgcttgaacccgggaggaagagttgcagtgagccaagctcgtgccactgaactccagcctgggtgacagagcaagactccatctcaagaaaaacaaacaaaaaaacacccccatgtcagcactttgcagaatggaagcaaatgtaatgttatacacctgatctactagaagcttcttaaagaaaatgttaatttctagtggaagactcttacttttctgtgacacaatttggaaaagaatgtcttaatttagaagtcaaagaaaaacaatttcaaaacctatcatatgctttttttttcatttatactttaaattaggagaatacactaaagaaatgaaaataagactttcttcctcactgaaataagttttcttagcatggtgaggatatttacagtatatatcttaggaaccatgtagcataaataaagggaaaagaacccccaatatctcaaacatgaatatgctaatagctctaggtgataatgtcttgcttttatgtaatacttagatatttagtaatgatttcatgcctaggatttcatttcacattcccaagacactggaaagggttacaggtagggttggagctaaggcagtaactgtgacagttgatgagaacagggatctggacctaagaaaaagcaggggagagatcaggctccagtgatggcagctgctggctttaggctgacagtgagccgagctctggttggcaggagtgggaaaattgaccacagctgttcacaggcagggtcctaggaatagtggctgcaggtggggtcctcactgtgattggagaaccttggagtcctagttaattcattccactaggctaccatatagtattaaaaacactactctttctcttttttcaatttaaaaatagtatagaaatatttcacatttactactgttggggaatgagttataatatttcatgaataaagttcaccttctgagtgttgaaactttattttttgtagtatgggatggaaatatctaaaatgtgcatcagtcctgacctcttgaaatgggctatagtaccgacatggactggtatagtttcttatttttaacccctcaagagtgtcaacttaaaataatcaaaaggatcagaatctagtttaaagagagtttattcaagtacagagtttaaggatggcctcttgggaagcacagattccaaagaatggaagtccgtgtttcaaagtgtagaagtttgggatttcttactgtattagtccattctcacgctgttataaagaactgcctgagttccactggccctccagtgagctgagggtttttgcaggaaaaaaaaaaaagctgcctgagactgggtaatttataaaggaaagaggtttaattgactcagttccacatggctggggaggcctcaggaaacttacaatggtgtggaaggggaagcaaacaagtctttcttcacgtggcagcaggagagagaagtgccaagcaaagggggaaaagcgccttataaaaccagcagaccttgtgagaacttattcactgtcaagagaacagtatgggggtaaccacccccatgattccattaactcccactgggtccctcccctgacacatggggattatgggaactacaattaaagatgaaatttgggtggggacacagccaaaccatatcacttacatagacaaaatttaggggagcttaaaagaatttcaacatctttctgtacaaggcttaatgcataattacaatgatctgattagtcaaggtggtggttttcttttgggaaaggtatgtttaacattccacactgaagatgtaacagtcatggtgttttttgggtcatctggtctgagttaggtacaggacaataaaggaggtggttaatctataacaaagatcttcaataagaaggggaggagtcctggtctctggtctttcctagttatttacagaagaagaacaataaggaagagagttactctataatctaagaaacagaagttgcaaacctgctacgtgacacagtctccaggacttaattttccccttggcataatttagagggtcctgaaaatttatattcttttataaaagtgatggtaatgtctttagctactaaggaataattataggaaagattttcagattatttttcaccatatttaacaaagtgagtagaatgatttctatactgaatatttataagaacctttaataatgatccccaaatctttttttccctggtcattgttcaagaactcccctgtcccccttcccagccattgcctttagtaatcaattgctggctgggaatcacctaccctctttctcctttctctccttcgccaggtggttgccatgttgctgctaatgacctggatgagaacatcttctccttaagctgtgggccccctctctccccactgtatcccctgccccctgccactgttaagagtccagatcagagtcacaaaatctcgtgtttgcaagggccaggctgctaacctaaagaagtgaagcagtttatgtagaacagtgggaaactagaaaattggatagcatttgagggggatggggcccctgtttctcatactccagccttttgttaccagatggagtgtggacaaagagtagtcagaaattctgatttttccaaaaaagtttttttatataaaaacagatcgatgtgatatttcctgattttttttaaaactttacgtgggctgcaaattgttgtagacttccgatttttaatcctatccccatctggaccttggctggtggctggagttggctcagtctagtgctgaagacccagatagcagtacccagagcagacccatactgcactgtcaggtcagcgatgcacctgcacgttcttccctccagacatcgcagccgagaccttcatcacccccaggcagggcatctgttgggatgtcctgcaccatggtctacacgaacatagacgcttcagcatgaccatgcagctggagtagaaggtgtatgtgtgtcgagtggaagcagaggcagaactgaaatggtgtcagaggttatagaatagacttttggagtgggaatttggaatgttttcccatggaaataatggaagtacgggttctacattatcatcattttcactccatcagctgcgtccttagtttaataggttttaaagcaacgactttgacatttagcagctatttttaactttgtgagtttagggaaaacgtatttctgagttccaaagacctgaacaataaataaacttttggggggtctatttgagctctatgtatggatactcctttttgcattacaaggatgtgtaatataaaatttaaaacaacttgtcaacaatgaagaatgaaatatgagcaccacccccccaccaaagtctgtttctaaccattttcattcatttatgagatttaaatgcctcaaatactttaacagaattatacgtttatttttgggttaaactagttgttgtctctttgaggcttttcaactcattaaagaattctgtagcactatgaagagaatgccttcagaaaggctcattaaaaaggagaagctgacctggtatgccactaatgttaaatgttgcaaattgatgtaagtggtaaaatagaatcagtgtgtcatacttcttagtttcaggaattaaactggtcttatgtttggtcctgcatcaaagactaacaaggcatggtgttcactttttttctcataaaatatagtttaaaaatactaaacctcttctaaaagatgagggcttattttcagctaaagcaaaaagctaaagcctctattggtacacatccatatcgtaatagtgggttttccaataggaaattgctcttcggttaatgtggagttggacaagtcacacatataacctttctaagcctcagttaactcatctgtaaaattgctgtaacatagggtggtttcattaaatgagatagaatgtgtaaattattatcatactgtctagtatgtagacaacatttaatatgtggttgccattactgatattattatttgtttggattaggtccattgaggccgttctgggactctggcttttattttcaattttttgtcttgtgtcttttgttatattttttaatatctttattgaaacaaaatttacatatcataaaattcactcatttaaagtatacagttcaatagtaaattttcagttatgcaaccataccacaatctaagtttaaaacatgttcatcatccccccaaaaaaaccttgtatctgttagcaatcactcaccattcctctcccccacaatttcctacagccccaggcaaccaccctctgtctctatagatttgcctatatttctggaatttcatataaatgaaattacataatatgaggacttttacgattgactgatttcacttagtataatgttttcaaggtttatctatgttgtagtatgtatcaatactttatttcatttattgccatatgttgctgaaaatataccatattttgtttatccattcatcaattgatagatgtttgggttgtttctactctttggctattatgaataatgttgcagtgaatattcatggaagtttttgggtggatgtatgctttgatttctctaggaatggaaatgctgggtcatatggtaactctatgttttacaatttcaggaactgccaaaatgtttcttcaaagtggctatgtgtgccattttacattcctgctagtaatgaatgacagttccaatttctccatatcctcaccaatacttgttcttttccatttttaaattatcaccatcctaacagatgtgaagtgttacctcattgtggttttaatttgcatcttaataatgactgatgatgttgactgtctttacatgtgtttattgccttttgtgtatcctctttggagaaattgctattcagattctttgcccattttgtagttgagttatcattgagttgtaagggttctttatatattctggagatgagtcccttatcatacatgtgattcacaaatactttcaatgcattctgtaggttgtcttgatattatttttattaatgcataaatctgaactgtcttatccttctatatttaatgcttcaatatcctcttaactggtttgcacaaactttctttccagcctctgtttctctaccttgctctccagtctgtgcatgagccccttcaggtccctgaggaatacttgaagccatatgactttatccaagacaagaacaggcatcactatgcaggaatggtgtcccttatggatgaagcagtaggaaatgtcactgcagctttaaaaagcagtgggctctggaacaacacggtgttcatcttttctacaggtaagtctgtcaataggaaaatcatctcttggcaaagcctaggacatggtatttgataagtggaatgaagacaaattggagcggttagcattgccttattaaaataaatgcaaactgcaatagtggagacatggtaattgtggatggaaagatatatctaaggaaaaagaatgatgggcttcccccgttccctcagatatcaaaatattctgggactgtggcttgaaaacacatgttcactaactgagtaagtatgagtggacatcactcatatacagggctgctgggtagtgaatccctagagtggcttgttcccagctctctctacaacccagacatcctctatggtcacaactcccaccaactagaagggtctctgtatcactgcaaagagacagattgtgacattatgaagacaaataatggagccatttaaatctatgaaagtgtctccaagtttagatttttttggtattaaaattgtttttggggccgggcgcggtggctcacgcctgtaatcccagcactttgggagaccgaggtgggtggatcaactgaggtcaggagttcgagaccagcctgaccaatatggtgaaacctcttctctactaaaaatgcaaaaattagccgggcatggtggcgagtgcatgtagtcccagctactcgggaggctgagacaggagaactgcttgaatccaggaggcagaggttgcagtgagccgaaactgtgccactgcactccagtctgggcaacagagtgagactgtgtctcaaaaaaaatattttttttctgacagtaaaagttatatatgttattatagacaaattagaaaagggagaaataaaactcataatctcagagattacttttgaaaatcattttcattatggcgatgccattctgtttcctaatctgttacatatgcaacttccccctctcattagagacggttttctgaaatttcactgtgatgtgctttgggtgtagatcatcatttattcatcatgctgagtactcagagagcactttcaatctgaaaatgcagatccttttgttatggggaattttcttatatgatttattttggaattgtgtggccctccgtcccaccttcccctattttttctgtacagaactcctattatttggtcaccaggtcagtcctctaatttttcctagttttttttttccctctcctgttttctttatttttcttctagtatttgggaaatcttactgttttgtaagcttcctattgaatttattttaactgccatgtctgttaattaccagcaactcttttgtgttttctgataattccttttttgtgaagttctgtttttaatttatagatgtcataacttgtttccccaaagcctgtgctcttaaccattactcttaaatgtgtattatgtgtgtgtgtatatatatgtatgtatatactttttttaaagtttgctgatattgccaacattatctctcttccttttgagttctttttttcagtttgtttatatctttgttatagtctgtctttaatgagagtggtttggttttctcaaatccctagagattcttggctgaaatctaacaatttgattggaaactccaagtgccaggtcagggcttgtcatctggtgagttttactgtaacatgaccatgtaggggtgaggtgacatgttgaggaattcattttggtattctactcatacttttgtggttttgttttttcacgagttgttttgttttgctttcaatcaggcatagttattgaacgtggcatttgttgagcagttactatgtgtgggacgcagttctaagtgtttcatgcgaattagttcagtgaatcctcatgataatggattctctgggaactattattgtcccatcttgcagatgtgagaactgaagcacaaagggcataagtaacttgccccaggtcatgcagccaggcagagcctggctccactacagtatcctgcctcccagatgatgatctcagtgttctcataggacctcatggtatagcagagctttccatatggtgtgctgcaatattgatctactgaggagcctgggcagggccagaatagcatctaccctgagcagccttgttcacttgtgtgggtgctatccaaatactataattttctaagtatgtcctgctgtgaaaaaggttaaaatttgtttttctcccaaaacttactcttcagaaaaaaaaggtagacatatttcagcccttaacaagatctctcagattctgggagtcattctcaatttaatttattttgaatatcctggcatagcattttgatcagtgctggttttgaatgcctagagaagtcactagaaagaatcaattaaaaaaaagatgctaggacatgtaacactggtgtagcaaaattattcctgggaaatgacctcattgttgcaagaattggaagtcataagtttataaaacaagtctttgttctagagatcacaattagacaatttcaggacaaatgattttctaaagtgaaagtatatatggattaatgtattgtacgtgggcttaaatgtgctcagacagaagtgaagatgctagttctggaagactgtattaaatatctctaagtggctcttgtgataacattcccatcaagaatgcatgggaggctgggtctggtggctgacgcttgtgatcccagcactttgggaggccgaggcaggcaggtcacttgagttcaggagttcaacaccagcctgggaaacatggtgaaaccctgtctctacaaaaaatacaaaaattagccaggtgtggtggcatgtgcctgtagtccaagctactggaggggctgaggctggaggattgcttgagcctaggaggttgaggctgcagtgagctgagattgcgccactgtactccagcctgggtaacagagcgagaccttgtttcaaaagaaagaaagaaagaaagaaagaagagtgcatgggaagaggtggaatacaatttttttcatgatatttgagaatggaaaaatattttaagataaatatttcctttattatatgattgcaaatgtgtatgtataattgtactttcaaacagatagttgactatttcataaacatctatatttattcaagctggtagtagtaacatttggagcttctcactgagaaaatgaggatcaccttaaataggattgtcttatattttgatactatattaatagatatcttaatcttggatcatctttgctttgttaggttaaatccaacttgaccgtgcctatgtatttttattatactgatgaattcagtttgctagggtttcatttaggatttttgcatcaattcagaagtggaagtagagttagtggtttcttttttgtgtcaggttttgttgtcttggttgtactcacttcataaaataatgtggttagttttgccatctttttctatgctctggaatagtttatagaatgttggaaagatctttctgtttagctggtccctgaagccttttgtggaggcatttaaaaaattatttccatagtttacattttttgctgaattatatctaggtgtgtgtctttaaaatgttttgaaattaattttgcctgaaatatagtgagccctgaaactgcatgctgagatgattattcactccaggaggctttccttgttcctattttagcttattgcttttgttctacttgatttatgtctcaaaaatatctttaattactgtgttgaatccctgattcagcttttctctcatccttttcattttttttgtcctttttctcaggctttggagctcttctgcattaccagtttagacacttttgcaattttaatcctacaccttaatatctccaacatagattattgttgattgtatttttagtttttttgcaatgctgtctctgtttcaatcagtacccttttcttccaagcttgttagtatagtatagtatagtatttagtagcattaaacctcaatgtaaccctgtgagatagtaaatggtttcttgatcccatttaccaatgaagaaatcaaaacttctttttaaaaaataaaataaaaaaataaagatagggtcttgctatgttgcccagactggtctcaaactcctgggctcaagtgatcctcccacctcagactcccaaaatgctaggattatcagtgtgagccgcttaaagaaattaagcgattagtccaaggccacacagctaacaactgaaaaagccagaattcaaacccagatctacttgaggtcaaaacccaattaacctaatcagttgtctttttgcatctcattttcttttccatttatttcatcccattgtactgcatttctacgcttgtgttcacaggacccatccttttcctgaacctttctgaatagaacttttctaaaatctttatttttataggaagtcattgccagctagatgctcttccttggagtatagtggtgaaggatctgcacacacagaatgtgtggccgtcttgtggcctctggtcactgtttcctggttgattccttctcaaatctgcagcttgaggtcaggttgatgcatacacctcacagagttcctggtggcatataggcattaagtgttctactctattgaacctgacccacctagttacagtttcttcttttttggcactctaattctttgacaggctaaaagaaccccagactcttcctatctccacattttcagggctttatttttggggacattcctcaggatacagtgtgccagcactgccagaccttctcttttcctgcctattgtcttctgggagttgtgatctctaagcacacagaagtagaggaggtaataattctcctctgcttaaattagtgccatcccttctcaggctgtcttcctgcctctcttaatctaggtgaagggctctgtgtcatgaggcaaagcagggtgggccagttcttatttcctcagcccagcttctctggtcttgtagtttctggacatgtttccaagattctggcattataagctgtctgtccatcttggtttcttatgttgtgatggggtttcatcttgttctgtgtttgttgttttcgcagggtagtggtccagagaagcagcactagtggctgttaggaagacaccattgtattctggatgcttgtcaccatggctgatctttgtagttgctaaattccaggaacctgcacaggaatctgacctggagtaaaatgagttaaggttagggacaactcttgagtaactaggtcatgagttaagactaggaaaaccgattctgcaaccctgaaaacagtgattgacctcaacatcttaatgcagccattgtgtatttatattaactcttttttttgtttgttttgttttttttgagatggagtctcgctctgtcactcaggctggagtacagtagcatgatcttggcttgctgcaatcactgcctcccgggttcaagtgattctcctgcctcagcctcccaaatagctgggattacaggcgtgtaccaccatgcctggctaatttttgtatttttaggagagacaaggtttcgccatgttggccagactggtctcgaactcctgagctcaggcaatccacccacctcagcctctcagagtgctcggattacagtcatgagccaccacgcccagcctgtattaagccttaccagaataattagttttacttacatttagatgagggtttgaatataaggagaaacctaatttgcatttctttctccagagacttctgtgtttattgacaatttcatttcctgaagttgaaattaataatgtgctataataatgtaattataacccaaggacctggactaactaatcacagagcagtgattcattttttcccacttctctcactttacttcacttagccctgtacttctttataaggataagaatactggttgcattcaaatcaataaatgttgagtccattagtacagaaaaccatgaaaacaatctagcttcctggtgttggattatatttggtgatcggtaaaggcaaaggcataatttttagattttgatgtttgataaagctaacttttaaaaatttctgttataatctgagagaaatccatgattcattccttgccacctctacccatcatcttagcatagttattctcagtgcgctgtctggggaccacctgcagcagtggagcatttgttaaaaatgcaattttcaaggtgatggctgcacaacattgtgccatgttctaaatgtcactgaattggatactttaaaatggctaatttcatgtaatgtgaatttcaccacaatcttaaaaattcagtttctcagactctatcacagcccagctgaattagaaacccagaggcccaaaaatctccatttttaacaagaattcaggtgattcttttgtacacagaaatttgagaacctctgagctaaggtaactcttattcaaactttaggaatttaccttacaaggaatgtatgtggttatttaaatttgacatatatttatgtttatacatatatcctcctcactaggaggaatatatatatgacagctggaaaccaactgggtttgaagttcaggcgctcctaggtagttttcatttcaggtaaatgcacctatttctagaaatagactcttcaaaaagctgacgagaaaagtttaaatttaattattctgctttccatgttcttactgcatataaatcacaaccttaattgattcatgccatttcttctgcagtgtgtgattaataccactgttaacaaatattgtctttctcattacacacatactattctgggtttgtttttttatttctattttttatttttatgggtatatagtaggtataaatatatatttatggagtacatgagatattttgatacaggcacacaatgcatagtaatcatatctgggtaatggggatatctatgccctcaagcatttatcatttctttgtgttaccaacattccaattaaactcttttgattatttaaaaatgtacaataaattattattaactgtagtcaccctattgtgttattaaatactagctcttattcattctatctaagtatatttgtgtacccattaaccatacccacttcccccctaccctcaccccactaccctttccagcctctagtaaccatccttctattctctacctctatgagttctattgttttaatttttagctcttacaaataagtgagaacatgtgatgtttgtctttgtgcttggcttatttcacttaatataatgacctccagttccctccatgttgttgcacgtggttgatctcattcttttatgtgactgaatagtactccattgtgtatatgtagcacattttctttatccatgcatctgttgatggacacttaggttgttttcaaatcttggctattgtgaatagtgctgcaataaacatggcagtgcaagtgtatgtttgatatactgatattctttcttttgggtatatacttagcagtgggattactggatcatgtggtagttttgtttttagtttcctgaggaacctccaaactgttctccatagtggctgtactaactcacattcccaccaacattgtacaaaagtacccttttctccacatcctcgccagcattcattattacctgtcttttggataaaagccattttaactggggtgagaggatatctcactgcagttttgattggcatttctctgatagccaatcatgttgagcaccttttcatatacctgtttgccgtttatatgtcttcttttaagaaatgtctattcagatcttttgcccatttttaatcagattattagattttttttccccatagagttgtttgagttccttatatagtctggttatttgtcccttgtcaaatggatagtttgcagatattttctcccattccatggcttatctcttcactttgttggtcattttctttactgtgcaggagctttttaactcaatggaatcctatttgtccatttttgctttggttacctgtgcttgtgggatattacacaagaagtctttgcctagtccaatgtcctggagagtttccccaatgttttcttttagtagttgcatagtttgtgttcttagacttaagtctttaatccattttgatttgatttttctatatggtgagagataggggtctagtttcattcttctgcatatggatatccagttttcccagcaccatttattgaagagactatcctttctccagtgtctgttcttggtacttttgttgaaaatgggttcactgtagatgtatggatttatttttgggttctctattctcttccttttgtctaggtgtctgtttttatgctagtaccgtgctgttttggttactataactctatagtataatttgaaatcaggtaatgtgattcctacagttttgttctttttgctcaggatagctttggctattctgggtcttttgtggttccatataaattttagaattattttttctctttctatgaagaatgtctttggtattttgatagggattgcattgaatctgtagattgctttgggtagtatggacgttttaacaatattgattgttccaatcatgaacatgaaatatctttccattactttgtgtctgcttcaatttccttcatcaatgttttatagttttcattgtagagccctttcactactttggttaagtagtgatctacttactacttattcctaggtatcttattttattggtagctattgtaaaagggataactttcttgatttctttttctgattgttcactgttggcacatagaaatgttaccgatttttatatgttactgatttttgtatgttgattttgtatcttgtaactttactgaatttgcttatcagtcctaatagtttttttgtggaggctataggtttttccaaatgtaagatcgtatcatctgcaaacaaggataatttgacttctttctttccaatctggatgcctttatttctttctcttgtctgattactctagctagcactttttaattccaggttttttaaatccaaggatgacacttctaatccttctctgatagaacatgatcagagtttgagtcccaactttcctgccaatgagttatatgtagagtctagcctcggtttcattatctgttaaacgcaagttgattgaccattcatttattcactccgtctttcattgcagataaaaagataactgggacatattgctcccttaggaaactcacactctagtgaagtagacaggtacatgtattattattatgcagtgggaatattaggatgaagcccagggtgctgtctgcacacaataagagccacctctcagagcccagggtgtggggaggctttctgagatggaaaggttgggaatggcttggccagataagcagaacacaggtggggaggagattgggcagcattctagcctgtgagaaaggaacataaataaagacagggaggttgggagagcagtcctggaggggggtctgcattgctggagcctggactgcaaggtggagagcagcgagatgtgaggctagagagcatgacccaggggtccactcagaaggggcctgtgcacatgcagggaggaattgtgaagggtctcatggtgacagtgaggcacttaaaagttttaagcaggatcagattttcactttagaactgaaatggagggtgattggaagcaggccgaccttttaggaggctctgacaataaagagaggagagaagataaggagcacttgaataaaggcagagggaaggtggatggagataagaggacagatttaagaaatacataggaggggtggagccaagatggccgaataggaacagctccagtctacagcttccaacatgtgcgacgcagaagacgaatgatttctgcatttccaactgaggtactgggttcatctcactggggattgtcggacagtgggtgcaggacaatgggtgtggtgcactgagcctgaggcaaagcagggcgaggcatcgcctcacccgggaagcgcaaggggtcagggaattccctttcctactcaaagaaaggggtgacagacggcacctggaaaatcgggtcactcccaccctaatactgcgcttttccaatggtcttagcaaacggcacaccaggagattgtatcccgcgcctggctcagagggtcctacgcccatggagcctcgctcattgctagtacagcagtctgagatcaaactgcaaggtggcagcgaggatgggggaggggcgcccaccattgccaaggcttgagtaggtaaacaaagtggccgggaagctcgaactgggtagagcccaccgcagctcaaggaggcctgtctgcctctgtagactccacctctgggggcagggcatagctgaacaaaaggcagcagaaacctctgcagacttaaatgtccctgtctaacagctttgaagagagtagtggttctcccagcacgcagcttgagatctgagaacggacagactgcctcctcaagtgggtccctgacccccgagtagcctaacagggaggcacccccttgtaggggcagactgacatctcacatggccgggtaaccctctgagacaaaacttccagaggaatgatcatgcagcaacatttgctgttcaccaatatccgctgttctgcagcctccactgctgatacccaggcaaacagggtctggagtggacctccagcaaactccaacagacctgcagctgacggtcctgactgttagaaggaaaactaacaaacagaaaggacatccacaccaaaaccccatctgtaaatcaccatcatcaaagaccaaaggtaaataaaaccacaaagatggggaaaaaacagagcagaaaaactgaaaattctaaaaatcagagtgcctctcctcctccaaaggaatgcagctcctcaccagcaacggaacaaagctggatggagaatgagtttgatgagttgagagaagaaggcttcagacgatcaaacttctccgagctaaaggaggaagttcgaacccatggcaaggaagttaaaaaccttgaaaaaagattagatgaatggctaactagaataaccaatgcagagaagtccttaaaggacctgatggagctgaaaaccacggcacgagaactacgtgacgaatgcacaagactcagtagccgatttgatcaactggaagaaagggtatcagtgattcaagatcaaatgaatgtaatgaagtgagaagagaagtttagagaaaaaagaataaaaagaaacgaacaaagcctccatgaaatatgggactatgtgaaaagaccaaatctacatctgattggtgtacctgaaagtgacagggagaatggaaccaagttggaaaacactctgcaggatactatccaggagaacttccccagtctagcaaggcaggccaacattcagattcaggaaatacagagaatgccacaaagatactccttgagaagagcaactccaagacacataattgtcagattcaccaaagttgaaatgaaggaaaaaatgttaacggcagccagagagaaaggtcaggttacccacaaagggaagcccatcagactaacagtcggtctctcggcagaaactctacaagccagaagacagtgggggccaatattcaacattcttaaagaaaagaattttcaacctagactttcatatccagccaaactaagcttcataagtgaaggagaaataaaatactttacagacaagcaaatgctgagagattttgtcaccaccagtcctgccctgcaagagctcctgaaggaagcactaaacatggaaaggaacaactgataccagccactgcaaaaacatgccaaattgtaaagaccatcgaggctaggaagaaactacatcaactaacgagcaaaataaccagctaacatcatgacaggatcaaattcacacataacaatatgaaccttaaatgtaaatgggctaaatgctccaattaaaagacacagactggcaaattggataaagagtcaagacccatcagtatgctgtattcaggagatgcatctcacgtgcaaagacacacataggctcaaaataaagggatggaggaagatctaccaagcaaatgaaaaacaaaaaaaggcagggattgcaatcctagtctctgataaaacagactttaaaccaacaaagatcaaaggagacaaagaaggccattacataatggtaaagggatcaattcaacaagaagagctaactctcctaaatatatatgcacccaatacaggagcacccagattcataaagcaagtccttagagacctacaaagagacttagactcccacacaataataatgggagacattaacaccccactgttaacattagacagatcaatgagacagaaagttaacaaggatatccaggaattgaactcagctctgcaccaagcggacctaatagacatctacagaactctccaccccaaatcaacagaatatacattcttttcagcaccacaccacacctattccaaaattgaccacatagttggaagtaaagcactcagcaaatgtaaaagaacagaaattatagcaaactgtctctcagaccacagtgcaatcaaactagaactcaggattaagaaactcactcaaaaccattcaactacatggaaaccgaacaacccgctcctgagtgactactgggtacataatgaaatgaaggcagaaataaagatgttctttgaaaccaatgagaaaaaagatacaacataccagaatctctgggacacattcaaagcagtgtgtagagggaaatttgtagcactaaatgcccacgagagaaagcaggaaaggtctacaattgacaccctaacatcacaattaaaagaactagagaagcaagagcaaacccattcaaaagctagcagaaggcaaggaataactaagatcagagcagaactgaaggagatagagacacaaaaaacccttcaaaatatcaatgaatccaggagctggttttttgaaaagatcaacaaaattgatagaccgctagcaagactaataaagaagaaaagagagaagaatcaaatagatgcaataaaaaatgataaaggggatatcaccactgatcccacagaaatacaaactaccatcagagaatactacaaacacctctacgcaaacaaactagaaaatctagaagaaacggataaattactggatacatacaccctcccaagactaaaccaggaagaagttgaatctctgaatagaccaataacaggctctgaaattgtgacaataatcaatagcttaccaaacaaaaagagtccaggaccagatggattcacaaccgaattctaccagaggtacaaggaggaactggtaccattccttctgaaactattccaatcaatagaaaaagagggaatcctccctaactcattttatgagtccagcatcatcctgataccaaagccaggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatatgcaaatcaataaaggtaatccagcatataaagagaaccaaagacaaaaaccacatgattatctcaatagatgcagaaaaggcctttgacaaaattcaacaacccttcatgctaaaaactctcaataaattagatattgatgggacgtatctcaaaagaataagagctatctatgacaaacccacagccaatatactgaatgggcagaaactgaaagcattccctttgaaaactggcacaagacagggatgccctctctcaccactcctattcaacatagtgttggaagttctggccagggcaattaggcaggagaaggaaataaagggcattcaattaggaaaagaggaagtcaaattgtccctgtttgcagatgacatgattgtatatctagaaaaccccatcgtctcagccccaaatctccttaagctgataagcaacttcagcaaagtctcaggatacaaaatcaatatacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggataccaacaaatggaagaacattccatgctcatgggtaggaagaatcaatattgtgaaaatggccatactgcccaaggtaatttatagattcaatgccatccccatcaagctaccaatgactttcttcacagaactggaaaaaactactttaaagttcatatggaaccaaaatgagcccgcattgccaagtcaatcctaagccaaaagaacaaagctggaggcatcacactacctgacttcaaactatgctacaaggctacagtgactgaaacagcatggtactggtaccaaaacagagatatagaccaatggaacagaacagagccctcagaaataatgccacatatctttaactatctgatctttgacaaacctgacagaaacaagaaatggggaaaggattccctatttaataaatggtgctgggaaagctggctagccatatgtagaaagctgaaactggatcctttccttacaccttatacaaaaattatttcaagatggattaaagacttaaatgttagacctaaaaccataagaaccctagaagaaaaaaacgtaggcaataccattcaggacataggcatgggcaaggacttcatgtctaaaacaccaaaagcaatggcagcaaaagccaaaatagacaaatgggatctaattaaactaaagagcttctgcacagcaaaagaaactaccatcagagtgaacaggcaaccttcagaatggtagaaaatttttgcaatctactcatctgacaaagggctaatatccagaatctacaatgaactcaaacaaatttacaagaaaaaacaaacaaccccatcaaaaagtgggcgaaggatatgaacagacacttctcaaaagaagacatttatgcagccaaaagacacatgaaaaaatgctcatcattactggccatcagagaaatgcaaaacaaaatcacaatgagataccatctcacaccagttagaatggcaatcattagaaagtcaggaaacaacaggtgctggagaggatgtggagaaataggaacacttttacactgttggtgggactataaactagttcaaccattgtggaagtcagtgtggcgattcctcagggatctagaactagaaataccatttgacccagccatcccattactgggtatatacccaaaggattataaatcatgctgctataaagaccacatgcacatgtatgtttattgcggcactattcacaatagcaaagacttggaaccaacccaaatgtccaccaatgatagactggattaagaaaatgtggcacatacacaccatggaatacttgcagccataaaaaatgatgagttcatgtcctttatagggacacggatgaagctggaaaccatcattttcagcaatctatcgcaaagagaaaaaaccaaacaccacatgttctcactcataggtgggaattgaacaatgagaaaacatggacacaggaagggaaacatcacacaccggggcctgttgtggggtcgggggaaggggtgagggatagcattaggagatatacctaatgctaaatgatgagttaatgggtgcagcacaccaacatggcacatgtatacatatgtaacaaacctgcacgttatgcacatgtaccctagaacttaaagtattaaaaaaaaaaaaagaaatacataggagagcttggaccacttgatgttgagagctctttttactaggaaagctgatggttttgtaattctgccagttttcaggatgttgtcagtgctaatgaaagcctttcatgttctccccatggcatggatacatctgcaaagagctggaaagagtgaagcccatggccagagtacccacataatccacatagcagtagtgcatcagagtgcatagattcatagtacacatgagacggagagcagaagtggtttggttgtcacagtgacttgagggtgaagtttccatttagtgaacaggcatctgcagtgctcaggccagtcctgcagtgaagtgtcctgcctcagatgtcagtagcacaaccattaagggacagtgaccggatcctgttcaataacacatttctacttagacaaatagagcaatttattgcagagtctaaacttttagcacttattatctgagctttcacaatattacatgtgatttaatactcaaatggagttaataatcttaactaattcctctaaatcttacgtcccttttccccttacatataagaatttccttcaaaactggtagttggcaaagagagagctcattcaaggttttaaatatacttatgcaattggcagacttataaaatattatagaaattctgtgccaggaacaaagttatatgtgctaggaaaccaatctcactgggttcttcagacacttaaatgaatttctgacaaagctaaggaaaagctgttatgtgaataaatcagtgagtgtgtccacattctattactctttgcaattatgcatttatttggcgcgtctatcatagaggaaaattacaacccatgcctcagaataatgagacttgaatgaacttttccatagccagtcattaattcatgccacctctttagatttcacctgttaatgtccacactgagagcatgttggatcactttaaaattttattagtaataggtactaatttgttgattattttattgagtgaaaataataaccaatacattttactgaacagccatgctgatttggtgtccctggctgagttacaaagcagaggttccagggctggggatggtagtcccacctcccctctttgtctctggctgttctcagggatgtgttgccctttgggtactcgtgttgcttcccatgggttaaagcatgggcaggcctcctgccagggaacccaggatggtggggaagctggttgtttacctccatctcactttttccagtgtagaaaccatgagttgggccacagtgggtggggggtgtagcagatatggacatttgattcttttaccatctcctcagagtttttcacttctctgtgaccctggaaatggaatcatcctcatgtttgagttctgcgatgttgctggtgataatcttggcaccttatatttgttttggttttctgtggagaggagtgaacctagattgtgtctgtgttatcattttggaactagaagttccgaaatcaataaccaatacattttaaaaccacccccaccccgcaccaaagggtcttgcatttgtattctctgtgtcaaaccattgaattcataatcccagagtcgaaggaaaaaatgcctctcaatctctatgtttatcagatcttcaatgttttattatagtacttaatatatactatgctataatgtcttattgttgatattatgaacttttagcaggagaaacatgaagtagtcatgattttcacaattctgtgagaagagagcactgtggcctttctatgagtttataattaatgaatatatatattcattatatatataagatatatatatcatatatatgatatatatatcttacatatatatatcttacatatatatgatatatatatcttatatatatcttacatatatatgatatatatatcttacatatatatcttacatatatatgatatatatatcttacatatatatatcttacatatatatgtaagatatatatatatcgaacttccttgaactgagcatatttattgactaaattgcaagaaactttccaatttgtttgggtttactttaatctcatcttttgcactccattttgaaggtcacatttaagatgaatccgtttcttatattttatgctcctctcagaactcactggagccaaaattctctgtgaggcaagagctatgttatgttggacaggctgcactggaggatgaagcaaaatgaaaagtagattctatgtagaaataatcacctggaaactacagtgacagcaagaagaaggagctgaaataaattcaggttgtcacaagctgctaaaaaaatgcatttacttacattgcttcttatctggtacccatatctgctgtctcctacagtcgtctagccaaatatttaaagatatagaatctacaaagacaaactaattattaatgtgtctgtgaactctgcaaacaaacattattgaatgcattactgttaggactcctatttggacaagtagctaggtgagccctgtctaagcataaagacctatgcagggcttatcaaacttcaagactctgctgactagagatgcaaaataaaatcatgagggaattagcaggcaccagtgagacctgcaggctttgagaaatctcttgaggtaagtgagaaagacagcttcctatgtgagcagaggttcatttattttgattcaagttaagggttaagggcaacttgacattttgtattacacctatcccttccccacccctctttttttttttttcttaggagttgtaaggatcttacaagatcatctgatcttagaaagaaataaagaccctggccaggcacagtggctcgcacctgtaatcccagcactttgggaggcagaggcaggcagatcacttgaggtcaggagttcgagaccagcctggccaacatggcaaaaccttatgtctactaaaaatacaaaaataacccagcatgatgccttgtgcctgcaattccagctacttgggaggttgaggcaggagaatcgcttgaacccgggaggcggaggttgcagtgagctgagatagcgccactgcactccagcctgggcaatagagtgagaatccaccaaaaaaaaaaaaaaagagagagagagaggaagggatggagggaaagagagagaggcggggaggaagggaaagagagggagggagggagggaaagagaagagggagggaggtggggggggagagccagagagaaagacagaaagaaaagaaaggaggaaagaaaaggaaggaaggaagggaaggagagaaggggggaggggaggggaggggagtggaggagaggggaggagagagaacgaaaaatacccagagagggacgttgggacttttgtaaatactcaggaggcagatggcctgagtccaacactcactgatgcctatgcaatcttgggtaagatacttaaacttccagtgccttattttcttcatcagcaaagtgtggataaaaattataactacccgatagtactgatgagattgcagcacttcctgacacatactgagtgctttattgttattaggttgtgtgatataataatagctaagtggctagagattaaaccatttctagcctttggtctccggtttgctttttatttgtttttatggcttctgtttcctcttgttactctcatcaggctatttgctactacctatgcttattattcattcattcattcacttgttcactcatcagcggcacacctgccacgggccaagctctctgctaggccctgggaaacagtagggaatgaggctgactatgcacaggacgaagtggcttatttcctaattcaatagtctgttaatgagcatcaggaatgtcaagaatcctccttcttctactgaagatggttagcagcctgtaacaattattatgacacatttttcatttatattttagcttctgaaaatcatgaggaattattttttaaagcagtctttgattttgattactgagaatacaatatgttttgagaacctcattatttcctctgatactttcttcttttcttcatatttcttatattctttatgtttaaattgaaggtgatttattatgcaagctattggatatgattttggagttttttgtaccattaattattgagggagcaaagttgaaattctgcttttaattcatctcctttttttgaaaaatgtatgacttaaaaatgaaattaaataatcaaaaattaaatgtgatgcttaaaggtcattttgtttaaagtgatgaatgctagtttaccatatactactagaaaaatcaaaattatataatctatttgccatgtattattatttaattttaataaatatttatggtttcataaatatacaaggttcttcctaaagttatctatctaccacattttctcatttatttatttatttttattttttattttggagacagaatctcgctctgtcacccaggccgtagtgcagtggcgtgatctcagctcattgcaacctctgccttcccagttcaagtaattctcctgcctcagcctccacctcacaagtagctgggattacaggtgcccaccatcacgcctgccaaatttttgtatttttagtagagacagggtttcaccatgttggccaggctggtctcaaactcctagcctcaggcaatccacctgccttggccttccaaagtaacattttctctttcattaactattcattcattttcctattttttaactctgaaagttcttaagtatatatattattataatatcagcaatcatatttataacaaaatattaaccattaatgattgtagtattttatttttattatactaaacagctatactttgattaaaattgtaacatatatagtaaaggacataggaggttttttgctccaaatgacatccagaatgcttatctatatttgaaagagactattcagatattaatactaacaccaaataatgtgccttgttttactgtgatgtagctacactgattatctgtgctggtaaactgtacctcaccattattgatgttccaggatgccagaaatggcattaaagtaagcattgggctatttggtcttctagggctaatgcagagaccatttgggttttttgggagaactcaactccctgtggtcctatgaccaagaccctcattgtctggctgtcagcttaaggctcattctagcttctggaggcttccccttattctttgactttctccttccaccttcagagcctttaacagtgggttgagtcctcctcatgttttgaatctctcctcctttttcttctctctcgtcactctagtctattcttccttctttaacttttagagctcataacctatgccctctccaataatccaggataatctccctatatttaggtcagctagttagcaacttcaattccatggcaactttaactccccgttgccatgtaaggtaacatattcacaggttctgaggttaggacatctttggggaccataattccatgcagtcactttggaatgattgaaattttttagtattctttctgatcacctcccatcctctactagttcttttcctaggagaaacattcaccacacatgcaaatgctcgtcctaatacttgtgtgatagtcccagtgtccccatccacaaggcagctcagcagacttctctgaaaaacagacaatagcgactctatcgccattgacctccacaaaaaaaagtaattgttgtgggcctgggaataattgtttaaaatattgtgacttgtgagtgactgtgaagataagaacaactttgggcaaatagatgcttttaacagcatcacacctcagagcctttgaaacttgagcgggagctggctctagttttcttggggatccatggactgatttcttctacttagggattttgttgtaaatccagaaaaatacgtaggaagctgtaaacgattataaaaattcaggcccattcttcaatccatgggtatatatttgacaccttgggaacttgcattaatactttttcggtaaaataaaaacctcaactcaccttcatttattgagcatcttctgtgtgatgagcagtgtcacctctgtgtttacgcacatataaaagttccaggttctgctttcaagagtttacattcttatatgagcagtaaggctagctatccaacccacttgctaatagtgtaagactttatacaactaatttctaaatggtgtgacattgacaatgacagtaagtgctgtttcgtagtagggaggggaaatatgagtggagttgtgtgagaagacttcacagaggagctggggcttgagctgttggcggaaggatgctagagtttgaataggcagagagagagagaatggtccattccagatgcctccatggagaaaataatggagaatgattatgacagtaacaaccaaaaatttatgagtacttcctgtaacctagttgttgtgccaagcactttacatgtatctacccatttaataggtactactattatccccaatttctagatgaagaagtaggtgcttagagagtaatataactcattcaaagcatagcacttcctaagtggaggaatggagtcaaactcaggcctgtctgatttcagagctcaagcttataatcactgtgtcagtaggctgtgatccaggtcagcttagagtatgggagccatgcagagaaatcctggataattgaagttctagaaagatagagctggaaagggttttagagacaatccccacacaatgttttcattttaaaaacagagacccagagaggctaagtgcaaccacttatgttagaatggagacttagccttgcctcttacacttgtcctcttaccacagttaggtgagtccatctgataatgatgcagaaaggttagcgttgccttgatgactgtcagaaggcagctataggctgcctcagtcacatgggaggtaaagcggtatctgacataatacccctgggaatggattccaccatgggagaatgtagttcactgaattccaactaaaacaaagagctattagactgctcgtgactttttggctgaagtatgcctttttgatacatatgcagccatcttttggaattgggtgaaaatcagtgtattagtccattctcacactgctataaagaaatacctgagctgggtaatttataaaggaaagaggtttaagagccagttccacatggctggggaggcctcaggaaacttacaatcacggcggaagggaaagcaagcacatcttacatggtggcaggagagagagagaaagtgaagggggaagagccctttataaaaccatcagctcttgtgagaacttactcactatcatgtgaacagcatgggagaaccagcccccatgatccagtcacctcccaccaggtcccttcttcaacacctggggattacaattcgagatgagatttgggtggggacacagccaaaccataccaatcagcataggacaaactatatttgccaaagaataatgaaattttgtagagtcatgttttcatatcacttcatgtgaaaacatgactctctacaaaatttcatattcttttctagcttgcattctacccagaaaccagtggtaaaaatgggctgattgtgttttttatctttctcaagttctcctccccttccagtagaaatattaatgagcagtgaaatggccagagacaggcagctggaggaagatgggggcactaagtgaggaatatgcattcatgaatgagcggaaaatagatgctggtgcttttggtctggaatctttttaacattgtcattagtaatagattcaagatagacatttaggtttcaaagggggcaccagtattatcagttgaaaaaacaaaagtgatgcattgtttatactcatctcttctagaatgtaaaaatgaggatttaccctgtagtaatatttctaagaaaaaaaatgaaagttggttagattttagctactaaagaaccaaaacagactaatactttcccattttactctccttgtgtggggttctccttgagggcagtggtaactgctgcacatatgtgtgcaatatatttgtatcaaggcattcgctccagaaaacgagagagagatttcccgggctagcctttgttggcattctgtcccagattcctctccgctttggggttatacaaagattactgtggttctctgacttgatttgaagctctggcttagtcagctgaggaaagactacagtcgccttcctccccaggagtttatcagagacttgctcttccgtggagggcctgggaacgcagtgcctaagctcttggtgggggaccaccccgctgtgcttggcttcaaacaggctgctgtccattgctttcagaagcatgagattgccccatcaggcttaaaaacaataataaaaatatatttgaaaaaaatccccagtcgcttctcttgctgtctttggcagttaggtacaaagcatcaacaaaatgttgtatacagaaattctgccttccaggcttgttcctttcttacagaacaatccttaaccttgtaggactcttttttcatgttttcttaatgagaaaatatttcagagattattggcaccacaggtttattcctttccagtggtttacactcttaactgactgtaatctttatgatctttttttgtatttttctttcacagtatgggccatatctaatcagcctctcctaccgtgactattcaaagaaaaggatcttttttttctttttctttttcttttgtttccatctcagaacactttcttgtcaatatcttctttttaaaaaatgaggattgttgtaacaaatttagcaaacattaagaatgacatccattgccgtggaagctaccaaaaaagttatatacctgtcctcaaaatagcctgtgatctggtgaactattcagatacatgcaaattagtcaaaatataaaagaaatagaggtggggaacaaagggagtgctgtgtttgcgctgacagtgctggccgtaggttgccattttaaactcccactttggtgtccccttttgtttgaaggtccctctggagtccagaggtaatagagcaggctgagtagtggggcctaaggaaaactcagggctgcaaataaccctgtgtacagtgcattcagatcacatctgtgagtcgctggagggagtggcctgaccggttggtgtctatggtgggttgtgatcatcaggctggtcccaggtgaggtcacctgaccactcattattttctttttggtaacagaaattagtcagttaacaagcataactttaacaagcataactctacttgttatttaagacaatgtactgtcctgaggagttctgaagatcagtaagatacagtctccctctttttttttttttttttttgagacagagtcttgctttgtcacccaggctggagtgcagtggcgcgatctcggctgactgcaatctcagcccccagggttctagtgactctcctgcctcagcctctctagtagctgggattacaggcacccaccaccacactgggcaaatttttttgtatttttagtagaaacggggttttgctatgtgggccaggctgttttctaactcctgtcctcaggagaaccacctgtctcggcctcccaaagtgctaggattacaggagtgagccactgcgccgggccagtctcctctcttaaagcacacctagaatcatggtagtggtctctaattcagtgtgaggcacaagtctcagattcctctgtgggtgaagagggggtcaggcaagtgtgtggtgtggagatttcctttcccgtgtctgaggccatgatccatcccctgtaaagactgtgttgattccttgccctctagactgaaaatcacttagtatgagaagaaatgttaccaaagggagtgtgaattgtgaaggagggaccaaaaacatgtcaggcactagtctagcacaatgcctagcaaagaactcggggactgtgtgaggtacaggagtatgcgtggattcaagattcagctacacatctgcaggagccacggttccccaggttaagggcagaacagaaagatgaagtctggacagcagaggggtcattgaggagcttcttaggggaggcgggacatccattaaactgtgcttgagtgattgttaagatgtaggtaggcaatggacacggagagcaggacgttttgggcatggggagtgagcagggatgtaggaagaggaagtgaaggtgtgttctgagcatgttgactaggcctgtccagcctttggtgttcaaagaggcacacaagaccacaggagaaatggggcacatcttcctggagtgttcattttgcttgaatatatagaagggaaaataaataatttaactggttaataatttaaaacattgttatattaaaacaggcaaattatggaagagaatacaattaatttcatggatttttgttaaagttcaaaatctcaggtttccattgttttcttttgattcttcgatggaagaattttaaattctttaaaggagatcaactttattccttcattcacaaaaatagcaaaagcagccgggcatggcggctcacgcctgtaatcccagcactttgggaggccgaggtgggcggatcacctgaagtcagcagttcgagaccagcctggccaacatggcgaaaacccatctctactaaaaatataaaaaattagccagatgtggtggtatgcccctgtagtcccagctactcagaggctgaggcaggagaatcgcttgaacctgggaggcggagattgcagtgagctgagatggcaccactgcactccagcctgtgtgacagagcaagactctgtctcaaaaaaaaaaaaaaaaaaaaaaaaaaaagcaaaagtaaatggcaatcacagttgcccacagatccttacttacatcatgaggcacgagctatggtttcccttagctccctgtgggcagtggggaagcagtctagcatgtggccatggggtttgcttggctgttagacagccctcttcaggtcccaggccctttggacccatcatactcatcctgtgcttcttgacactggcaaatcttgatgatggttaatgtgactccccgaaggatgtgcctccatcccatgtgacagatatgaagtctgtctgcgcacagtctgggccatggagtctgcactcctaagaatgcacagaggcctggctgccttggtctcttgagataatgaaattaagagtcttcagaggcatttcttgagtcttcaatttcatctcctttctccccttctggtcctaagcatgacattcctgtctcagctttttctggccccctgctgtctctggattctggtcttgtgagtttcctttgtttgggttgtgaatcattaggcaatttagataacaggttctgtttttcctaggcagaggcaaactcctctggttcaaagctgcctctggccttttcccagctttgaggaagctgcatacagtctctccaagctagtgtggcatcagaggccaatcagaggcagaattggtggtgggtgaaagagcctctaagcctttctttactatctctgttttgacttctattctttccggtgtgtgttggattgacctaagattttctttgttagaacaccaaactgcccagtgttatagatagtgtttttatactttatctactcataaattaaaggaattaagaaaatggcaggaagagctcagttattcaatactaaatagtgccctggccttcattattcaggggagaaaagggcctgggtctgtgctgttcaacaggtagccactagtcatacatggctattgagcatttgaaatgtggtaaagttgaattgagatgtgctgtaagggtaaaatactgaatttcaaagatgatatgaaaaaataatgaaaaataatacctccataatttttatatgaattacatattgaaatgataatatttttatatattgggttgaataaaatatattattaaaattaatttcagccaggcaggcgtggtggctcacacctgcaatcccagaacttgatcacttgagcccaggaattagagaccagccttggaaacagggtgaaaccccatctgtacaaaaagatacaaaaattagctgggtgtgatggcacatgcctgtggtcctagctactcgggaggctgaggtgggaggattgactgagccagggaggtcaaggctgcagtgagtggtgatcatgccattgcactccagcctgggcaacagagcaaaaccctgtctcaaaaataattaatttcaacagtttatttttatcttttcatgatctggccactagaagattttaaattacatttgtggctcacattttatttccattagacagtgctgctttagatggtagcttcataattgcagtaattcatacctcttgagagttctccagggattattttgttgaagattttctcttgcaatgatcaggctgggtgagaataacacatagtagactgtaagagtcttcaaggcaaaagctgtgtctgtttaatgtactttggaggcaggagtagtaaagtcattttgcttaggaaactcataaactggcttcgaaggcaattccaaaaccagttttgagcatcatctttgaaataagggtattgcctcccagtgactccattgaaagatgcaattcatttggttgcataagactggggttggaatgttaaagaaaaaaaaaaagtgggggaagcaagtttcatttcttatagtccatacctccagtggggactcagcatgtagaaaggcacttggacaggaaccacgatcatacctattgttatttcatcaatgcagaatgcaacataatggaggcagaatggggaaagaaagcctttccagctgcttcaaagaaaacccagatgcttaacttgtttgctgtgatgtgctatcctttcttccttggtgccagaagagaaattattacaacatataaaaaataggattatggccggaagaaaagttattataacatacaacaaataggattgtgggatcctgaatatgttattcaggatccatattgtaaaacatattttctttgaaattttaatcattagaaactatatagttcaaatatattctcaaggctaatccatccatattcaggaatctttcttttttaatattataaaatctttctatggacaaactcacgattagtaaagtatttccccataaaatagaaacaatctttttttccaaaaaagagggttgttattattaaggtcttttaaaaatactttttgttctggagcatgctttatcttctacttctctggggtaggttagaaataattatcaccgttttgtaaatcgggaaataaacacagggaagtcatttgtcgaaaagcacaggggaccagtgccagaaatggtttgaaaatttagatcttttactttccatttcaggtgctgcaatcatagtatcacatggctatgtgaatagtaaagtgtcttgtttacgacagaacatactgttctgaaaagtggggaggtatatctcatttttaggggcattcctttttcttaaattctaccctgtgctttgcttagtaatacagttatttataaaaatttatagaactgtaacagaggtaaagaattctcaatcttgctacttctttcctcccaatagtaataaaaaggatttaggcatccttgctagcttctcggaggcaaagtccctgtgaagctatgagaccttcattatcacattcccactgctttgtcagcttatatttgtgaggaatttaatcagttttattgctgtatatgactggaaatgaatggcatttattttctctgcagggatttatttgcttttttccttgggtggctattcctttgttgataatattttcccaagtcttgaagcactaattgattttgggacttaagcaagatcactttttacattgaatgcagaaactgtgttcctatggattagggcacggtctgtgtagccatcaactggagatcctgctgagaactgtaaatgaggaagaaattatgggtcatgataataaggtgttccaagtctcaagattcagacaggagcagacataaacagcctcttccttggagatatgcaaccagtcagccaaggtgtattttcttaagcattgaggccttgaaaaacatatggaactttgagaatatgtttgcaggtgtgaaaataatggtcggtggatctttctccctgtcatgtatatatacagtgtgtagagagtaagagacacattttggaaaagaaaaatgattttaattgttggtgtttcaggacaatgctttgcttttaaagttacatgtcattatctcaaccccaattcagtctattccctgaagcacattctccttgctctcttactagtcttagctttgggcatatattgctcatcgtaggaacttggtaataaacctagatttaatcgtaactcaaagaatacatgaggactttatatcactttttgatttcaaagactgctcaagtcaaatgactgatacggaaatgtaccaaaaagattccaggtccagtcaattccttggaaaatattgttaatagtagactcaacttggcatgttgggaacagggagaaggtgggaagccaaggctgggcaaagccatagataggaggctgagctggctataggacaggctccagaaaattgacaaggagtctgacttatcacggccaagtagacatggcaggtttaggacccatcttggagagactgtgtagcacaatgattaaatcggaatagaggctctgtaattgtacagacctgaggctcaggccctcattctaccacttactaatttggtgatatggataaattacttttctgagcatctgttttgttatctgcaaaatagggataaagcttgctcagcggactattgtgaggattaaatgagagaattcacataaagcacctagcaccaggcctggcataagcaggaatttaataaatacagctattattattatcttcatcatcatcactatctgggcttttgccattttgcactggttggtgaggatactgcagcagtaatctctgggcaattacaaatattatatccatgtttaggttccgtaggtccaggaagaagcaggatcatattcagccatgctatgtggacagagcccagcaccccctggaaaaggaggttcataagggctgggcaggccttggaacctcgctttcaggaaactggaatgtacatttggaaagcaggcagatgcccacacataatactgtagggtagcagagaaaactgtagactcaacatgaagctgtcagtctctagggcctgagcagagctgaacctattcactgaagtcctcagaatttgcaactgggtaggattggggcaagcaggagctaatgactcaatagccaattgctgtctttaaatcttactgaaattcttaaaactattgaatggcagcattctagttttaagtcttttccagaatgtgaggtaggtatgttattctctgtttttcagatgacgacgtgagcttaagggactgtgatccatagttaaagcaaaagccacaattgcatccttcagctccaggctgtcatttagaaaccacacttactaagacagtgtctcttgtagacgcgtctatgcatcactgcagatgcttgaagcaccatattttgttccagctgctgctatggtgaccaggtcagagcaggctttcgtgagtttctcacaggggcaatcacagtgccttgccctgagcccatgttttctgacactgaggggctcacatgtgcataacccaggtgtgctgggagtcagtgcccatggggccacacttactcattgggaaccagtggatggatgtttcccccatggatcccccagctgtgagatgaatcttattggaattctcaaagggtcccagtgagatggagcatgagccacctgtggcggtggtcagccaacttgataacacatccaggtgttgctttttccctccctccctgtttggctctcccagcctttccctcctgctctctgggatcacttccaacataaactacctacatgcaaacttctgcctttggtccaagcaaagataatttcaaaaagcgtttccttatagtcacatgttcatactgactcccttgtcctgaccaactcacagcaggttggagcttgaaagattaagaatctgttattatagtccaggtgcggtggttcatgcctgtaatcccagcactttgggaggccgaggcgggaggatcacgaggtcaggagatcaagaccatcctggtcaacatggtgaaaccccgtcactgcccaggggcagctccagaaatgctaagaaccaaggcctggaatcagggatatcaagagtcagcttggtactttacctcactgtggctgagctgatgcttaagctgcaagacaaaagtccgctttacaattccctctccttttctcaagcagaagacatccctccttataggcaccacagctgggaatgtgctgggtcacacctgaagccagcctggctctgaatcccgttcaaggcctactgcaagtactgcctgggtattgctgctgactattcagagcccaagggctcttaagttagcaggtgatgaatgctgccaggactgggttcttcccttcaaggtagtgggctcccttctggcccaggatatatctagacatgtcctccaggaggtagggcctggaatggggacctcaggactctgtctggtgccctatcctgctgtggctgagctggtatccaagttgttagacagaggcctctttagtcatccctctcctcttcttgagtggaaagaagtagtctttcccagggctgcgagctgcactcccttggccatcctagctggtgtctcagtaggtcacgtgccccctcctccccccccaccaaatccactggctctaagcccagcatggtattaggatttgcctagaaattgcagtccttgtaccctggactaccttaaagtttatttagaatcccagagcacttgagcccatggtggtgagccttgctggaacttcgattccaaccactgggattgttgatcccctctggccagggctggtctaaatgctccctccacgggtgccagctgaattctgccggtgttgctttccactgttttagggcagcactgagttccagtgcacagtcccacaatcgctacaccttccttcccccaagaacacagattctgtctctgtgccacgcagctgctactggggagatgtgtgaggcatggcagcaattcgtgactgtctttcctaccctcttcaatgcctcttttagtgatatgaaggagacatttaagtgatatgtctcaagatatttttgacttcccttttgatttcttctttaacccattggttattcaagagcatgttgtataatttccacatactgtatttgtgaattttccagatctcttctgttactgatttctggtttcaaagcattgtggtcagaaaagatacatgatatgattttaatcttctccacatatgtaattttaaatagccacattaaaaaactaaaaagaaacacgtgaaattaattttagtaattagatattccgtatatccaaaatattatttcaatttataatcaatataaaaagttattgatgagatgttttacagtcttttacacacacatatatacacatacatatgtatgtacatacacatatatgtgtgtgtatacacacacacacacgcacagtctgttgtgtattttatacttacagaacacctcaattcagactagccacatttctagccgcatgtgcccagtgggtattgttttgaacagctcagctctaaaggaagtgagctggaagatggttggtggtcattggagagtgagacttgaaactgagattgtggagggtttgcaaatatttataatcttaagatctaggatacaactctgggattgagtttctttagcagagtggaaatttagatcatggaaggagaaaaggacaggtcattgagcgtccaggttttgggaaagatcatctgtgtcagttttgaattcatcaaggtttatgagagagtggagagactgataggatgttaggtcttaaaatcttcaaaagagaatctacaaactcctggcaggtctgatccaggagtttgtaaatccctgtaatcaagtagtatagtctgatagcatgggcttctaacctggcggggcagcagttagaaaggagggtgggaaaaagttaggaagtgcagtaacaagcaacaaggctgcagaggaagcagttgtcctctggggagagccagatctcaatgtgagccagaggttctggctgtaaggacttctgatggtgatctatgaggagctgaagcacagaggaatggttttaggagtcagatcaccagatgtgcagagctcatggggacaagagtccaggtgccgagggatgctcaccccatcccctgtggtggaggtgtgtcccccactgctgtcccagccttattgccttctgagggttctgataacccgccgcaggtatggcctgtggctagcagggtagaggaccactaagacctaagtctcacagtgtatctttctacccctgacttccatcctgtctcctgtttgaagtgttgctcagatgactgcacagtagtcttattccagataaatgacttcatccagagttcacttttaaataataatttattttattttttattagagacagtcttgctatgttgctcaggctggtctcaaactcctgggttcaagcgatcctcccaccttggcctcccaaagtgctgggattacaggtgtgagccaccgcatccagcctattttatttttgaaccaacagtgcacaaagtacaaaattttaaaatgacaagagcatctgaatgaaaagtaagtctgcctccctccagccacccaatttcttttctcagagaacacacttgttaccctttctggaattcatttgtaacaggtggctcctctgtccaaattccctcctcctatctcttgggggtttggatgtgaagctggcctttttttccctgaaaatgcattcatgctccctaggacactggcttgccaaacaggagtctgggcacttagcagccagtgctctgtgcaaaccagccagtgctctgaattcagatgagagctttgtgtttgccttattggaaagcccttgattcctgggcttctagaggtatgtatcactcaaaatctctgcagttcttttagggtaagtgaacgctttacttcttcatctattagaaaattattctctcagcagggtgcggtggctcactcctgtaaacccagctcactcctgtactttgggaggccgaggcgggcagatcatgaggtcaggagttcgagaccagcctgaccaacatggtgaatccccgtctctactaaaaatacaaaaattatccgggtgtggtggcacacacctgtaatcccagctactcaggaggctgaggctggagaatcacttgaatccgggaggcggaggttgcaatgagccaagatcgtgccactgcactccagcctgggtgacagagcgagactccctctcaaaaataaataaataaataaataaatgaataaatgaataaataagtaactctctcagtggttcctcaatgcagggctgcacactaagcacacaaaagtgaatcaaacttgaccaaacttgggtatttggatcatacatgaactctgcctgaagtccaatcccaggctagctactggcactggcagcttctccacattcaagaaccacggggatgttgcaagtgcgctgatgtttgtggtaagcagacattaatggaataaggactatgtggtccccacagcttgccctgtcatgatcattctccagtgtgggtcacaggttcaccggaacatcagctaacatgctgtataaagtcacagcaggtgagcccacgagggaatattgagctccattctctctgcaactccaccttcttctctcagattggagagtggggttcctagcttcctgtattgaaattgtagccaatcaataggaaatctcacacttatggaaaatcccaaatcttaattgactctgttccttatcctctattaccagtactcaactgcagcattttatgttgctgttgtcatgcagaagagaaaggattaatcacggtaactttcatcggcagaggggtgaaacaaatgaaaaaaatgttcaggcacttaatgcttctgtgaaaacccaattagcaccccttcatggttataatttctaattactttttgaactgagaaaaaaatgttcttgctaattagctaattatttggtagtgaccttttgataaaaattgctttgactctaaaaatgtctgaagaagagttacttaatttaataaatcactgttattctaacattttagaaaatcaggcattaagaagaggtcttgaaagtttctaagtttcagaaataccatgttgggttgaaagttctttagatgtgtatttgtgcatgcatgtgtgtgtgtgtgtgtgtgcacatgatattgagatttttgccacttaaaatttatgagactaatgtcagttgttagcaatagagaaaactgggcttggggcatatggaaactttctgcaacatttctgtatatctaaaactattctaaaataaggaatttatttttttcagtgtaagaaagtcccttgaaataaaatttgatacagtctgcaatgaactgaattaaaacatccctgaaaagtttctataaagtttaattccacgtagaaaataacttaataaaaaaacctcacaatgtgttgccttcctaaagcttctgacttcagctaacagaagcattaagagtagtggttttaatatgtatgtaatagtgccatcagaaatccctaatgtgcagatatattaactataaaattacatgtcaaatatttagttgctgtatttagaagacaatacaattcctaagagaaacaataagcctatttactaatacatctattttctacacctcagtcaaatttatagttaaaaactagaatgaattgtctttagggttgaaagcctgtctcatgatgctgatgagccagcgtaaggaagtgtggtgactgtttgagttgtgtctgtctcttggtctgttctcttataagtttctaagaaattaactgatggtggccaaatttgattgaagtatatctagtcttccttgattcccccttgaacctgtggtttaatattccacctttaaacataactgcaggctgggcacagtggctcactcctgtaatcccagcactttgggaggccgaggtgggtggatcacttgaggttaggaattcgagaccagcctggccaacatggcaaaacctcgtctttactgaaaacataaaaattagctgggtgtggtggcacacaactgtaatccgagctactctggaggctgaggcatgagaatcacttcaacccaggaggcagaggttgcgatgagccaagattgtgccaccacactccagcctggatgatagagtgagactctgtctcaaaataaaataaaataaaataaaacaaacacaattgcattttaaaaaaccagtgatttaattgagaaaaatgcgtatgctcagacaaaaaagaaaaaaaaatgacttcagatgggcatgtatcctatcagataaataaatttcaataaaattaagtaggtgggttatacagataatgagagagaagtaatgataatcataaaatttgagttgacgttcctttgtgctttatgcatttagcttaagtttttcttgacaacagacaactataggaatatagaatatagtctgtagtttaaaaggaactttggcacaatgtatccaactacctaatactgtattagagagggcctttgaacttgagcttcctctgcctagagctctcttcatcctgacctgacagggttgactcctggtcattttaattctcagctcagaagtcaactcctctatcttctgcaccctctcccttttccctcatggtctgccccatcacagtgtttggtttctgtcctggcactcaccacagtgggaattctctcaacgtttattatttgctttccttatttatcacctgtctccttcaccagaattcagctttataggagcaggggccttgtctgtcttgttcaccactatatcattccctgtgcttggcacatagcaagttggtaatttaaagtttgacattgaaatacatgtgtgtgtgtatctatgtgtttataattactggtagaaacaggccaaaaagatccccccaagaatgaataacaacctccacttactaaacctttgtctcattctttgctccattcctgattttcttacacacttgtattgcttttaggacatgataaatgatacaacttaataagaaaatgataaatctcaaggagaaaacttggcattaatgtaacatttaatctgcagaacaaattgatgttgtagcttccttcttatctttctgtttttatcaataagagaaagatgtctttggggatgggaaggaaacagagggtcttgaggtaggattcccaggggtcctcatctcagtgacctcttgttctacgtgcattttcccggaagacaggcaagtttagtgttttaccacattaaccctgaaatctgataaagtctgttctcctctttaaactaaagacagtttgtctgtgtgcccaggcccagtctcctttcttctggactggaacaggccagggaagatttctgggccttttttctctttctttccgtagtcagggcacctggccacagctttgtctcttatcttgccttagaacttgcatgggaagctgtcatagaccgcctgctgagagccttaaaagaaatgtaaggtagagtgtgtaattattatcagctgttcacatatgagatgtaagtatcttggatattttggattttatggaagtcatacgcgcttaccacattatattcatccagaacttcagtaattttacaatgaatcattgatcttaaggaagacttgtaataaatgctaatctcagagcattaatgaagacacaaactaagactacataaaggctatacaggatgagcatccctaacctgaaaatccaccatctgaaatgctcccaaatctggaacttcttgagccgatatgatgccacaagtggaaggttccacacgtgaccttctttgactagtcgcattcaaaatgcagtcaaactttgtttcatgcacaaaattatttaaaatattgtataaaattaccttcaggctatgtgtatatgaaacataaatgaattttgtgtttagatttgatcccagccccaagatgtatcattatgtatatgcaaatatcccacaaaaaaaattttaaatcccaaacacttctggtcccaagtgttttggacaaggagtattcaacctgtagtgtccacttagatctggttggtgttagcttccattttaccttcttattcataccctcactctccttttctttttttccccaaattaatgtagtatccatatttagtagaaagcctatttgacctttctcattattgcctgtaggacatcttttcttttagtgtgtagagttagcttgccttcgactgacattaacaaagtgctttcctaatcacgatcctcaatgcagatagtcttttcctggaatcacttgttttccttttagttacggtatcaatgcagctcagaaaggtcctaaggtcatgactgatgaaacttcaagaaaaaaaaaaagccaagggcctagaaattgtgtcaattttaattgattagaggtggcagcagtagttcttggtcaagtaattatcaaataactcaaaaaggtatccaggaaatgactgggaagcagaaaccaagctgattgcgcattgatagtgaaaaccagatttgtttgacaaaagggaaagtttctgccagaattgaattatgtctcttctaggcaaaaatacacacataaggaacaaggagcaagctcaaaaactaaagaaagtagcccattgcctggcaaattactagaaaaataataggaacgtttaatgtccataagaagactttcatgaggccaggtgtggtggctaccacctataaatcccagcactttgggaggccaaggcaggtcacttgagccagagttaaagaacagcctggccaacatgaccaaaccctgcctctactgaaaacagaaaaattagctgggcgtggtggcaggtacctgtagtcccagctactcgggaggctgaggcaggagaatcgcttgaacctggcggagattgtagtgagctgagatcatgcacgccagcctgagtgacagagcgagactctgtctcaaaaacaaagactttcatgaaataaaacgaataatgaggtatccttggcatcatctgatggctctgagtatttgttgggctgctccattctgatacgtgggccattctgtccaacaaggtgtggcattgagaaggattggtggtcacattaagggcttgttttcttttatattgttaaataatagactctgaaatgttacttttctctgtaaaacaaggtagtacttcctagttcatttctttcttctttgtaaattaatatttaaaataatactttctaacttttggattaccagattagactttattgtataataaaccacatgattttagatttaaagtcagcttttgaaagaaatccttattatttgttcattaattttaattaaaaatttgataatgtttctgataaaaaatattaatatgtggctgctgggcacagtggttcatgcttgtaatcccagcactttgggaggccaaggcaggaagattacttgaggccaggaatttgagaccagcctgagcaacatagtgagaccctgtctcgaaaaaaaagttttaaatattagctgggtgtggtggcacatatctgtaatcccagctactcagaaggctgaggtgagaagatgacttgagcccaggagtttgaggttacaacgtactatgattgcaccaccgcactcctgcctgggtgataaagtggtatcttgtctaaaaaaaaaaaaaaaaaatcatggtattgaaaggtataaagaggaaaatgtgaattattattattctactcctaaggtaaatatttaaccttttatagtgaaaatttttctgacactaaaaatttttttaaaaacatgagttttaacaatagcagtcatcttaagaaatcattattgaggtgactacagctagcaaagaaattttttttcccccagctgaaatcttgggtacctttatactttggtataaacatgtacacatagtagcagagaataattgtgatgcactaagctggcaggtctgtggatttcagctccaaacacaaatatgtaacactgagcctatattgaaatatggattaagaggctctaactcacttttgtaaaataaaatgataggagccacatttgtgtttaattatagcatgagaaacctgagaatcaaaagaaataagtaagttccatcacacaacaggataggaaaaatagaaagtctacctcacactgctgcatttgtctgtaacttggcctactttatgaaactcaaaagcgaattaagccgggcgcggtggctcacgcctgtaatcccaagcactttgagaggctgaggcgggcggatcacgaggtcaggagatcgagaccatcctggctaacacggtgaaaccccgtctctactaaaaacacaaaaaattagccgggcgaggtggcgggcgcctgtagtcccagctacttgggaggctgaggcaggagaatggcgtgaacctgggaggcggagcctgcagtgagcggagatcgcgccactgcactccagcctgggcgacagcgagactctgtctcaacaaaagaaaaaaaaaaaaaaaagcgaattaaaactacattttaaaagcctggttctcatcacagtttttggctgttagggataggactggtgcaggcaacattgctccagctgaccaggaaatggtcttccagaatccctctgatttaatgagccctatctcctagctctgcgtgggttttgagtaaccatgaaaaaaagcttttaagtgatcaaaatgatatattgattctttctttctaatgccttgaatattctttcagcaaagctgctttaaaaataatttctgattttctatttggtttttatcaagacatggaaatggatagaggtattgtgaattgatcccaagaggaagaaattcctgtaaaatgtagatgcgttggtcacatgggggagaagctcctgtctgacctctatttcatattatgagctcaaaacatgctttctcatgggccatgtgacatcatgtttggttgagcaaaatgttaatgttgcagtgattgggatcagtgctgtgcttcctgacccacctgctgcattggtaaacctgaaaccaccgcagcaaatatgtttatttgcttttccctgaaatgtgctgttcctttttacctcctacagataaaactgacaggcccttttcctgctagccaaaaacagtgaggagaaccaggtggaagacacagcttttaaaatgtagttttaattcactttgagtcccataaagtaggctgagttacagacgagctgtgggcttcaccaaatcactccatgacctcactttccttctggcaaacctctcccagtgcaatatgttgatatcgttgatggagtatgagaaacagcttgctggagaagagcctgcctgtgatctcttaaggttgccagacaacatcactgtaggccatcttctctctttttccttatgcttcaatttcccatggcttttgtgtactacaataacgtcagtaaccaacctcactggaaccacttggcttgtagatagtgaaagctctgtttacattagaggtagtttcagaattgatgaaagcctgtgttgacttcttagtttcttatagtggatattttgattgaaaacactggaatctccaatgtgataattgaccttactgttgtgtactgagatctctattttagattctccccaaataccaccttttttctatttttaaaattattattgcaaattcagtcaaataatatggtagacagaaatttggatgggcttcaggaaaagaggtttaatagtggatttgcccctaactagctgtacagcctcttgcatatcatttaatctatcttgacctcattgtctttgtattgagattctgtggtccagtcatgggaattaaaatcaccatccatagaaagctgtgtctctcgtctctttgtgattcaacacttcatcttttctgcagagtagaacaccttgtaggcaggttcataatcttctctgtacttggaaatcacccggaaagccccctttcaagtttctaattgcccaagttattctttttttttttttttttttttttttttttttttttttttagagggagtctcactctgttccccaggctggagtgcagttgtgcgatctgagctcactgcaacctccgcctcctggtttcaagcgattctagtgcctcagcctcctgagtagctggaattacaggcgtgcaccaccacacccggctaatttttgtatttttagtagagacggggtttcaccatgttggccaggctggtctcaaactcctgacctcagatgatccatctgcgttggcctcccaaagtgtgcccaagtaattctataatgtagccaggatgagaaccactggtatcaggtctagacccagggactcattattataaaacattcccctttgacataccttttcatccttgagtcaggacaattttacctttcagaaagtagctacagtccttttataatttactcctcaccaaaggtaagatacatccattttctctgtgtgtgacttctgactattctgcactgattcaataccccttcgttttttgcttattttttcattctcaccattcaaccacacttgacacttgaatcacttttgttgatttaaaagaacaacaacaacaaaaatacagagtaagatcacttgactttattgtattagccattaaatctctttctggagcaatagttctctaagtatggtcccaggagcagcaatatcactatcacctggaaacttgttagaaaggcaaattctcaggcccctttctggaccagaagctctggagatggttcccagcagtctgttttcacaagacttctaggtgattcgacacactattgcttgagagctgttctagagagattttatattttcagatagttggatttttaaaaatttttttagtgtgctcagatatttttgaagtaatcgttgtctgaacttacttggtctagaaatagaagagatgttctatttctaaaggggatatttcccaatcctacccatctttttatcctttagaagttttcatcttcttttctgcttttagaagacctatccatatctctcttatttttacactgaaaatttagtcttacattctattatcatggaaactttaataatcaatgctatttcaatgatgtattatgatgtgatgtaacaatagatggggcagtgactaatacaacattaatttctacttcttcatttgtttatttttattggaccttcagatgacattcttcttactttatgaagggggccagcccctccacacctgtgggtatttctcatcgggtgggacgagagactgagaaaagaaataagacacagagacaaagtatagagaaagaacagcgggcccaggagaccggcgcttagcatacagaggacctgcaccggcaccggtccccgggtttcctcagtatttattgattactattttcactatctcagcaagaggaatgcggcaggagaacagggtgatagtggggagaaggtcagcaagaaaacatgtgagcaaaggaatctgtgtcacaaataagttcaagggaaggtactatgcctggatgtgcatgtaggccacatttatgcttctctccacccaaacatctcagtggagtaaagagtagcagagcagcattgctgccaacatgtctcgcctcccgccacagggcggcttttctcctatctcagaattgaacaaatgtacaatcgggttttataccgagacattcagttcccaggggcaggcaggagacagtggccttcctctatctcaactgcaagaggccttcctcttttactaatcctcctcagcacagacccttcacgggtgtcgggctggggggatggtcaggtctttcccatcccacaaggccatatttcagactatcacatggggagaaaccttggataatacccagttttcctgggcagaggtccctgtggctttctgcagtgcattgtgcccctggtttatcgagaatggagaatggcgatgacttttaccaaacatactgcctgtaaacattttgttaacaaggcacatcccacacagccctagatcccttaaaccttgattccatacaacacatgtttctgtgagctcaaggttggggcaaagttacagattaacagcatctcagggcaaagcaattgttcagggtacagatcaaaatggagtttcttatgtctttccctttctacatagagacagtaatggtctgatctctctctcttttccctacaacttaagaacacagacacagattattttttaaagttattcttaaacatgtggaattactttataataaacccaaaagttgctgttgttagagggaaatttttactaagtcaagtactctctggaaaaaaaaatgtgtgagcataagctaatatcataaatgaaatgatgaagaagaggataagggcacatggtcctaagtgaggaaactttgacccagaaaccttttgcagtgacagaagtagaccaagagtccaagtctccatgcttccaattcagtattccttgcatgaaatgtcactgcctttcgagactataccgtttacctaattggttggatctttgtcaagagcttgatccaagtggagtttctttgtttaatatataaagcatttgcaagtcctttcaagggcagcacatagttttatttaactccctcaagccctctcacctctgtcaagttgcaccaggaaattcaaggtctagccaaaggcccccaatgagttaaaaacccaaccatcctgcagagtagaagaaattaatgtcaaaaccagatgttcctctgtgggccttgctggattcataagtcaggataaagccagcgtggatgcatgcatgtcaaaaaaaaaaaaaaaaagtcttggccagtgttgtagagaaatgaagtgttgtttcatctgcagttcctctccagtccttgctggttgggagcactggctcccgggagactggtggccctgacactcaagccattaactgagaatgctctctaatcccttgttttcattgttggtgttccggccaggctgcccgcacagagcctgcccgttttcattggctgcaggaattgttattggagtggctgacagctgtctgccaggctgcctgaaactgccttcctgtgctctccgctgctgctccacttcacagcgctattgttcctgttgagccttttcttaaaatctttcccagctgtatcctgatatggtaaaccacttaaattagctccagattgttctgtttattttgtgttagataagcgacaaaatacagtcccagcggcagaccaagaggagagtggaagtcgggggaggggggtcagaggacacaaggtcttttacaacacaaggtagagttcccagacaaaactgtgagaggcacaagtatgatacagtcactggcctgaccatttatacgtgactctgatgggccaggtgagcattaacgttgcatctgcgcacacctcattccagaaaagaaaatcaagaccccagcatacagctacactggaagggagctaaatttctattattggaaatagacacagtattgctgtcaggttggttgccatgccagctgtccaggtaccatgcttgatgccctgattaccacaagacttcccccttccccctgcttttaattatccttctgtagtgcagtgtatggtaactgatgggctcaaaactggcccacatttgccagtctccctatatgctcagcacttgaaaatgagtcttctctgctgtaatttaaagctagaaatccaaagacattgagtcaccagcataggtattttccacacagctgcaagtgaaacttcacaatggacttggccgctatttgcttacacttgccatctgtgcaaccgctctacccgtggcctcccccgctttgtggttgtcttctaacaggagcagtccacgcaaagccttcctgaatacttaacaaaattttaaaaaatataatagatactgtcctagcatgaaggcgctgcctttgtgatttttaggaattaacccaaataaaatatgaaaaataaactaccgagtgctttaacgcagctaaagcatgcaagcaaaaccagcaaccagctgagttccgacagttactgagagttttgtatgtggtaattcaagactccccaggaaagatctcatgactcactccagtgtggctgggcctccagtcctcactctgaaccaaagtcctggaaacacttttccaccacgttgagagaaggcgagggaagaacagggtcaggagtgatcaaatgcccttagaaacagtctctttctttccttttgggaaaacaaactcactgtgtaataaaaaggtacaaagccaactttggaataataatcaccccgccccatccccttgccctctgatggaaagtgccttgtcttctccatcaaggtctagctgggggcttgaacggcctccgtgtcacctctaattccccagtttttaccttgtttcctttctctgtatcttttttgcccttagttgtgtacagtcttgtattttttcacataggctatgctttctgtggatgttgcctccctcgaaagcagggaccatgtgttgaacccctgttgccttttcccagagtagcgggcacctagcaggtgcttaattaaggtgtgtcaaataattgtttccttttttattcttacctgacatgaagtatgctcctgtatcaattcagatgaaggtttaaaaaaaatcaagacaagtatcacaagttcccttagcccattctcattaaaatcatgggcaccaccttcccgtgctcaccaggatggaggaagtcaacaaatatctttctcattgattaaaaactctggataatactgaaagcaactatctgaggcttcttaaaagtacttaggttggtgctaaagtaattgaggttttcgaaaactgcaattacttttgcaccaacctaatataacagcagggatgataagaatagggacagagaagaaaacaaaatcaggtgaatggagaatggggaataaagtcaaagcttcatgaatcccttgtgtggtgagttttggaggtttattttctctcctctatctcttggctttgacctaagagccaatggaattatggaactatgcagcaggcactggcagcaacatctccaagagaaacctcctacttctaaccagaggtctaggaaagtgggctcttgctcaagaatatggggaattcctattttatttgttttttcttttcttttaattttttgagattgagtctcacgctgttgcccaggctggagtacagtggtgtaaccatagctcactgcagcctctacctcctgggctcaagtgatcctcctgccttagcttcccaaatagctgggactgcaggcatgcaccactacacttggctaattttttttttttttaattttttatgtttggttagcgattggatcacactatgttgcctggctggtgtgagccacagtgtccagactgttttttctttttctttcccttttctttcttaactctaccccaagacaggccccagttgaagatctgcattggtgttgtggtggggtccaggcacctaaaatctcaaaagaagacccacatttctgaccggagtgtgagataatctctgttattttcctctttttttttttttttttgctactttgctcccaaaggcaacctcagttatgcagaagtgcatgacagaatggggaactacaacctaacagaaacctgtttttctgatcagagaaaccacataaaggggcccctggagcggaggttgggggtggatctgaaggatctaaagggagagaagaactggagaagaggatcccctgattctgtgtatgagctaagccccaggctcacctccaagtgcatatatgccacacaggcccaaaggagcaaagcagaggcttcgaaaactcaactgccatgtgaaccactgcccaggtcctagattaacccctgagtggcacatgcgctgggcaaacccaaacctcatagcaaaggctttaaaaactaaactgacattagagccactgtccacagaaggtgagacaaaacttgtggtctgagtctcactaggttgattctctgcttaaccaaacaaacatcaacaccctcgagaggattttaactagacctagaggctcagaacatggtattcaaaatgtctaatagacagtccaaaattactcattatacaaaaaaaaaaaaacaggaaaatacgagcagtactcaagggaaaagactaaaaatagattattttcagctgtgatgagctcatttgagatgatcatccaaatattggtgttgtcagacaaaaactttaatgcagctattgtaaccattctccatgagacaaagttgaacactcttgaaatgaatggaaaaatagcagtgaaatagaaactaaagccaaacaaatgaacaaacaaaacaaatgaaaattatagaactgaaaaacacaatatctgaaatttaaaattaactctatgggtccaatagcagaatggagctgataaagaagagtcggtgaacttcaagatagatcaatagaaattatacagtctgggctggtcgtggtggctcgtgcctgtaatcccagcactttgggaggctgaggtgggcagattgcttaaggctaggagttcaagaccagcctggccaacatgatgaaaccccatctctaccaaaaaatacaaaaattagtcaggtgtggtggcacacgcctgttgtcccagctactcaggaggctgaggcaggagaactgcttgaacccaggagggcagaggttgcagtgagctgagatagcgccactgcattccagcctgggcaacagagtgagaccctctctcaaaaaaaaaaaaaaaaaagaaagaaggaaaagaaagaaaattatacagcctgaaacacagaaaaaaggaagaaaaacagtgctgcagggacctatggaataatatcaaaaggtctagcatttatgtcattagagtccagaaagagagcagaaatattagtgtagaaaaaatatataaaggaataatgtgtgaaaacttcacaaatttggtgcaagatacatgtacaagttcaagaagctcagtgaaatccaaacaggataaactcaaagaaaactacaccagcatcataatggaactgctgaaaactaaagatgaaaaaaaaaaataccttgaaagcagcaatctcattcatgggattgaatgaaattgaatgaaagcatgttcacacaaaaaacaatacccatatatttatagcatctttattgataattactaaaaactgaaaaacccaaatgtccttcaactagcaaatagataaacagatgtggtacttctgtgcagtggactactactcagtagtgtaatgaactgttgatacacacattagcatggatgaatcacaaatgcattatgctgaatgcaggaagccagactgaaaagattacacacactatgatttttttatatgacattctggaaaaagcaaaaccttaacgacagagaagcatcagtggttgccaggggttaaggctgggtgtacaatttgtctacaaagaggtggtacaaaggagttatatcacagtgatagaatgttctatcctgattgtggtggtatttatatgactctatttgtcaaaatccataatgatgcacaccaaaataagtgaattttactgtatgtaaattaaaatgaaatcaccagcacatgatttcatatctgatatggttaatatatcttcatgactatgtgaagtatagaaaagattcatgtaatctcttatctattttgaagtcattttccatttgattccataaactttcaggaagccaaaaatggaataaataatgaaatggtctctgatacatacagaaagctttccaaaaaagaattttgtgtttcatatgccaggcatatgttttgtagggtcagcttaccacaaaaggcctcgctgaaaaaatgcagtataaaagtaggggcctgtaagagaaagagaagcacattgactccagaggaggtctactgttttataaaagaagccaagcaaatttgatggactggtgaaaacaagaacaaagaatctgacatgtcttggaagctctgggttttgataattagggaagtatttagaatgctgtctcgaggaatcacatcttttgtgctgagatatatccctgcttgtgttctgaaatatacatggagtgggcaggcttggactgtttaaatgaagcagattttttacattcttgtgacactaggaagacttttcctgaatgtaggattttttctttaacgcacctctcatccaaatggcaaaacatccaggatgggtgcttacttgcaatgagatctccccagctgaccagagctgtactttctcccactgcttattccccctctgaagttacatcatcattttgctccctggtacaccattatgggtcttatctatttttatacataaatatattaaacaaaactgttggttttaagaaacttttgacctattctaagacctattctctgtttttctataaaagttttatggttttagctgttgcatttaggtctttgatctatcttctttttcctcatacagtattgtttttattgagatataattcatataccatgaaattcatccttttaaagtatacagttcactggtttttagtatattcacaaagttgtgcaatcatcaccattgtctaattctagaacattttaaaaattaaacatacaagaaattctctaccccttagcagttactcccaactccctttcctccctctgtcaatcacataatctatgttttgtccttatggattttactaagctagacatttcataaaaatggaatcatacaatatatggctttttgtgtctggcttcttttatttggcataatgttttagatgttcatccattttgtagcataaatcagtatttcatttctttttgctgatgcataatatcccttttattgctatacattgctgaaaatatacattttaaaaaatccattaatcagttaatggatatttgggttgttcctacttttttgggctattatgaataatgctgctatgaccattcaggtaccaatttttgtgtggacatatatttttacttctcttgggtatatacctaggtgtggaattggtggatcatgtggtaaatctatgtttaactttatgaggaactgctaaaccctttgccatggtttgaaggtatctcccaaaagttcatgtgttggaaaccgaatccttctgtcctcatgaatggattaatgagggttttgccatcatgaatagattaatgtcactgtcacaggaatgggttcattacattgagagtggctttgttataaaagtgagttctctcagtctctcttgctcttgccctcttatcatatgatgccctctgtcatgttatgacaccacatgaaggccctcacctggtgccagcaccatgttcttagacttcccagcctccagaaccatgagctaaataaacttgttttctatataaattaaccagcctatggtattctgttacagcaacagaaaacaagactaagacactgtttttcaaagcagctgcatcatgttacactcccaccagcaatttatgagtgttccagtttctccacgtccttaccaccacttgtcaattgtctgtcttttttgttatatagtaatcctattgggtataaagtggtatcttcttatggttttagtttgtgcctcttggatgactaatgtgggacatctttttgtgtatctattgaccatctatttttgtgtatcttctttagagaaatgtctatttaaatcctgtgtcaatattttaatttggttatcttttattattgagttgtaatatgattcatctttaatttttatgtgtgttatgaagtagggtttgtcaaggttttgtttgttttttttaacgtagatatcagaatactctagcattatttttttttgaaaaaactatttccctattggttggtttggcacccttgctaaaaagcaaatgaccatttaaatgtggttgttttactaggcactccattccagttccatgaaatcttgattactgtagctttatagtagttcttgaaattggatagtataattcttctaactctgttcttctatttgaaaattgattgcagtcttgggataaatatcactttatcatcatgtttgtggtaggcagagtaatcccccgtctccctcctgcctccaaacatgccctaaagcctggaacctgtgaatatgttatgttatatgacaaggggaattaagattgcagaccaaattaaggtttctgataaactgacctgaagatgaggagattgtcctggattatctggttggaccagtgcaatcggtgaccttaaaagtggaagagggaggcagaagaggaggtcgggtaatatgatatgaaaaggattcaaccatcattgatgactttttttttttttttttttttcctgagacggagtcttgctctgtcgccaggctggagggcagtggcgcgatctcggctcactgcaagctctgcctcccaggtcccgggttcacaccattctcctgcctcagcctcccaagtagctggcactacaggtgcccgctaccatgcccagctaatttttttgtatttttagtagagacgggcttcactgtgttagccaggatggtctcgatctcctgacctcgtgatctgcctccttaggcctcccaaagtgctgggattacaggcgtgagctactgcgcccgcccattgctgactttgaaggtgaaggaagagggcatgaatcaaggaatgcaggatttcaaaatggtagtatagaagcaagccagcttcaatccctcaatagaagaccaaaaacaaatatatagcattgagattttcaccagcaacaacccagagttcaagtatgaggatgagacagcccccagggccacagagaagtggaaaaaccttgagcatatgattggagaatcagatttccacgtctgcgagtcccctcccctacattctttcagcaccaagcatgtggaaaatctccctcaattctgtttttacactggaaaaagtgaaattgagtggtcaaccagcttcctcaccttcttgggttccgtagcaggagtcctgtccctgccttaactcatgggaagcattgtgagtgcctgtagggagaaatatctctgaggacaggctgcaacaaaggtcagaaggtgagactaccatccccaaccctggaaactctgctctgtaactcagccaaatgagacaccaaatcagagtggctattcagcagcaccacactgtaggaggtacattccacaggttcccatgggcaggaacccctagccagtcttcccacactgctgactaggggttcctgcctaggagcctgtagaacatacctgggataatccctttggtgactcccccatttgggacaggcagcactgcaaccgtttactagagccaaagtgaacctgggcttatagcgccacctagagccgaaaaggaggcagcaacctagttgcaaagattaagcaaatatattcaatgaaagacaaaacaagctggacagagaaaactagaatcaataattaatccttcaatgcaaagacatagacatatacccgcaagtaacaacagcaaacagggaaccacagtctccccaaaggacaaagcaaaaatccaatgactgaccctaacgagatggcgactattagcttctgaccaataatttaaaatagcagttttaaggaaactcaggtatctccaagataatacagaaaagcagaaatttatcagagaaatctaacaaagagattgaaataattttaaaaaatcaaacagaaatcttagaactgagaaatacatttgccaaactgaagaactcttaagaggctctgagcagcagagtgagccaagcagaggaaagaatctatgagctcaaaaaccagctgtgtgaaaatacacaatcagagaagaaaaaagaaataagaataaaatgtaacaaagaccacctacaatatgtaaaaaattacctcaaaagaccaaatctaagaattactgctgttggtgttcaagagagagtgaagcgagagcaaggggtagaaagttgattcaaaaggataagaactgaaaactttccaaaacttgagaaagagaaatatccagctacagaaaggtcagagaacaccaaacagatttgacccaaataagactactccaaggcatagaaaaatgaaactctcaaaggtcaaggacaaagagaggatcctaaaagcagcagagaaaagaagcaaataacacgtaaagtagctctaattcatgtggcaacggattactctaaggaaactaaacaggccaggagggagtggaatggcattttcagattgctcaaagagagacaaaaaaagcctgccatccaagaatattgtatccagcaaaattatcattcaaatataaaggagagataaaatctttcccagacaaacaaaagctgagagaattcaccaccactagatccatcttgcaagaaatactaaaggcagttcttcagtctgaaagaaaaaacgctaatgtgcaaaagaaaacttttcaaagtataaaacctacaggtaaaattaagtacctggacaaactcagaatactctcttactgtattgctggtatgcaatccactcataactctagtatgaagctcaaaagacatgagccaaggagtgaaaacagcctctagaagctagaaaggcaaggaaatggatttgctagaaaggcaaggaaatggaacttccagaagggaatgcagccctctcaacaccttgacattagcccagtgagacctgcatcagacttgtacaggcctcagcagctgaatgtattgtacagcctgcagaactgtacaataataagtgtgtattgtttaagctgctaagtgtgtggtaatagaaaactaatgtatgtttttttatataaagctaaatttgatttcctaaatattgttaaagatttttacacctgtgttcattgtggttttctttttctgtaatgtctttgtttcattttggtgtcagagtaatgctggcctcatagaataagttgggaagtacaggattcctatctattttttgaaagagtttgtatagaactagtattattcctttcttaaatgtttggtagaatttgccaatgaaggcatttgggcctgaaattttcttggtgagaaggttttgttttgttttgttttgagacagagcctcactctgtcgcccaggctggagtgcagtggcacagtctcggcactgcaacctttgcctcccgggttcaagcgattctcctgcctccgcctcctgagtagcttggattataggtgcctgccaccacacctggctaatttttgtatttttagtagagccggggtttctccatgttggccaggctggtctcgaactcctggcctcatgtgatccatccacctcagcctcccaaagtgctgggattacaggcgtcagccaccgcacccggcctgtggggaggtttttaattactaatttcaatgtctttaatgggtatagggcatgtatgttatctattttttcctgaatgaacttagattaatcatttttgaagtcttagttgctagaaaaaaatatttaaaaattggtgaattttctcattaaagcagcttttagtgcatttttgaatatagtaaatataaatattttatatttatagaatgtattttagatctgaaaaataattattatgagagtccgcatattacaaaaatacaaatattatatctgagtccttacttaccaggagatctgattataacttgatttcccatacatttatgccactcccatgggccataaacatgccagtcactgtgataaatttactttgtaaatcaattaattgactttgtgattatatatatatcatttacagtgattctgcttctaaaaagtggaacctctttccatatgctgttagaattatttataagcttacagaggtttaggccagaccccaaactgtgttaaattcacaaggtaatgagtgctaacctgtgaagcctcttgaaagagaggtcactacctatctctggccatatgtcccaatcctgccattgtatagggcagtggtttttactgagagtattttagaaattcacttgagtgttactgatagttagtgagtagggggctcaggatgcaatgcccgtaataaccccacacagtgaggaattgtcccaagtcctgtacaacttacaaaatatcctgctggttagtcatgaagattaaaagcttgtttacaattttctgagactagaacctaagtctagtctctatgttttacacataaacacaaagtattttttgcgtggttttaatatataattaatattctaatctttattttagcatttatccctgctctctctttttttttgtatttctactatagaatggccttaagtccaaatttatttcgtctataactgtatgcactcatctaaccactttgctatgtcttttagggttgaacctgcgcattttcctatgaaatacatgctattttattattaattgcctttttctactctgtattacactgagagttattttttttaattagacatatagttacagtattgtatataaattccatttcaggacaaaggagcatcacaaaatatttgttatgaaaagggtggggatgttagatttgaaaagcctgagaggcatgttatagaaacaaactttcttctgatttcagtacttttcctatcattatagttgctattacataaaaatgtaaagtcttggaatgagtccatattactgcttcaaaataaccaaaacaataaaaatggatttaacttctatttcgcctacaaaatagcctaacacaattattatatccatcaagtctaggacatccagccatagtgctcacacatatgcatagtaatcacaaatttcagtgcacaaacttagatctgcaaagaatataacttacttcttttttaccctgtcactgaacgcagtacctctggggtccctattctgctgggtggaggaaacctggttccagtcaattcagatcatctcagttaattcatgatctcatcctggctcccctccagggagccagtgcgttggagctgaaggaagtgtgtggtccatagtcatccttgcacaagcctctgcagaaacattcctgttcctggctggcctttttatatcatccatctagatcatgctgcgacctccttgcctgcggagactctttggaccatctctgtgccacatttgtgctcttctcaacaccaaatcaaaaacattcatcagttcagctgcaaccccttccacactgtggtgtgagaagcctctgagcctgccttccatcaccttgtgcaaccattgtcatctgctgctgccacactatactgggcacaagaaccgcagggagtcttgctatcctctcatctgccccccggctcctccaggggatgaggcatggttctttccactcttgtatccctccgtccattatttcttctacactagatccagtcctgggggcagagcccaagatgtgtgcttaaggtcacagccatgtcctttagcttcgtttccagtcctctctcttcccctggctctgagtgattgcttaagctaaatctattagctcatccacctgctgactatccatttccggagcccagacatggatctccctgcctgcttcctgggttgagggtcacagggtgacaaaattactaggaatgagaaaagctgttacttaatatttggaaacatcattccagtggagatgcagggcacatgaggcatactgcttagcctgtaataattttctctcttttcagtctatatgcctaactttatgccaggatagtgaaagttttcatgtgcttatcgttgtgacctttgcaaggtatcaggtgaagaaggcaggcacattgtattgctgtagataaataggattaatgacaggaatatgggatataaacctttttgctaggtctaaaccatccttaactatgccatgagtctctcactatcttaatgatgtagggtcatcattttaatttttttattgtagtatgcatctttcagtggtgtcttcaatatacgtcagtgtggatcatttaatgttggaaaaacaggtaaagacactttagtttgtggtctacttttacaatttatacttttcttctcctttcctccttctacaaagattatgtccagcagtatgcatcttcctgacttgcagattctagcctgctataaaattaggacaccagacaccgcacatattgctagaattgcgtctgagactgaataggtcctgagttagtctctaattgcatggacttcgtggtgcctattgtggtaactcaggggcatttgttttgatttgtttgtttgtttgtttggttggttggtttggttttttatcctggcccttggctgttcatccctttgtctcctgctgcaaggcctcctgttagccatttgcctctcattaggcatggagctccaggctgccttccatgttctttcctcctgagtggcctcctcacctgcttgggatgtccagtgtcaatcacctggattctgccctcactcccactgtgcatgccctggtcagaggtggggctgctgcccaggactctgggggctcacagagtttatttcactttggccttggagcaagtgttatctgcagatccgaagaggttcttgttattattgattaagtatgcattcaatatttgaaatgctttaaacaaactgcttcatgtttggatatattgagttatttttgtttctgccattaaatgttttactctccggttattcttcagggaggattgtgctcatcagtgttctcgtgacttttgtttgcctctctctgcattaaacacccaaacatcagtgagatcctttagaatctggcaaaacttcagagaactctgaggaaatgaaactgcctgtccactcagtttcattgatttttctgagtaaccttaaaggcatatcttactacttaagaagtagagattcagtaaaatgttgtttctgctccaaggataaaaattgagaacatttaacttgtattatatacttggaatcataaagacaaattgaaatagttgatgtctgcccagatagaatgtgctagctttctctggcttaaccatctctgaaaacacattgacataaatttccatctttctcaccacgcaagttgttagtacacctgttcttttgaaaccacaattctgtttgttcctgtgtgttgatggtattttcacttttctcctgctgcccttgaacttgccagactctccagcacttgtgtggtacttttctcattcattacttctctagtggcattactgaaggataaacagctgtctagtcaaaattatctggccacgttcagtgggttttaggtctgaaaggggagccaaataatgtgtgagtaaactgtaacactccctaagagtgccaaaaaaattagtttgcctggaaatccattagtaaaaaatatcaaacattcctaaaaattaaacaataggaaaaacaagcagggttttagttgttaaaaaggacagaccaaatatttggtacttttactcgcttaatacatcaaacatgggtcttctgtgctacttgtcagggggattctgaatatgaagatcaaaccttgcattacccatacctcctaagtgagagcacctcaacattttgtgcttaccttacaactttcatctaaagatctccaagatctgtgaatacttatgttttaaattacaggaaaaagttaagttgttgcttgccaatatgtaataaattaggacactgttttccagtttccagttccattttaacttgtagagaataaacgttttcaatccttcaacagactttggagtcttttcatccttaataaatgttaaaggagagataaaaccccattgatatctcagcattataagcaatggcattagcctcattaaagtgaggaaatattttactacaaacttttataacatttttctttttaatcctcattcatccctgattttgccctttccctgcatgcatcttttttaaatctccacatcttttggtggctacatccgtgtattagtccattttcacactgctgataaagacatacccaagactgggtaatttataaagaaaaaggtttaatggactcacagttccatgtggcttgggagacctcacaatcacggtggaaggtgagggaagaacaaaggcacatcttacatggcagcaggcaaaagcaaaatgagagccaggtgaaaggggaaaccccttttaaaatcatcagatctcgtgaagcttgttcactaccacgagaacagtatgggggaatctgcccctgtgattcaattatctcccactgggtctcccctacaacacatgggaattatgggagctacaattcaagatgagatttgggtagggacacagccaaaccgtatcaatcggttatttggtgcctggctgccagtcgcactccaccagaaccctcctcttgctagcccagctggacattctccttgctggtgctcttagtcaagatgtaaagtctggttagtgtctgagctggtggtcagagcacttatctgccctgaatgctgcaaaccattttaaacccctacgaataatcaaatgtgtatttgaacaaatcttcagtttctggtgtttaatttgaatcccaggctattgttatagtgtttttttctatgataattgatgtcctttatttaaactcatgggaacagaaaggagttatcctggctctcccctgatagtaacaacacccctcacaattcactgtgttgttgaacttctcaagaaattacctatagaatagagaatgcaggctgggcgtggtggcttctgcctgtaatcccagcactatgggaagccgaggtggatgaatcacctgaggtctggagttcaagaccagcctggccgacaaggcgaaaccctgtcttcactaaaaatgcaaaaattagctgggcatggtggtgggcacctgtagacccagctactcaggaagttgaggcatgagaatcgcttgaaccctggaggcggaggttgcagtgagccaagattgcaccactgtactccagcctgggagacagagtgagacactgtctcaaaaaaaaaaaaaaaaaaaaaaaaagaatagagaatgcaatctaggaggactctatgcttagaatactttggtcttatgaaaacgtgatgttttggagtgtggctatgatacttaaatctaatatatgtttagtaaatatccagataggagcctattctgttctgtgtactttgctggtgctgatgactagcatacataaaaatagctaatattatttagcactgcttctatgccaggcacaatattaaggtgggtattttgttatcctcatttctcaaataaggaaacttaggctccgagattgagtacttgcccaaacccacagtgcttagctcctctcagttccctgcatttcagtgaaattagacatggggcagtaggggtgataggggaaagtgatgatggtcataaaacacctagacctatacctttttgtttatacctagtcatcatttagctcaagttttccttaacttctggcagcagagtatacctaatagtataactagtctttaattaagaagcagccttgacacagacaccctagtctctaatgtgcgattgcataaggcctcctgctccctgtgcctgggctctcatctctctggtggtcacttggctggctctgtcctgtccttatggtttcagctcctccacaaagcccagtcattgcctcccatgaatggagagatcttatctctttttctcactcactccgtgagggacaggaccttgtccatcctgtttgctgccctttttccagatctggagtggtccctggaacatggcagcactcaagaaagatgtgttaaaggaataagtgagttctttcttccaggccaagactgatgcttcttgaaatgctcccaatcaaccctcttagactccaacataactgaccagggaccagattagacaaacaattctgatatttgagggtttgatttacttaaattctcactggggtccaagagcaccccttgccagctcctatagtttaagcagcagtatgtagaatagccaatgaaaagtcaaggtcacagagtagctggacaaaggcttagaaaaaacaatgcagtgacctaagttaatgtttagtgcctttaacctctattttcggtgagtggccttttccctaattatttgttcctccaaatcattgagcccttctgtgtggtaggtcctgtgctaggtcttggaaataaaaacattaagaaactttttgctcttgagaagcagagttcatggggaagacaaagccatgaacaactgattaacaatagacagagctaagtatagtagaaaatgtgcacataaaatgtagcagaaatacagagcagagatgaagaccatctagggcactaagtggcaggttcacagaagatatgatctttaacccgtggcactttaggcaagggagccaacatgtgcaaaggcaaaattagcatgaaagggcatgacatattctaacaacagggagaagttagttctacgtgactgaagctcagggcactttttatgggggaggacaggagttgatacccaaaaaggaggttgggggcagatatgaaggattctatatgtgggcctgaagttggaactttttccctgattggaaagcaatcaggtctttaaacatgcatgtggcctgattgattttgggttttacaaacacctctggtgggaacttgaagcggtatataaattagcccaggagcccagacagaggagtgcctgacctaaagcaatgggctgcagaaggggggatgattggaaagctgttttaaaggtagacttggcagaatcaaatgcacattctgtcagaaatgattcaatgtagtgcaacagggaaagagtagccaagcgtggtggcacacacttgtagtcccagctacttgggaggctgaagtgggaggattgattgagcccaggagatcgaggctgcagtgagctgtgatcctgccactgcactccatcctggttggaggagtgagactttgtctcaaaaaaaaaaaaaaaagagaagatttgagaatatcagaatgtaatttgaatatctaggtagataatgtctccaaaatcttttagcaggagaagattgaatttaccgaatcctttagatgtgtactaagacatatattagcactccagtttgcctctcagtaatttaaaaaaaaatccaaagaatcaaccatcaacaagcagatacttttctgggacaaagaggcttctccatttttgaaacgatgttgcctactcatctgttagtcacccttgcatcagggccgtgttcaaagagatgtccaggcttggtatgaggctgctagagccttccttgcttttccttttgtgatctttgagtcaggttgggaaggatgactagggtaagccccagctgaagcatgcacagggatgttggggtagagatgatgtttcagggcagccctccacggccaagccacacattaaattgtttggggagtagttctaaaaattaatgctgttgtcatggtttcattttgatttttatcagctggatatggatgaggcttcattgtcatatacttaatgtttttgcttagatctttggcaaaccaatatttttccatgactttttgacagttatttttgttcaatagtgaataataaagtgagatttacggtctgtatatgataatgtttgtcttactttgacatttcttttctagacagtaaaggccttataattagattttccctgtgccaaaacattgctgcaaaaccatctccctgaaaaaacgtttctttgcttcttttaggagctggcgtcatcttattttgatttggaatttttttcatatgtcagtcaggaaatgaaacaaaaatttctcttgaatatgaattcttaacaagaaagaaattaacttttgccgaaaaataaaactagaagggaaaatgagaagaaacgtctttgaaatgctgatggttccattgtctttttaaattctaatttatgtcaaacttcagtgagcaatataggaaactcccttttccaccttgttgcaaaagagcttattttattcttgttgctactcctaccagttttatgttgaattctttgaaatacccaggagactgaactagaacttatggaccgcaccctatttctcatatagttaaccaactaatggcctaactcagtggattctgccccattgctgataagtggcaaccatcggccaggtgccatctgtgggggtacaaggacaggcgaagctgaactgcccttctgctgaggccacatctgcagttggcgctatgccaggagagccttggagaagttgcacatgtgtccattgacagtgctttctctttggagtgctcttaaaaagaataactgttgatagaatcgcttattgctaatggcaaaacatcacagagaactaattgcaaaaacagtcacacttactacatccgtggcctcccctaatgatatgtggaaacaccttccctttcctacagtagcaaaagtggccaaattctctgtacaacccggagaattttcctaattttcctatctgagtcataactgaagagctgctcctagaatcagattccagatccagccacccttgtccccatcatctccactcttatttccaccaccatcttcatccaatactttccgttgagcactaacaaatatgtgcaactgaaggacactacataatacctcagagaagtgtatctatttaaaacagagacaacaggcttcttctaaagtattgagccagcatcacttacagcaatccagacaacagagtgaaataatcgttctgtctcagcctttcttgatatcacgggaagagtgtaggtatttctttccagtgtatttttgtatcacatgaatagcaccttcttctaagtttcgatacattggttatgagtgattgctactctgtgcagtatcatgaacatggaggaatttcttctttctactgatggtgaccttttgttgttttgaatatacgggtctgctcagcttcaatatgaaatggaatgtgtatttcaacaactggcctgagtgaatgtttgggccttgagtttttgtcaagaagtgatgtggggaggtttgaagaaagattcttgtaagtctgtgatgtcaaatgatgagattgtctgtcaccgacccatgtgttgaagaattgtttcctcacctgatctaactcaagactcttctctactccctttcgagaagcacagaaaagaactgagaactggtgtgttaagggcgccaccaaaagtttccttggcagtagagccttgaatttcttccccaacagcagctaagccttctctaaaaggaattaccattaccttgaaataacttcctatgtacactcataggaagagtgtacactttgctgaggttgaccgtacttgtggttttcatcaggaagtgaaagtttatgtggcctacatgtgtgagcccactctatactagggatagcaggagtgtggtgctctaggggcagaggcctggggtgtcacacagaccttgttggaatcctagcattgccatctattcactgtttggctttttcaaacttccttttaaaaaacgtgacaaaatggttataatactaaactattcgggttgttgtaaattttaagaacaacagcagttactaccatgtattgagcacttaggttgtgtcaggtaccctgccaagaaaagatcataagcaatgtcacttcatttccatcataatacatgaagtagtgctatggtttggatgtggtttgttcccaccaaagctcatgtggaagtctaattgccactgcatcttgggaggtggggcccagtaggaagtgtttgggtcatgggggcgggttcctcatgaatagatcaatgctgtctcccaggatcgagttctcaatctcaagggaatggattagtcgccatgagagtgggttgttataaagtgaggctcttcctgctctttggtccctctttacctgcacctgcctctccttccacttctctgccatgttatgatgcagcacaaaagccctcaccagcaactgatgccagtgcctagcgcttggacttatcagtcatcagaattgtgagccaaataaacctgttttctttataaattacctagtctcagtattctgttatagcaacacaaaatggactaaatcaattagtgattgttatttccacatgaagacgaggaaactgaggtggtatatcacccctggccacacagctagtgagtgtctggcctcaggcttctattccaggtctgccaaccccagattctgtgagagataatgcaaaatcagagtcactcctagtgcagtcagtgcttaacaagtgttcattctctttcctcccagatgcatcttgtagctttgatagatctctgatttcttaataaatttttatatgtaacattctatacagcaggtggtctgtcatactgccctcatgtggctcatttgggtaatagtgggttttttttttaaagtttaatgcaaaatatgtgttatttaaaatgtgtctctaaagtcacctaaatctgtggatactttgggagtttgtatgattctataaccccagtatgtaagaaatggcactttttcttttctactgcccactttaatgtcttaactctgagccctcatttggctgggaagatacttaacttcagttactctagtagcttctaccctgtctttgccaagatctcccattccttctgttgtcttggaagagaaaccttctcttccctggtattgtgcataatgaaactttatttcaccatcctgtcaagaggggaaaaatttttttcacaattatatttttccatctaatgttctgtttacagagacatttatcaaccactggagaaatactcagctttcacacttaagaaagagatattattgccagagtgtagagtgttaattcattttccagtttaaattgtagaattttttttccaagaggaaaagaaaaaggtcagtttttgtctccacctataaggagcattaagtcactaagtgaaattcccttagttttctcttcatgcatggagagggtcccagcttccatggactcattctcccatgctatacaaagttacacaggtgtatttaaagtttagtggattgtttagcttagggatctccaaagcgcatatcatcgagggactgccttgttttccagtggctctctccatggaggatttaaaggtagatatgtgtcacactgggccttacttatgtctgaataatgaaaggctatgtcaatgggaaaagggaatttagggtgggaaaaggcaaggaattttctttttttttattatttaagcaccatttagtaacaatgtacatacagtctctgttcttaaatgtatttaagagttaacatcatcctcatgccaagaccttactgtgtttcagataacggagggcagactttggcagggggtaataactggccccttcgaggaagaaaatggagcctgtgggaaggaggcgtccgaggggtgggctttgtggcaagccccttgctgaagcagaagggcgtgaagaaccgggagctcatccacatctctgactggctgccaacactcgtgaagctggccaggggacacaccaatggcacaaagcctctggatggcttcgacgtgtggaaaaccatcaggtacctacaccctgccctttttcctcccaggacagaaactccaagagcagcctgactccattgagcaagaatgatagcttttgtgttaaaatgatagttcagcttacaaatacatgatttttaagaaaaataagtgcctttagagacattgtaagtatatatatttttaaattataaatttgagattgtgggcctgtgttttacgtgaagaacaagattgtcctcagcccattgccctccatggaaggtctttgaagctgcgacgttttgcttagaagtaggctagggtattgttagcttcctgcagggggtcagggaactagtcctgttgtctgctggaagaatggaggacaaaacagcagggaaaaagctggaataggaactagggatatgtttatttccatttattagcaagtatctaacaagcacctactatgtgccataccttcttctagatgctgagaaattaggaatgaacaagtcagtcaagatcctgcctctcaggaagctgtattctagttgggggagaaagatgttggacaaatgaacacacagatgagcaagatgactgccagttgtgataagtgccaggaaggcaaaaaagtatgttgtgatagatagagctggctgatgtgaagaagatacatcagggaacaggacccagactcagatttggaaatcgtgatggtctttttcctgtttaacccccacagtgtagagcaatagcccccaaggttgggaggcacatgccttagaggttgcaagatgttcccttggagtacaggaagaaaatttcaatcttgtatttgtattaatatctaatttcatctcatcctttttaaagtatatgttttttaagacacataatatattagtagacttgtacataaatctaatttataaataaatatgcatatattggagatattatttttacgggtggaatgacctagtgcaatggttttcaacctctgtttggtgttacagctctgtttggggttagcagctgattgactgtcccttagtggccagggggagaggacttcctcaggccatctcttcatcccactccaggtatcccagctcaagaatagtaggtttcaggtctctagttataggaaatacacaatggagtatttaggagcaaaaagccatgatatatttaacataccctcaaatggttcagaaaaaaattgtgtgtgtgtgtgtgtgtgtatgtatgtacatgtgcacagagagaattcaaatggactgcaaaattaaataaaagaatataggtaaggtgcataagtattcttttgttatgtcttatttttgcaactttttgtaaatttgaaattatttccaaataaaagtgttttaaaaataggaaggtctgacagcactgcacccacatttccagaaggccaacaactgactagaatcaaatagctgctgccttctgtagatgaagtatccacccttcaaatcttcaatctctattgttcccaagttccaatacagatccactgcactcatttaggttacctacttagtctctgtaggcatttaagtttatagtccctgctgaacataatcatagtattcaacactctggaaataccatactttgaccaatttccagttgcaaaatatatagattatttcttatctttttatattatcaatttttctgtaattaataattaatgttaaaaaatagtagggttcagcagcctaagattagtttttacaaaggaagtttgatagctattcaagtttaaacattaaagtttaaagtcctgtgagttcaggaatggatagaagaagtgttcagccaggccgctcaacctctcacaacgtggagtctatgggttcctctctaatgggcctcacccacaagggtgagactagggaaggtcctcatctcttacaaacccaagggaaaatctgatttaattagctttataaccttctttcaattattttgcaactcaaagttccatgttttccttcgagaatttattaaattttaaagatcacttttcaagcagcaacatttgtagtattgggtagccatttcttcaccatttctaaacattattttggttcttatgagtcatattattttcatattattttaaaatcctcactagcctcaaattgttccctcttattcttgcctgaaaagttgatttgtcagtttggagacagtgatcagtttatgatttgtcatttcaagaacactctacagcatccaagtcacagaaaaagtaatgccactgaacagctaagctgagaagcaaagcagtaaaaccttttctctcaccagaaattttgaagctttgtgctcattatgtgctcattcatatgcgatgacttttttttctttttctttgaaacatttctgcctctatccatgatctaaacttgatatgttaaatttaaatttaatttccccaagtgtgagtactatatgtcattgtagataatttgcaaactacaaaaaataaaaataattggctgggcgtggtggctcatgcctgtaatcccagcactttgggagaccgaggtgggtggaccacctgaggtcaggagttcaagaccagcctggccaacatggtgaaaccccgtctctactaaaaatataaaaactagccgggtgtggtggtgggcacctgtaattccagctactcaggaggctgaggcaggagaattgcttgaacccaggagatggaggttgcagtgagccaacacggtgccactgcactccagcctcggcgacagagtaagactccgtctcaaaaaaaaaaaaaaaaaaaaaaaatcactcaaatcttacctagaaacaactactataaacattttgtcatatttccttagaatttttcttttcagcatttttttactacatcttttttccttatttaacagaccattggtttttgattgtgtcatccaagaaacttactgcaaacactatttcagtcactgcacattcaatcgcatggatataccttgatatacttacccattcccttgactttcttttttagttttttaaaacattagctctgaaatgagctctttctacatgaactgtttgtctacattttggactttttcccttagatataaatgatttgaaattaaatcattgagctaaagaaagtgaccaatgttggggcttgaaaaacaataccccaaactggaggccccagaagcagcctctacaacagaagtttttctctgacctcctcctgctctcttgtctctcagtctcattttttcctgaggcaagccatggaaaccagaatccttcttccccagggcaggtcatagaaaccagaaccccttctccccagggctaatcataaaacctagaaatattattctaattttccctctgccctatttgtgtaaaaagtggccataaaaaagttatctggcctaacttgttttaactgtaggtcataacattcccattccagagcgggtccaaccccacatccagaaggaaggaatgcatgcccagagaggccgagaagaatccagagagacagaccttgctgggtttccccactcaggctattagcattagagcatacccttttatccaatcatgtttctatatggctgtccatactttgttaaacctatacataaaaatgaacgatttcctctatatctttgggtcttcattctaaaggctcccatgtatacacattaaatacatttgtatgccttttctcctgttaattcaccttttgtgaactgatttttcagtgaacttgcggagggccaagggtggcccctacatgattttaaaagcatttgataaacattaccaaactgctttctaaaaaggctgtatcaatgtactcttgtacaggtgtagaaagtgctcatcttcctcatagcttttccttatcaagctttttaaaaaacctttgctaatgttatagacaaaatagtcttgtattaacttgattttttattattatggagattaatatttaactttttatattccatttgtattttgtctttgaaagtattcattccatgtgcttttacacttattttactgaaaagtaggtgttttttgtggatttgtttgcttctttatgtcaggtttttggattgttgtatttcttgcaaatatttttcctttttttttgtctttttattttgtttatgtcttctacatggatgtctttcccatgtttatttgtcaatgaaatgtttttctcttgcttttttgttcagaaatatttttctcagcttcaaatgtgctaaatatctattttcttctaggtgttgtggtttgagtttcttccatgtatttcttttttctttttttttctttttaagacagagtcttgctctgtcacccagactggagtgcagtgatatgatcttggctcactgcgatctctgcctcctgggttcaagcggttctcatgtctcagcttcccgagtagttggaattacaggtatgcatcaacatacccagctaatttttgtatttttagtagagcctgggttttgccatgttggtccaaccagtcttgaactcctggcctcaagtgatccacctgccttggcctcccaaagcgctggaattacaggtgtgagccattgtgctcagccataattcttaaattgttgcaagatggtgtgcgtgttatgtgaggtcagtgtctaaatcagaggagtaatgttttttgcagttttttaagattgtaggcctctttaagaccgatgaaaactatgaacttacaggaaaaaagtacctaaacataggcacaaaaatctagatattacctattttgtgatattagaaattgattacacattcttttctaaaacattctttacaagcctatgccccttttgcttattttaatgcaaaacttaatgcccacttcatggtaaaaataaaacaaagatttccaagcaaagcaaatcttgaactttaattcagtttatcatcaactttcaatataaaggctgtagcggtttggcttggagtaggagaaagctttgagtgactttgagatggcaacatttgtggcatgcttgatatccaatcatttttgatttttcttttgttttgttttggtggcaaaaatgttgtaaaccctggcttgcataaggacataatagcatgtggaatcaaagctttataggacactttgccaggtgagggtgggattgaatcgaaaaatagttgaattcattttgagtcccaaatttactgaggttattatctttggcaaagttcacatcattgatgtttgtccatatagctaaattttggattacaaatgcacatttcaaccttaagattatgttgatcagaagtaacctttaagaatttggctcatgtttgcttctgactgcagagaaattgggaaaagtctaatcactcttagctccaaattgcagatctttcttcggtgttagcacgttctcctagcggccaatctcttatggaacaggggcacgttcttcagtaccgtacatagtggtgactgcggggctttaaccaaaagatatggccaaaattattgtccaagtaggctaaatcatgagataatgggctttctttttttttttatttaaaagtaaaatttctgcccaaagtttgatcatacatttcaagacttgttttctggaaattcagcaaatttctatttagaaagcaaaaaaccgctctcattctgttcccattgcttgagaaaaattcctgaaataataattcagcctcgagcctaatgaagttggtgcttctcacagcattaggcaagttcggaatcggtggcagaacatttggcacccctgcctgctgatacagaaatcgcccagtcacattgacgtctgttgtgtcttttccaaagcagcaaaaacaaatggacagccaaatgtcagagacacccgatctgtgcccagaggtctgaaacttttttccagaaatggaaataccactttcgagatgatggtagtttttgaaaatttgaagaggctcgtgaaataggaatgccagtaacggatgaaaaacagttgtctgtgctgagagcatcagaagttttattagctgtatagttacaaatttctcttaggactgcttcaaaatattaaaatgttagaagaaatagtagttctggagtgggtgacattatttacaatagcagctccttcgactgcttcagtttttctttgttccaagccacagactatgtttgccatttctaggggacatgacttctctaagcaatttccaattctgtgtagtttttctgcttttcagctcaataatcagcctataggttgtttgaagacatttcataaggttgattgacaaaaaggaaaaccaaaggattaaaaccttgcaagtttctttttaattattttatatttaattaaacaatgtaaaacataagcagactaggcgtggtggctcacgcctataatcccagcactatgggaggccgaggagggaggattgcttgagcccaggagttcgagaccagcctgggcaacatagcgaaaccctgtctctacaaaaaatacaaaaattagctgggtgtgttggcacacacctgtagtcccagctactcaggaggctgaggcaggaggttcacttgagcccaggagcttgaggctacagtgagttgtgatcatgccactgcactccagcctgggcaacagagcaagatcctgtttcaggaaaaaaaaaagcaatctcctgatcataatgataggaatttcttttttatcatcaatgggaaacactttaagatgtcataacatgacagtggtgacaactgaatattaaaatatcttaaaaacttagtatgtcattataaagacttttcccccactatcaatatcatttcaagaagaaagttaaaggaaaaacaaatcttttcacctcaattttacagatgccatgaagccaaataaagcatgatggtccatgagctaaatgttaacctctgatctaaaatggatacttcaagaaaaaaaaaaaaacacataaaatgatacttcattccacatactaacaagagaactcagactaattattgaataatatttctcttttcactgacttatggcactattttaggttttaagttcttatgagtactgtgctctgtcttggggccccctgttttagcccactgacttatctgttctcatgctggcatctgactattaatcattgtctttttcgagtatatttaaatatctggtagaaatggttatcggcctgtccttcattatattgtctttataaaattttcttgacaactctcactttttaatttttcttggtgaactctagaattattttgttaaattaaaagaaaagcttctcaaaaattatactgagtgagattaagcctgtaaattaatctggcaacaatgtacatattcatgcttttcacttggacacttaaagttgtcccccagtttactaatgctctttttatttaaaaaaaattctgttttctctttatttcattttgggcagtttctatttctaagcctttaaggtttttgatttttttctcaatgtctgatctttcatcaatttcatgcaatgtatttttcatctcacacattgtagctttcacttcttgaagctccacttgggtctttttaatatcctccctgtaactacttaacttcctgaacatatagaatacagttataataaatattttaatgtcccctgctaattccaacatctatatcacttctcagttggttgtgattgattattctcctcattataccggtcatatttctatcccttttggtctttgattcaatgccaagcattgtacattttaccctgttgagtgctggatatttttgtattcttgtaaagcttctagctaggcagggtgtggtggctcacacctgtaatcccagcactttgggaggccaaggcgggtggatcacctgaggtcaagagttcaagactatcctggccaacatggtgaaaccccgtctctaataaaaatataaaaattagctgagcatggtggcgggcgcctgtgatcccagctactcgggaggctgaggcaggagaatcgcttgaacccgggaggcagaggttgcagtgatccgagattgcaccactgcactccaacctgagcaacagactgagaccctgcctcaaaataaataaataaataaataaaaataaagcttctggctttgttctgagatgcagttaagttatttggaaacagtttgatcgttttgagcattgcttttaggatttattaggcaactgcagagcagtgctcagtctacagctaattatactccactgctgagtcaaatcctctctagtcaaaccttctcacagcagcctgtgagtttttcaaggctggctgatgggaacgggtactgttcccaactctgtgtgaatgctgagcagtcttccccttaatccttacaggtagttctttcccgtgttgtgagtagttcactcacaggcatctttttctaagacaatggtccccaaactctctggcaccagggactggttttgtgagagacaatttttccaccgaccagggttggtcgggggatagtttcaggatgaaactcagatcataaggcattagttagattctcataagaagcatacaccgtagatccctcgcatgcgcagttcacagtaggattcgcactcctatgaggatttagtgctgccactaatctgacagaaggcagaactcaggcagtaaagcttgctagcccaccgctcacctcctgctgtgaggtccagttcctaataggccacagatgggtaccggtccacagtctttgttgggggacctctgctctaaggggatcctctgcagatttccaggattctcattctgtgcagctttctcttctctggtcctctgtcctaagagctcaagctcccttggtctctggactcagctctgtctgctcaactcaaggaattcattggactacatttcagttgcccttccctgcaccagggcttagaaattctctcaaggcagtaaactgggcaatgattaaaaactcacctgctttgtttttcatcttggaataatcattgttctttgcctgatatccagtgttttgaatactgttttaaatattctgtccatttttctttgggttgttttaggcaagagggttaagtaaatctaatttggctggaagcagaagtatccaaagaaaaatttattgtgcctttactttctttaccagtattttcttgcctatttctcactttcaagtgttttaaattcaatctatcagtacagacccagctttttgcaattgaatactttaaatcttataactcttcttccaaagcaagtttcttcttcattctactttgtaatcacatgttgtgaaattttatatatatatatttaattatgtttaatgttaccaacatttttatttataactttccttagttcttaagtttgattaatcttttgattagttgattaatattttaaagtaatttttcagtagaggtacataaatggtgagttcttccaaatttttcatatgaaagaatatatttctattaccatcaaacataaatagtaatataggtcaggcgcagtggcttatgcctgtaatcccaatactttgggagcctgaggcaggtagatcacttgaggtcaggagtttgagaccaggctggccaacctggtgaaaccctgcctctaccaaaaatacaaaagttgactgggtgtggtggcacacacctgtagtcccagctacttgggagactgagggaggagaatcgcttgaacccatgaggtggaagttgcagtgagccgagattgcgccgctgcacttcagcctgggtaaaagagcgagactctgtctcaaaaaaaaaaataataataatataaataattattgttaaaaatgaaagaatgtatttatttcatctttcgatcatgatacttaccaacaatgttggcataaactccaccttgtcaaataccaaaactgcaatcctgtcttgtttttgtttgcctttacctggttcactttgctataataatactcaccagtagacaataaactaacgtctacagcatcttgagcagaaaggatttaacaagaattctgtatattattaatattatttttgtttgaatgtaatatgttgaatgtatttatgtttgaatgttagaatattaatattatttatgtttgaatgtaattatttatgtttgagttctttcatttgaaagaatgtattctatggggaatggtgcaaatggtgatttttttctttgaaccatgtatttagaagtgcattgttaagtttccaaattttgggtttttccctagttaaattattgatttctagtttatttcagttgtggttttgaggaccacaaataattgaaatgctttttattatttcaattattattattgttttttaacagagacaaggtctcaatttgtcacccaagctagagtgcagtggtgcaatcatagctcactgcaacttctgcctcctgggctcaagcaatccttccaccccagcctcccaagtagctggcactacaggcatgtactgctataaccagctaatttttaaatttttattttgtagaggcagggtctcactatgttgcctcagctggtctcaaactcctgggctcaagcaatcctcctgcctcagcctcccaaagcgctgggattacaggtgtgagccatcactcctgggctaattgttttaaatttgagacttggcctagtagatggtctttcttgttgtccacatcaggtgtaattgaaaagaatgcgtattctgtagttgttaagtatagtgttaggtttttctttatgatccagtctgtaatgttttagtagatgaatttatacatatttataaatatttttatttctattcttagttttttcattgttttgttacatttactttttatctttgaccttttatttagtagttctttaatatttagaaaaatttatattttatcctactgtttatcattatacaaatatctttatataattccttagtcccttttttcttacttaggttccactatttggtttgtcacatttaaatgacatcttcagcttccacttattacccataaggaaatcaagcaacttatgtaacttttcattctcttccagttttgtgatttaagtagtgttattcctactgtatcagagcatgtaatatgtaatactgttctctctttatccacaattttgttttagttttagatcttcaataatatattcaatactgaccacccatccacttctaaagtgttcacaattatctcttagttggaggaattcatccttgaatagatttctcaggattctttgaattcttgcatgtttattaaaacattttctacaaccttgataattgaacaccagctcaaccggttaaaataaaacccttgtcccacactttcttgctttgagtttcttgaaaatgttaccctaatctttgcttgttttctatgttactgttgataagtctaatatcagcctgattttattcctttgcaagtgactttgtgttttttgtctgggcacccagaagattttttattatcactattattatagttatgatttaaaatctaagaatttttccagatgtgtcacaaaggtgaccctactgtgtcagttttctcagataaaagtgagttatttcactttgtatattcagatcttcttttatttcagagtttttaaaaattacagttttaggccgggtgcggtggctcacgcctgtaatcccagcactttgggaggccgaggcgggcggatcacaaggtcaggagatcgagaccatcccggctaaaacggtgaaaccccgtctctactaaaaatacaaaaaattagccgggcgtagtggcgggcgcctgtagtcccagctccttgggaggctgaggcaggagaatggcgtgaacccgggaggcagagcttgcagtgagccgagatcccgccactgcactccagcctgggcgacagagcgagactccgtctcaaaaaaaaaaaaaaaaaaaaaattacagttttaaatattatattctactgttttgtttttcttcttcaggaactcctagttataggtattattgaatcttctttacataaatttggtttctgtcaatttctctcgtatcctctttgcctctttattttttctttattttgaattaattatcctttctcttttaatttctattctctacacgctttcacatagagaatgtcatgtataatgttttgtcatttctaagattttgtcctttttttcccagttcccttcctttaaaaagtgtgatgtctgagttttacaatttctgaatcatggttgttgtttctttaatattggcagttgatgatttcattatatttaattcatgttgaaatatcctgtaatggttttcttctgccttatgactgtttttccatagtaggagaatgttttcatttgccaaatttttgaattctcattttctattttttttaactcgtatggtaactttgcatagatgctgagttctttttggttttgttcacgtttatgtatgttggcgtttcctggatctaagatagcaggcaatccgtaggagtgggatttggacactttcatttacttcaggtgcttcaagagcgctgtgtattgctatagtgaagtgcagtttctttgctaaatgtagcccctttctttttttttttttttttttaattatactttaagttttagggtacatgtgcacattgtgcaggttagttacatatgtatacatgtgccatgctggtacgctgcacccactaactcgtcatctagcattaggtatatctcccaatgctatccctcccccctccccctccccaccacagtccccagggtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttcatccagtctatcattgttggacatttgggttggttccaagtctttgctattgtgaataatgccacaataaacatacgtgtgcatgtgtctttatagcagcatgatttatagtcatttgggtatatgcccagtaatgggatggctgggtcaaatggtatttctagttctggatccctgaggaatcgccacactgacttccacaatggttgaactagtttacagtcccaccaacagtgtaaaagtgttcctgtttctccacatcctctccagcacctgttgttccctgactttttaatgattaccgttctaactggtgtgagatgatatctcatagtggttttgatttgcatttctctgatggccagtgatggtgagcattttttcatgtgttttttggctgcataaatgtcttcttttgagaagtgtctgttcatgtccttcgcccgctttttgatgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagctggtgattttgctcgttagttgatgcagtttcttcctagtctcgcaggtctttacattttggcatgattttgcagcggctggtaccggttgttcctttccatgtttagtgcttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactctcctctggcttgtagggtttctgccaagagatccactgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgtttgccaacttggttccattctccgcatcactttcaggtacaccaatcagacgtagatttggtcttttcacatagtcccatatttcttggaggctttgctcatttctttttattcttttttctctaaacgtcccttcttgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttgtttgcctttggtttgaatgtccttccgtagctcagagtaatttgatcgtctgaagccttcttctctcagctcgtcaaaatcattctccatccagctttgttccattgctggtgaggaactgcgttcctttggaggaggagaggcgctctgcgttttagagttcccagtttttctgttctgttttttccccacctttgtggttttatctacttttggtctttgatgatggtgatgtacagatgggttttcggtgtcctttctgtttgtgagttttccttctaacagacaggaccctcagctgcaggtctgttggaataccctaccgtgtgaggtgtcagtgtgcccctgctggggggtgcctcccagttaggctgctcgggggtcaggggtcagggacccacttgtggaggcagtctacccgttctcagatctccagctgcgtgctgggagaaccactgctctcttcaaggctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcctctcccccagcctcgctgccgccttgcagtttgatctcagactgctgtgctagcaatcagcgagattccgtgggtgtaggaccctccgagccaggtgtgggatatagtctcgtggtgcgccgttttttaagccagtctgaaaagcgcaatattcgggtgggagtgacccgattttccaggtgcgtctgtcacccctttctttgactcggaaagggaactccctgaccccttgcgcttcccaggtgaggcaatgcctcgccctgctttggctcgcgcacggtgtgcgcacccactggcctgcgcccactgtcttgcactccctggtgagatgaacccggtacctcagatggaaatgcagaaatcacccgtcttctgcgtcgctcatgctgggagccgtagaccggaactgtccctattcggccatcttggctcagcccctttctttttggtctgccttctcatgattctctgacactgtgttattataatggaaccctgatctttggccatgtccttccttccctttaccatccatcttccaaaggacacttgttcttcagctgctcctctctcagcatctcagctgcccaaggcagccactctcgtcctgcacacttccttatccaagctacttccttggactcccttttgactccccactagccagtgctttgatctgtcaggtatgagacctctatcaacattttgtcccttgggtgtgaccttctctttctggagtttatcttatcagacgttatttgagtcctttccccttgatatggtttggctgtgtccccacccaaatctcatcttgaattcccatgtgttgtggcagggacccagtgggaggtaattgaatcatggggcaggtctttcctatgctgttctcatgatagtgaatagggctcacaagatctgatggtaatataaggggaaatttccctgtgcaagctctcgttttgcctgctgccattcatgtaaaacgtgactggctcctccttgccttccaccatgactgtgaggcctccccagccaagtgaaactgtaagtccaaataaacctctttctttggtaaattacccagtcttgggtatgtctttatcagcagcatgaaaacagagtaatacagtaaattggcccagtagagtggggcactgatgaaaagatacctgaaaatgtggaagccactttggaactgggtaataggcagaggttggaacagtttggagggctcagaagaagacaggaaaatgtgggaaagtttggaacctcctagagatttgttgaatggctttacccaaaatgctgatagcaatatggacaatgaaatccaggctgaggtggtcttggatggagatgaggcacttgttgggaactggagcaaaggtgactcttgctatgttttaacaaagagattggtgacattttgcccctgccctagagatttgtggaactttgaatttgagagagatgatttagggtatctggcagaggaaatttctaagcagcaaagcattcaagaggttatttgggttctgttaaaggcattcagttttataagggaagcagagcataaaagtttgaataatttgcagcctgacaatgtgatagaaaagaaaattccattttctgagtagaaattcaagcaggctgtggaaatttgcataagtaatcaggagccaaatgttgattctcaagacaatgggaaaaatgtctccagggcgtgtcagaggtcttcatggcagcccctcctataacaggactggaggcctaggagcaaaaagtggtttcaggggccaggcctagggtccctgtgctgtgtacagcctagggatttggtgccctgtgtcccagccactccagccatggccaaaaggggccaatgtagagcttgggccatggtttcagagggtgtaagccccaagccttggcagcttccacgtggtgttgagcctgccagtgcacagaagttgagaattggggtttgggaacctctgcctatatttcagaagatgtgtggaaatgcctggatgcccaggcaagagtttgctgcaggggtgggatactcacggagaacctctgctagggcaggatggaagggaaatgtggggccagaacccctatacggagtcctagtggagctgtgagaagagggccactatcctccagaccccagaatgatagacccacgacagcttgcaccatgcacctggaaaagccacagacactcaatgccagcccatgaaagcagccaggagggaggttgtaccctgcaaagccacaggggcagagctgcccaagaccatgggaacccacctcttgcatcagcgtgacctggatgtgagacatggagtttgagatcatttcctggagctttaagatttgactgccccactggattttggacttgcatgggccctgtagccactttgttttggccaatttctcccatttggaatggtcggatttacccaatgtctgtatcccccttgtatttaggaaataactagcttgcttttgattttacaggctcataggcataagggacttgccttgtctcagatgagactttggaatgtggacttttgagttaatgctgaaacaagttaagactttgggggactgttgggaaggcatgattggttttgaaatgggaggacatgagatttgggaggggccaggggtggaatgatatggtttggctctgtgtccccaccagatctcatctggaactgtactcccataattctcatgtgtcatgggagggacccggtggcagataattgaatcatgggggcagtttcctccatactgttctcgtggtagtgaataagtctcatgagatctgatggttttgtcaggggtttctccttttgcatcttcctcattctctctttgcctgctgccatccatgtaagatgggacttgctcctccttgccttccaccatgattgtgaggcttcgccagccatgtgtaactgtagtccaattaatcctctttcttttgtaaattgtccagtcttggggatgtctttatcagcagcatgaaaacggactaatacactcctcttgtaccccctaaccctcttttgcataattctagcctgactctgcccttgggtgggtaccagtcctgactcttcaggtctcagagggttgtttcctcacttcacccagggtttaaataggccttgtctcctgcttgtgtcataggcttctgctttggttgatattactttctttctttatcaatatggtttttaaagagaatgtatgaagggattttaaatttagatggccaccattattctatgaaaatctaaaaattcacatgttcttaggttcttattccactttaagaaaaacagcactagaaactatagataaaacattatagatatggtttatgaaataaagatgataggaacaacaatcagtagccctgcatgcaaagactatgaagtgactatctatttttttttattattattatactttaagttctagggtacatgtgcacaatgtgcaggtttgttacatatgtatacatgtgccatgttggtgtcctgcacccattaacacatcatttacaataggtatttctcttaatgccatccctacccccaccccccaccccacaacaggccccagtgtgtgatgttccccgccccgtgtccaagtgtcctcattgttcaattcccacctatgagtgagaacatgcagtgtttggttttctgtccttgctatagtttgctcagagtgatggttttcagcttcatccatgtccctacaaaggacatgaactcgtccttttttatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcaagtccttagagacctacaaagagacttagactcccacacaataataatgggagactttaacaccccactgtcaacattagacagatcaacgagacagaaagttaacaaagatatccaggacttgaactcagctctggaccaagcggacctaatagacatctacagaactctgcaccccaaatcaacagaatatacattcttctcagcaccacgttgcacttattccaaaattgacaacatagttggaagtatctatgtttttaagttcaaactaaatgtttaaggaatgctatattatttgattccctaatttcccaaccttttggataaaagggcttctatcctacactcacagtatggagtgttctgaggttgtttcagattgttttgttaggtggttccatgttccaggaagctacatctcatgcctgatctcttccatgttagtctgctgcttgctgtgggggtggacatagagaggaaagcagccagcattcggggtgagaggaggcacaatggtgcctctctaaggacagttcatggaagatcatcactcttttttttttgtttgtttagcatagcccctgagtcccatcattcgatggaggcaaagcaaatccatcttcttctactttctttgggatcatgttttgattcttatggcagaatccaagaatgtgttgttcgtctcttcagcattggcattagtgaaaatccccttgggactttggcatatggtcttctctttagtttccaacgctgttgccagttttcatctttttgtaattcttcgtggatattaaaatggaaattggaagaaaggcatattagtccctgaagtttatcctgaattaacccagaagtcctaccaattattttttagtaatgaataggaaaagattatattaagggtatgattcagtgatttttgattacttttttctctagactacttaaaaaacttaataaaccttcttaataacaatctatatgaaaaatatctttccatatataactctagacccagtgaattcaacttacatatttcctcactgaatttcatcaacattttctaatttccgtgcctatactcttaatttatggtaatatttgcatgttgaaatggcttttcaggaagcatgggatttacacaaaccaaatatcacctgccccccatacacacacacccttaacaaaggaaataagtcctgtaaggagtttcaccgggatagtggttaaaaatcggtactctttgattagatctggtttaaatcctgtctcctccattaattacttgtgcaatctttaagcattgatttccttgtgtaaaatgtaataatagttacatttgtctgtaacaaatgtaacaaataacaacctatcctgtagacacctatgtgaggatttagtgagagagtgtgtttgaaacatttagcaccatgcctggaacattgtaagaactcggtagctggtagtgaagatgataacaaggatgatggtgcttccaaagggttaacaggtcggacattaccctgtggatgtgttggtcaatgttttcattagtaactggggttattttttttcttcaaaatttcttctcagaaagtattgtcattgctatttctaaaaatttgatactgcctttcagggtgtgtcttttatgacagatggtcagcagttagtggtaaaagaagtatggaatgtaataccatttcatttatttatgggaaatgttttgttgccccacccttcaactaataggaaaatgaaaatcaaaaactggaaactatttataaatggacagtgctgtgatctcagtgtctgaaactgtagacttttagaaaatatttatagcatattggaaactggtcactggtcagtggctgtctccttgccctgtttttgtaaataaaaatactctagcaaatgtgaaatttggggtaaattcaaacagaatactgaaaatatcatcagagacaatgatatactactttataagttttcaagagaagagggtgaagaaaaatgtttaacttttattaatagaagcatttgcagttaatagagatatttgtttatggagccttaaaaataaaccaaatgaatggaaacaccatacattcaaggagacactgaggccatgtgtacattttactgagcagagaatttagcatagaaggttagagatgggatttgggggtcagtctgcctgagctccaaacccagtcctgtcacctgctcaaccacatgattgtgtaagtcacttaaccatgccatgccaagcttgtctctacctcacagtgttgaaggttgaatgaaatgatacgtgtaaagtattttaaatggtgtgttgcacataaaaaatgttctatcagtgcaagctactgttatccaaactagcctagccaaaacaaatgaaaccccaaaataactagtttggttgttataggcatgggtaaaacttgccaacttcaccggtttagaggtaggtcttcatcactaagtggcaaatggcaaacaagatagttctgttattttctttacataggtctttgtctacttactgccatagccaataatatgtgctgggatgggggtaaacattgtacggtggcaatccttgaactgtcccatgggtgcctaccttaaagaagctaattagagagctctgctttgttcctataagcctggagcccaagtatttgctgtaataaaaacacccattaccttgattcacgtaaaaccaggacatttcatgaacttgtgtgattattgaaaacccgtttatcattaacaccgtcagtcattatttagagatttttatttcacaaataaaatcaacaatctgataaagacagtattgctcatgcagctaaactatagcatctaccaaaaccaaaaaataaggaaaatacctagataacagattgcaatatgtattttttaatatacagtctataatgagtagactgtgtgacttgactatattgacactgatatttttccaaaaagagactctcatattggagagaacatcataaaatgtcttagaaattaaaattacatctaccccagtgtgtttcataaagggagcacttgccagcaagaagaataggtaggaatattaatgtttcattttatcttcatattattcttgtgtctgtgtcccaggttatagtctttgaggttatattatttccatgtctgcagaatctggatctatattttacaataaaagggcttttgttgcctcatgcaattctcataacaactctgtaagataggtacttttatctagattctgctgatgagaaaaacaacacccaagtttatatagccagtaatttctggagttgggatgcacaccctgaaaggctttgctcccaaagacaatgctatacttcttatgagagagtgatgtcttcagaaattggtcaggaggaaagttcattttctgatgattgtatggaaatgaaactttggaactgtatgatgtcctggaatactatagtatttgtagcattacctaaaaatgaatacatgcatatatgtgtgtgtgtgtagagagagacatagagaagatagaagctaacacatgattatagtatagcaataatcaaccccacaaccattttatggttctgatagggccactgtttattctgcaagatcacaagtgatcacaagagttgatattgctgaaactgtgttatgaacatacaacatacactttttctccaacccactttggtatacacacctttgtggaagaaattgtgtcattgtgataaagctttgtgttcaaggtactaatatccctatatggcatatattaagatattgattatagaaagttatcaacagatttcttaagatactttctgggaaaccaggacttgttttcaaggggaagccgttatcattatatatggacttcttacctaagtgtcctaaaagctagatacccatcttttgctctataggaacaaaatcaagaatttagaacatgtaatcacatatggtgacctctataacaaggccagagagcagtgattcttaatcttagatgtgggttaaaatcagattgcatttttgacaagggtgccaagatagttccattggaactattgaaaagactattggaaaaaatagtcctttcaaaaaaatagtgctgggataactggctacccacatgcagaagaatgaagttgaagaagcatgacatcagcaagatggtagactagaagaccctagtgctattctccctcaaaaagatagccagaacaatgaataaacaacttcattttaacaaaaataactgaggaggagcacagtggtgcacaagagaagtaacagataccctggtgagcacagaaacttgggatggccacatagagaatgggaagaaatgccaggcctccattaccctaaccccaattggaagcagctgggaatgaactaggaggaacgtttccctactgcaaggaggtaaacaaaaggatcccagcagccccatcaacaccgtggatacctacagacctgagcactggggtcccctgcaatcctcacaggcactaagcctagctgagggagctgcctgaagtccacatgtccgtgcttcccccagagaaggagccaatactatgatccacaccctgtggcccacatagctaccatgctatgccatcttggagttggaactatggctggatgtgtcttgctctgggggcaagtatgcatggctctcttttatccctgaggctaagccattgctgaactgccccagcccaatggcctgacatccccaagtcgagcaactgttttgtgctcccctgtggggccaagcagaggtggagctgctccacctcccaccaccctttcctcctcaggccagagctgaagcagtgtcctgattcctgggaaaacagtactttgactgctcagagaaatcatgcccctccaatgcctaagtcaaagcagcacgctgcatcctagggaaatggtgcctggtccacccagagcagtcatacctgttggactcaagccgaaatgacacatcaccctctggggaatttgtaccctggctgagctgaatagctgcaaatcccagggctgtgctgacatggtatcctgtgtcccagggaaacagagcagtggctgagctgagacaccccatcctgcaggccaaacagctctagtgtccttccttcctggggctgtactagcctcctgaagtctgagctgctgagatacccttgactctggggagtggagtcattgctgtgctgcacattgtcttccagggcccaaataacagctgtgttctgccattctagggtacagcatatttctctgcagaaacctgacaagccaggagagaagtggatgatgtattcaaagtaccaaaagaaaaaaaaattgtcagctaagcatgcgatacccagcaaatctacccttcagaaatgagagagaaagaaagtctcccagacaagtaaaaactgagggaattcatcaccactagactggctttacaagaaacagtcaagggagtcctgtatctggaagaaaaaagatgataatcattctcatgaaaacacacacaagtgtaaaactcgctggtagagcagatgcacaaaggagaaagagaaacaagagaaaaccttgttactgcagaaaaccaccaaactgcaatgatctcaaatatctttcctgaccacaatgaaatcaataacaagaggaacttttgaaattttacaaacacatggaaatggaagttaaacacgttcctgaatggtcaatgggtcaataaagaaattaagaaggaaaatgttaaatgtcttgaaagaaatgaaaatagacatacagcatatcaaaaacctatggtatacagcaaaagaagtgttaagaggaaaatgtatagcaatagatgcctacatccaaaaagtagaaggatttccaataagcaacgtagcaatgtatctcaagaaactagaaaagcaagaacaagccaaatccaaaattagtagaaggaaagaaataatgatgaaagcagaaataaacaaaattcacggagatctggcagccaagatggctgaataggaacagctccggtctacagctcccagcgtgagcgacacagaagacgggtgatttctgcatttccctctgaggtaccggattcatctcactagggagtgcaagacagtgggcacaggacagtgggtgcagcgcaccatgcgcaagcctaagcagggcgaggcattgcctcactcgggaagtgcaaggggtcaaggagttccctttcctagtcaaagaaaggggtgacagacggcacctggaaaattgggtcactcccaccctaatactgcacttttccaatgggcttaaaaaacggcacactaggagattatatcccgcacctggctcagagggtcctatgcccacagagtttcgctgattgctagcacagcagtctgagatcaaactgcaaggcggcagcgaggctgggggaggggcacccaccattgcccaggcttgcttaggtaaacaaagcagccaggaagctcaaacttggtggagcccaccacagctcaaggaggcctgcctgcctctgtaggctccacctctgggggcagggcacagacaaacaaaaagacatcagtaacatctgcagacttaaatatccctgtctgacagctttgaagagagcagtggttctcccagcacgcagctggagatctgagaacgggcagactgcctcctcaagtgggtccctgatccctgaaccccgagcaacctaaccgggaggcaccccccagtaggggcagactgacacctcacacggccgggtactcctctgagacaaaacttccagaggaatgatcagacagcagcattcatggttcacgaaaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagcagataaagccacaaagatggggaaaaaacagagcagaaaaactggaaactctaaaaacagagcgcctctcctcttccaaaggaacgcagttccacaccagcaacggaacaaagctggacggagaattactttgacgagttgagaaaagaaggcttcagactatcaaactactctgagctacaggaggaaattcaaaccaaaggcaaagaagttaaaaactttgaaaaaaatttagacgaatgtataactagaataaccaatacagagaagtgcttaaaggagctgatggagctgaaagccaaggctcgagaactacatgaagaatgcagaagcctcaggagctgatgcaatcaactggaagaaagggtatcagtgatggaagatgaaatgaatgaaatgaagcaagaagggaagtttagagaaaaaagaataaaaagaaacgaacaaagcctccaagaaatatgggactatgtgaaaagaccaaatctacgtctgattggtgtacctgaaagtgacggggagaatggaagcaagttggaaaacactctgcaggatattatccgggagaacttccccaatctagcaaggcaggccaacattcagattcaggaaatacagaaaatgccacaaagatactcctcgagaagagcaactccaagacacataattgtcagattcatcaaagttgaaatgaaggaaaaaatgttaagggcagccagagagaaaggtcgggttacccacaaagggaagcccatcagactaacagcagatctcttggcagaaactctacaagccagaggagagtgggggccaatattcaacattcttaaagaaaagaattttcaacccagaatttcatatccagccaaactaagcttcataagtgaaggagaaataaaatactatacagacaagcaaatgctgagagattttgtcaccaccaggcctgtcctaaaagagctcctgaagcactaaacatggaaaggaacaatcggtaccagccgctgcaaaatcatgccaaattgtaaagaccatcgaggctaggaagaaactgcatcaactaacgagcaaaataaccagctaatatcataataacaagatcaaattcacacataacaatattaactttaaatgtaaatgggctaaatgctccaattaaaagacacagactggcaaattggataaagagtcaagaccccccattagtgtgctgtattcaggaaacccatctcatgtgcagagacacacaaaggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcaaccaatacaggagcacccagatgcataaagcaagtcctgagtgacctacaaagagacttagactcccacacaataataataggagactttaacaccccactatcaacattaaacagatcaatgagacagaaagttaacaaagatacccaggaattgaactcagctctgcaccaagcggacctaatagacatctacagacctctccaccccaaatcaacagaatatacatttttttcagcaccacaccacacctattccaaaattgaccacatagttggaactaaagcactcctcagcaaatgtaatagaacagaaattataacaaactgtctctcagaccacagtgcaatcaaactagaactcaggattcagaaactcactcaaaactgctcaactacatggaaactgaacaacctactcctgaatgactactgggtacataacgaaatgaaggcagaagtaaagatgttctttgaaaccagcgagaacaaagacacaacataccagaatctctgggacacattcaaagcagtgtgtagtgggaaatttatagcactgactgcccacaagagaaagcaggaaagatccaaaattgacaccctaacatcacaattaaaacaactagaaaagcaagagcaaacacattcaaaagctagcagaaggcaagaaataactaagatcagagcagaactgaaggagatagaggcacaaaaaacccttcaaaaaattaatgaatccaggagctggttttttgaaaagatcaacaaaattgatagaccgctagcaagactaacaaagaagaaaagagagaagaatcaaatagacgcaataaaaaatgataaaggggatatcaccactgataccacagaaatacaaactaccatcagagaatactacaaacacctctatgcaaataaactagaaaatctagaagaaacggataaattactggatacgtacaccctcccaagactgaaccaggaagaagttgaatctctgaatagaccaataacaggctctgaaattgtgacaataatcaatagcttaccaaccaaaaagagtccaagaccagttggattcacaaccaaattctaccagaggtacaaggaggaactggtaccattccttctgaaactattccaatcaatagaaaaagagagaatcctccctaactcattttatgagtccagcatcatcctgataccaaagccaggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctgcttcaatatacgcaaatcaataaatgtaatccagcatataaccagaaccaaagacaaaaaccacatgattatctcaatagatgcagaaaaggcctttgacaaaactcaacaacacttcatgctaaaaactctcaataaattaggtattgatgggacgtatctcaaaataataagagctatctatgacaaacccacagccaatatactgaatgggcaaaaactggaagcattccctttgaaaactggcacaagacagggatgccctctctcaccactcctattcaacatagtgttggaagttctggccagggcaattaggcaggagaaggaaataaagggcattcaattaggaaaagaggaagtcaaattgtccctgtttgcagatgacatgattgtatatctagaaaaccccatcgtctcagccccaaatctccttaagctgataagcaacttcagcaaagtctcaggatgcaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatggacaggaagaatcaatattgtgaaaatggccatactgcccaaggtaatttatagattcaatgccatccccatcaagctaccaatgactttcttcacagaattggaaaaaactaaagttcatatggaaccaaaaaagagcccacattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccgcttacctacaactatctgatctttgacaaacctgagaaaaacaagcaatggggaaaggattccccatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaaaccaaaactgacaaatgggatctaattaaactaaagagcttctgcacagcaaaagaaactaccatcaaagtgaacaggcaaccttcagaatgggagaaaatttttgcaatctactcatctgacaaagggctaatatccagaatctacaatgaactcaaacaaatttacgagaaaaaacaaacaacgccatcaacaagtgggcaaaggatatgaacagacgcttctcaaaagaagacatttatgcagccaaaagacacgtgaaaaaatgctcatcattactggccatcagagaaatgcaaatcaaaaccacaatgagataccgtctcacaccagttagaatggcaatcattaaaaagtcaggaaacaacaggtgctagagaggatgtggagaaatagaaatacttttgcactgttggtgggactgtaaactagttcaaccattgtggaagtcagtgtgatgattcctcagggatctagaactagactagaaataccatttgacccagccatcccattacggggtatatacccaaaggactataaatcatgctgctataaagacacatgcacacgtatgtttattgcggcactattcacaatagcaaagacttggaaccaacccaaacgtccaacaatgatagactggattaagaaaatgtggcacatatacaccatggaatactatgcagccataaaaaatgatgagttcatgtcctttgtacggacatggatgaaattggaaatcatcattctcagtaaactatcgcaaggacaaaaaaccaaacaccgcatgttctcactcataggtgggaattgaacaatgagaacacatggacacaggaaggggaacatcacactctggggagtgttgtggggtggggggaggggggaggatagcattaggagatatacctaatgctaaatgacgagttaatgggtgcagcacaacagcatggcacatgtatacatatgtaactaacctgcacattgtgcacatgtaccctaaaacttaaagtataataataataaaataataataataataaaataaaaaaattcacgctaaaaaataatacaaaagatcgatgaaattaaaagttggtttttgaaacgattaacaaaactgacaaataattagctagatgaatcaagaatgtaaatggtccacataaaatcaccaacaaaaaaggagacattgcaactgataccatagaaatacaagtgatcatgagagactattatgaacaactatatgccaacaaattagaaaatctagtggaaatggataaattcatgtatacatgcaatgtgccatgattgaaccaagaagaaatagaaaacctgaatagaccaattataagtaatgagattgaatcttgtaataaaaagtctcccattgaagagaagcccaggacctgatgacttcattgcagaattctacaaaacatttaaagaactaataaaaattcttctcaaactcttccagaaaattgaagaggagggaattcttctaaacttattccacaagaccagcattatgttgataccaaaactagacagagatacaacaagaaaagaaaactttaggccagtatccccaatgaacatagacacacaaagcctcaacaaaatgctagcaaactgaatccagcaacacattaaaaagatcgttcacagccaggtgtggtgtctcatgcctgtaatctcagggctttgggaggccaaggcaggaggatcacttgaacctaggagttcaagaccagcctgggcaacagagggagatcccatttctgcaaaaaatttaaaaattagccaggcatggtggcatgctcctatagcccaggtactagggaggctgaggtgggaggattgcttgagtctgggagattgagactgcaatgagccatgatcaagccactgtactccagtctgggcaacaaaatgagaccccatctcaaaaaataaaaataaatttaaaagatcattcaccattatcaagtgggatttatcccaaagttgcaagaatggttcaacatatacaaatccataaacatgacacattacatcaacagaatgaagtataaaaaccacatgaccatctcaatagatacataaaaaggatttgatacaattcaacatcgcttcataatcaaaacactcaactaattagttatagaaggaccacagctcaacacgataaaggccatatatcataagcccatagcaaacatcgcactgaatgggaaaaagttgacagcctttcccctaacatctgaaacaagacaacgatgctcacttttaccacttttgttcaacagagtaatggaagtcctagccagagcaatcaggcaatagaaagaaataaaggacctccaaaatggaaaggaggatgtcaaattgtccctatttgcagatgatatcatcatatatacagaaaaccctaaaagctctaccaaaaaactcttacaactgataaacaaattcagtaaagttgcaggatacagaatcaacatacagaaatcagtagcatttctatatgccagcaacaagctagcagaagagaacacacaaaaaatgaaaagatatctcatattcatagatttgaagaataaatattgtgaaaatgatcttactaccaaaagcaatctacagagtcaatgcaatccctatctaaataccaataacattctcaacagaaattaaaaaatcctaaaatttacatgcacccacaaaagaccctatagccaaagcaatcctgaatgaaaagaacaaagttggaggcatcacactgccaggtttcaaaagatactataaaggtatagtaaccaatacagcatgttacttgtgtaaaatacagattcatataccaatggaacaaaatagagaacctagaaataaattcgtgtatgtatagcctactgatccttgacaaaggcaccaagaacatttattgaggaagagacagtcttttcaataaatggtgctgggaaaattggatatccacatgcataaaaatgaaaccaaacctgtatctctcaccatatataaaaatcaactcaaaatgggttaatgacttaaatataagacctgaagctatgaaactcctgaaagaaaacataggagaaatgcttcagaacattggtctgggcaaagattttatggagaagacctcaaaggcacaggcaacaaaagcaaaaatagacaaatgggattatatcaagctaaaatctcctgcacagcaaaggaaacaatcaacagagcaaatagacagcctgcataatgggagaaaatatttgctaactcttcattcaacaaaggattaatatccagaatatataaggaactgaaacaattcaacagaaaaaccccccaaataatccagtttaaaatgggtaaatgagctgaatagacacctctcaaaataagaaatacaaatggctagtagatttatttttaaaaatgctcaacatcactaatcatgagagaatgcaaatttaaaaccacgatgagatatgatctcaacccggttagaatggccattatcaaaaagttaaaaaataacagatcctggcgaggttgtagagaaaggggtactcttatccaccactggtgagaatgcaaattagtctagccattgtggaaaacaatatgaaggctcctcaaaaaactaaaaatagaactaccatatgatccagcaatcccgctactgggtatatatgcaaaggaaatgaaatcagtatatcaaggagatatgtgcactcccatatttattgcagtactattcacaatacccaagatatagaatcaacttaagggtccatcagtgggtgaatgaagaaaatatggtatatatacacaatggaatactctttagccataaaacaaaatgaaatcctgtcattcacagtaacatggatgaaactgaaggtcactatgttaagtgaaataagccaggcacagaaagataaataccacatgttctcatacatggaagctaaaaaacgttgatctcatagaagcaaagagtagagtagtgtttttcctgaggggtgggaagggtaggggagaggagaatagccaaaggttagttaatggatataaaagtacaattaaataggaggaataaggtctagtgctctatagcactatagggtgactatcattaacaacaatttattgtatatttttgaaaagttacaagagtgaattttgaatgttcccaacacagagaaatgataaatatttgaggtgatggttatgctaattacactgacttatcattacacattgtacacatatattgaaatatactctagcccataaatatgtatatttatatgtcaattaaacataataaaaaaagaagataatgaagttggatctctacctcacagcatacacaaaaattaacttaaaatggatcatagacctaaatgtaagaattaaaactataaaactcttagaagaaaactcaggagtaaagctttgtgatcttgggtcagacagtagtttcttagataaaagcaacacaggagaaaatacataagtcgaactacatcaaaatgcaaacttttattctcaaaatgatattctcaaggaagtgaaaaatcaacccacagaataggagaaaatattagcaaatcatgtatcagataagggacttgcaaatagaatatataaagaattcatgcaactcaatcataaaaagacaagtagccccattaaaatacgagcaaatgatctgaatagacatttctccaaagaggatatataaatggccaatacatacatgaaaagatgctcatcattaattattaggaaaatgcaaatcaaatcgcaatgagatatcactttacaccaactagaatggctacattcaaaaagacacattaataagtgttgtcaaagatgtggagaaattgaagcacttattcctggtgagagtgtgaaatggcgtagctgctttggaaaattgttcggcaagtcctcaaaatgttgtagagttaccatatgacctggcaattccactcctagttatagacccaagagatatgaaaacgaatgcccacacaaaaaattgtacatgaatgttcatagtaggattattcataatagccaaatattgaaaacaatcaaaatactaaccaagtaaatggataaagaaaatgtgatatcttcaagcaatgggatattatttagccatataaaggaatgaaatatttgatgcatgctaccacattgatgatccttgaaaacattatgctaagtgaaagaagccagccacaaaaggctaagtattgtgtggttccagttatatgaaatgtccagaataggcaaatctgtagagacagattaacaatcggctagggctggggaggggagtgaagtagaaaatgaagaatgactgctaatgggtacagtatttcttttgggaggataaaaatgttctaaaattagactgttgatgattgtgcaaccatgtgaatataccaaaaacatttaactgtgcagtttaaatgggtgattgtatggttttaaaattatacttcaataaagctaagtttgggtgcttttataaatctttatgcccaggctgaaactcagaactcagtctcctgggattgaacccatgcatcagtattttttaagagttcttcaggtgattgtattgtgcagccaaggttgagaatcattatgtttgaatcagccctaatccaaataagattttaatttaagagactccaaaagagttgagatcccatgtggaaggactccgggaggcttcctcaaaccatgatacctcaagtgtggttctgagaccagcagcatcaatgtcacctgggaaactgttagaaatgcagattattgggccccattcagttcaagtacatcaggatccacagtttaacaagctccccagatgattcatatgtacattaaggtttgggaagcactgcttaggagcagcggttcccatgcttggctgcacattggaatcatctggagagtccaaaagtaccaatgcttgggttccaccgccagtgatcttacgggtatgagatgcagcctgtgcatctgggatttaaaagcttcccaggtaattctaatgtacagcaaagtttgagaatgagtactgcaaaaaacaagatacctaatggcaaataagatggttaataaaattttcttattttgtttttaacagaaggatagatgaacatgcataagaaagtggagattattgatatcaaaaatttccagaggagtgaggaagggatggcagtgagacaacaatggaaaacgttttctctaaaaaaaaaaaaaagggaaaaaaacaaaaacaaaaacagaaaactcaccacacaccaggcattttccttctaaatccaagagagggatctttcatgtgattattggagactactcaaatttaagtggccaagaatttgtgggttcttaagagggtctttaatgctgaaaacatatgggtatttactgaacttccctttctttgaatttataaagagaaagtttattaatatggtggtgaacatttcttcccaagctgtgtacccatgtccagcttcttcggtctggggaaattttaactcctcagtagacagtgggccctgcgcagggtctggggcatgctcttcctatatatggcattcagccctgaggattctcctccccagcaatcggccatgtctctctaatgaccattgtctctgccatttactggtcttttcaaaattatgactctgaaatatctcctaggcaaaattatgaggcttgcagagttagctttgagacttctcatcacccaccccttcccctccttccgacaagctccgtttctgtcccatgcccccagattgtcttctccaggtgacttgaacccaccttcttggttgcagtatcagtacactgtacccttgtctgcactgaaattaaccatgcagtttctgtgccttcttaagttgatgtgtgtgtgtgtgtgtgtgtggtggtggagggtataattacttgaatctgtgttaataaagtgttaactattaacggaaatccacaatccctctctacctccccctcaggaagtccctaatggtgtttggtcattgtttcaatcacttgtcatatattgtgttttcttggcccatatctctaaccacatccttatcaaaatattctgatgagtgcattttaaaagtagaatgacaacatacttaagatagttggaggggttggctcctatttgcatcatgatgattctgcctatgaagatttttcctaacaatcaactaggattatacacaacgcttggtttcaaaaaatcatctcatcgtattaaatttacttattttaaaatacctgtgactcttctgaataatgaaaaaaatgacatgaatgaagagtatgtatataaactctctctaaagttattaggaaaatgtttttatttaattgtgcctaatattttggggtattacagtgaactctacttttaaagctgcgtagttatgtattaatatactggccctgaaatttttgagttttcaacctatagtccagaaaaagcctttatttttaatagttgccctaaaaatttaacacaaaagttttacttagctaaatctaaatttaatcagtagctttaccccacttccaaacaatataaatactttaaaatgctttcatttgatttcctttccttgcttgctattattttccaggattttaactctgtttgcttggttttatttgtttgtttgttttaagacagagtctcactttgtcatctaggctggagtgcagtggtgtgatcatagctcactacagccttgaactcctgggctcaagggatcctcttgcctcagcctcctgtgttgctgggactacaggcatgcaccaccatgctcaaattattattattattattattagtagtagtagtagtagtagtagtagtagtagtagtagtagtagtacagaccaggtctcagtatgttgcctaagcttgtctcaaactcctggctggcctcaagggatcctcccatctcagcctcccaaagtgctgggattataggcgtgagccattgtacctggcatacttgtttggttttaagcccacaaattagacatcatcatcattctatttagattttctcatatttaccattttctttacatatcatttctacttccattcagagcttctgggatcaaaccgtagttcctggcattttggactggttgatagtctccaggatattcaggcagttaagtgtctccgaaagaaaatgagaaaagaaaggtcctgggaaatatgccccacccccacccctgcagtgctgccgctgctgtcccaggaccgtgggcacccctgaatgtttctcttccactgtctctgatcactgtgatttatggagtagagggggacaatgacatctgatagaataccaaagttaaatatgctcaatttaaggagctgttatttattcagagatcctgtctttcctaccttttttgctgtttattttataaaataatggtgatggtagttgaagtttgttattttgttttgttttaaattaattcattaagatttgtttttatatttccttacttggcaaatacaaagttgtgaatcacaacccagattttttgaaattgtattgggcattgaaatcccaaaccactgctatcaacagctaactgtgagtttggcgtgtggacactgggacacctgaaaccatgtcttggttacgtcaggagccttattgattatttatattatgtatgaatcctgtggtgttaacagtactttgcaacctttagtacttagctgaactgtattagattatcagggagtcctcagtacaccctcaatgatttaaattgtttttagctacttctgtaaggctgagtctacactagcaaaatgacctgggtgcctattgtgctccctacatacatctggtgatgtttatgctcccaatttcttaagaacactgctttgagagtcacacaacccaatattctaccaataacttactatgtaccttcatcatttgtaagaagagggggttgaactaagcgatctccaagtcacttttcagcacaaatgtaggttgtgattgtatttgtgtgtacacattttttaaagccttaaagagatctaggtatttctcatgtatttatattaaatctaagatccgtgttgcaaatttggacatggaggacattaatttttctgatgtaggttactctttaagaggcatgttgcatctgtaatattggtgccaccattttggcagatgcagtttcttcatttactcgtaagtgttcagtatgaagtctatatgaggtgacttgagttctcatttctctggtgtaaaaaatggtcatgtttaaataaggccacaatatttatttcaaagggtcccagaatcattttttaaaatatcttcatatgcttgacactgaagttcttatgtaaagggttcggtcaatgtaaacaaacgatgactgcttgaagatgcaccagccgtgattgtggagacctccaaattcatgacagagttgttaactggcaggtttgttatttcctataagtacaaggaagggaagtattaaaataattcatgcccattagagagaggaaattaacattcccttaaaaattgttttccagtgaaggaagcccatcccccagaattgagctgctgcataatattgacccgaacttcgtggactcttcaccgtgtgagtaccagtgcattgctactagattaaatctaattggcccaccaagatggtttgattacctagtgtgtctctagcctagctttctcttttttcctgagttgctataaaggtaaacagttcttcgggacatatctcccgctcatctcagagggcagtgtgctgtgaaagcaacaccagcttatgaaataagaaaggtgaattctattcttgctctgccgcttactagcctttaagccattgaactctccctgccccagccttccccatttacaaaagaagaactcatggcatctctgaggctccttctcactgtagatgtcatgttgctgccctgttcttacctgagagctccagagccaccttccagaaaactcacagtcagataagccacagttgggttccaggtagtgtgagcaaccacattatctgattgggctggtcaggtactgcccaacacctgctgggtgtcacaagtgtgactttcctagcagtcctggaagtgattccgcttgattctgcctcctgcctaaattaacctgtaaagagccttaccatttccttcagggcaggcatgcatgtagtgcttccagatcacaacggactgtaataggcctgtataaataccatgcgagtggccctaatgccctcagcatagtgagtttgggcatagaaagccttagcaattagaccctttgcccagctttcatcataatgctcatcttgcaaacagtgcccttatattcccttattcacatgggggctcccatccgctcctttctggacatactgctgcccacttagttcaggctctccttacttctttgttttttccaaactgcattatagctcaccacaaaatattctcattcagagattcctgctcagagaattaccccacagtcattctaaatgtgtcaccaggcactcgggccccacttgcccggccagcctcactccaggcactccttgtcatgttctcacttcctagacacttgtcatctccatgcagatcatcgtactgtcatgaatatgcttttccctatgcctgaaacacattttccctacctgtctataatctctctcatcccttaaaaacccagccccatgtctccctctgtgaatgctttccagagccccagaaggagcagtcactccttcctgtgtgcatgtgtctccgtatagcatccctcacatgttcgtgtttgtgcctgcatttccaagctgagagctcctggaagtcagcatctcctgtatttttttatccttgtcagttaacacaaatactgggagcttgctaggcactcagtaatgattacttgatgactcagtggacaattggagagttgagatgcaataaagaccaagtggacacattaagacctggacaggaaagggccctgagacaggcgagaatggctacatcgtggagaaatttctatttcttttggagtaaacgcatgtcagtgagagaggcaagggcaaggtttgagccctaaggactgtaagaacagtctagatttgtgctgtccagtatagtagccacaggccacatgtggctgtcaggtacttaaaatatggctaactgtggattgagatgtgctgtgagtagaatatatacatccgattttcaagacttagtacacctatgtattatatgcatacaatattatagatttattatttgttgaaaggataatactttggatatattgaattaaatatattgttagtgttttacttctctcctcttcctttcttaatgtggctaatagaaaatttaattttaattaacttacataagtgacttgcattatatttctattggcctaaaaaccccttctagaaggtgctaggaagtaagttgatcagctgagctgatcacagagctgtgaatagttactgtgaggctacatcaatgactcctaaacttttctctaccccagtacacctaagagatacatttcagtcatatcaaagtctctaagggtggctggaagagaatagtggggaggcaggaatggctttaaaactttctgagtaatttaatgcactgcaaagcccagtataacctaggtctaggggatatgtggaatatgccacccacattataatggttgtaaatgtcttcacctgctaaattccacctacaaatgaaaaaccttaagacccctcactcactaagctgtattttggtttggcatttgaagtaggagcttgagaactatactcctatgtgatatggttgggatttgtgtcccacccaagtgtcatgtcgaattgtaatcccccatgctggaggaggggcccggcgggaggtgactggatcataggcatggattcccccttgctgttcttgtgatagtgagtgagttctcatgagatctggttgtttgaaagtgtgtggcacctcccccttcgctctcttcctcctgctccagccatgtaggacatacctgcctcctcttcaccttctgtcatgattgtaagttcctgaggcctccccagccatgattcctgtacagcctgtggaaccctgaaccaattaaacctctcttatttatacctagtctcaggtagttctttataacaatgcaaggacggacgaatacactatcaccacagcactgtgtgctgcagggttcttggtgcaacttgctgtgctttctcctgccttacctaaagggccctagcaaaataacagcacaggcaaaatgtttctccagagtaaaagttggtaagagcatggaaattagaatagaaaattttcctaatcttgccacccatagactgtaaggacatttacttctcttggactcagtttcctatgtattatgtggtagaattataagacccagtactgccgccacaaatttaggcatcctctttggccttctgctgctcttccttccctctctggagcccacccaggccttcatgttggcttccccaccagcttgggactcctgctctgactcctgcagataacgaaggacattgtcagctcttgcaaggatgtagaaccacattcactgttgcttcacacacacacagcgttctctgctgtctgtgcctgcaggtagcaaggtgccacccacctcctcacacatggcaatcccatgggccttttctgcccagtttttatattcacttcactctactgagaggcagaagaagaaacaagaagagctgtctttgggtgcctgctcatttttaggatgatgatacaagcccgtttccttttctatgcaattcatttatgaggaaaaattaaatccagctataaaaaaacatgtacttaggggacagccaagtctggatatcatattcatagagcacagaggcttttgtggagttaaatcagaagtagccaatctcgggtgtaaactgagggttaacaatggagtcagtgttatcacagaagcatttctgtggtttctcactccagctcttcccagatcgttggtgcttactgcgggagaagaaggtagcgttccacctccaccttccctaaagccacttcgtcagtttcctcacctgtggagtaaagaaggaattaaatgatctccaaggtccctctggcttcagtgttctgtgggtctctatatgaatgggacctcaaaggagcaaatctgcttactctgcttctctcctttttctgcctgctagaaggagtgtgtccattgataagcagtgatgttgccaaaggcatgatcataaatagataaacacaagtgcaaatgctagaaacattatatgcactagaggaatttgaattattttatgagtttcttattactatatcctggccacctttctgatttccgttccgaaacatcaccgtatcgatccgcttttctatctcctctttcccttagtgggtcatcctggggtttgttgaccaatgtctcctctgattgtgaatcatacgaataggcattacgcacttcccaggagatttctgccctctgcctagcaccacatgctcccagaagctggcctcttggatttcagcagctacacctcccccgctccctgccaacacacaccccattcccctagtcaaattatagggtgcccagaggcccatcctgctggtggagtcaggatttttttcatggtcacatgcacatggtaggttgtggcttggatactaacagtaaaaatactcaaagatcggcacaaaatattgatacacgtacacattcatagagaaacatgcacacacaccaggggtcaccaaatctctcatagatcaggagattcaccattctgcagtaaagcataaagtctcaaggatgcatacgtaaattataccattaggatgactacaatttaaaaaatgaaagaaagaaaaggagagagagtggaaaaaggaaggaagggagggagggagggaggggaaaataagaattgttgaggatgtagagaaattggaacccttattcactgttaatgggaaagtaaaataatgtagcctctatggacaataacattgtgtgattactcaaaatattaaaaatagaattatcataggatccagcaatcccacttctgagtatatacctaaaagaattaaaagcaggggcttgaacaggtatttgtacactcatgtttgtagcagcattactcagcattactcagaacagccaaaaggtagtagcaacccaaatgtccatcagtgaatggatgaataaacaaaatgtggcatatatatatatatatatatatatatatatatatatatatacacatatatataccatgaaatagtatccagcactaacagagaaagaaattctaatacatgctacaacatggatgaaccttaaagacattatgctaagcaagtcacaaaaggaaaaactatatgactccacttacatgaggtacctaaagtggtcagattcatagggacagaaaatagaatggtggttgcctgaggttgtggggaggggagaatggggcatgattgttgagtgggtgtagagatggatggtgatgatgacagcataacaacgtgaatgtatttaatgccactggaccatacaattaaaagtggttaggatagtaaattttatgttgtttgtattttaccacaatttaaaaatataaaaaataaataaaacgtaactttccctccttccaaaactgaagagaaactgcatgagaatagggtctctatctttttcatttactgccatatgcacagtaaggtctccgtagcacagaacctaacatcgtagtaagttgttgggttaatatcagtaaatatctgctaatgaatgataaacagatcaacctgtcaaagtcattgttttattgtcttacagcctttcctgagcctaaaagtacctccagatggccacttatactccttttaaaccccaaacctaccttttgtgcctaagtaaaaataacttagaagctacaagtcacttattaagttgtaattgacattatatacagatgtttgaaactgttcattcagcttctaagtgcccaccctcatcgctccctgcattgaaaagatcggccagaaaagatgatgtgggatttccctgcccaacttcatcccttttcccagacctcctcaatagacaaatagagatttataaagcctttgcctctggcctggctcggcctgacttccctctgagtctggggctctgcctcttcttgctgttctgagttcggttctgctcctgttttctgggatgttccctctggttgtttcatcattcactggttatctcagtgccccaaccctagctctgcttttatccccttcctccctcccctgcctcccagcttcatgacctgtgtcagagtgtgggatgtaattgctttcctgtgtgctttgaggagactttttattcatttttgaaggctttgttctgaagtaaccttggaagtgctttggtctctgttcagatagtacccttctcttttcctttgttcccttctgagaaaactcctaagaattatttattcctccatgtctttaaaatacttctttctagtaggctgatctgtcttcgtccagcagcacagggtggtcagtgtaagaaacccgtgagagagcctggggaatagcaccattgaagctgattagtgggaaagcctggaaacctctaaagtggtggggaacagccataatcccagggtaggcaagaggtcctgcaggtctgaattcagctctacatggttccaaggagagctccagccccaaattccacactcctgcaaggccccagcaagcatggctcagaccacaaggagaactgcttcaaaggcattattttgcctgaggaaaaacatatacacctatcctgcaggtgccgggcttgatcttggctgttctgcagtaatgatcctgccccatctgagaccacgactcactttggaagtcagacgtggcattctatgatggctggaacacacatatccgatcatgtaacataggtgtatatatttaaaacgtacgcacacacaggagacacacacattctgctggtagaagcttgattatagatgaagggcagtgacagatgttagcattttccaccccaccaaaggccagctcttcaaagtgattccatacagctttgttactatttcatttaaaggccctcttctctttaaagtttctaatgagatgttatttctgctcctgattatagggtgaaagaacagccttcttcccaccctctcctctctcacacacacattttctgtggtgcaattgccaaatccatgcttgagatccaagagtcgtccaggttggaatgcttggagctgctccctgtttcctcctcagagcgacattcagagccatttcccagtattatgttgccatttccaagattgtttattcagtaaataaataaacgatgatggcctgggatgcatgaggtactgttataaatactcgagatcagttaagctaaagccaaacctaaaggtctggctaaaacccagtctggaagagtctggaagagggcatggacacagcctctccccaccctgctggaaggctgttggtggttcccagctgtccactagcaagccctcctacaacgcccaccattcagcaccattgcaatgccctccttcagtcctgtttatctcccttgttgccctgcgccttctgtagagttcagtgcacattcctactcctccgtgaagccctctctgattcttttgaacttgagtcccttgagtttctctggagcttcccaggacggtgagctcttgctgcctcatagtgcagtatttatattcacgtgttttccccatccggagctataaggagagcaaggcttcattgtatagttctctcggtgtcttatgtataagagattaatacatattgaaagaatgcatgctaataaatgaataatttatcatcagctgattcgattagaatcagtctaatgagaacaatagtaatttcatacatcattttcaaggcatttttatttctttttgggtctattagagaagtagtgacacagaggcatctttctttcagcctgaaattagatattaagcagaatcaagagttagggggaatgcatggggctcaccctgctacagattgctcagcattgcatagaatgccagaggctaagggccccttggcagtttgttcactctttataatccaagtgaagaaactgaggcaccaggtcatgcatgctgttaaatatcagagctggaactcagggctgttcagacccggcatgtacatcatgtcctactgatttcgcaggtctcatcgctttgtgtcctacccttgtcttgtgggagaagggcacccagatatgagttacgatcatctcacctatataatagcatgttgatgggacatgactcatttaaaggaggctggaaaaatgggtcgagtagtcacattagccttgctagattcacatgtaatctgactctgcagatggtggtagcttctgcttgtagagctagtcatggaagccctgtcagtgccttgtattcactccactggagggtgctggggggatgagggagctgtgtgtggggtgggcagtgtcacctagtaaaacaggtagagtttgggggtgccagaaagccctgggttttattcaataccagctctgacttatttcctgtgagcttgtgggtaagttcttccagccatctgtttcatcacctatacgttgggaacgattataacaatatctcctgtaaatatgtccaaacaacagtgaacaacaattacattctggctgctacgattggggcagggtgggaaagttgcacttttcactttatgtatttctctagttttaattttaaattatgagcacatgtgacttccttaatcaggaataaagccataaagctttatttgtgaaaaccacctccaaggagggttccggtaagcatggaatatctgaaatctgctgggttcttatagagtgggagttgctgcttccgtgcctgcctgtactaggtcagagcagttagaattttgtgtcgtctctagttgccaatatttgtctttagcagctcgtcaaattttccttggtgtgggttgctacatgccctcaatcacagagccaaaacacagatagctttctcctttttaattttcaaaggcttctagtctgccccctccgctttggggagcactaaagtctgtttggaaatgtggcctttttgatgccaaaggcagtcccacaagcctcgtatcccctccaccccacttcacacagcacatctcaaggagcacgcatgaaaccttcactgttaacacttggtgctggcatcctggctttcatcccgagaaaatacacaaaccaaaccaaatccacagcactttaaaaacactaattaactctcaccactggcctaggctacgcagaaatggcaaatcccgctgccccaattttatgtttggagaaatcagggtaagcaacattttctagggcttctctgagccagatcacagaagctgacctgaaggacttggcctggccctgcatctggagttaggccatttgatgaagggccagctgcctcaccagatcccttctctacagcaccacgtggttagtggcccataactccatttgtacatcagcgtttgtttttttttccccagggttactttgatgccaaactgtctcatgtccaactgaccatttatttatttgcttacttttctttaattctggtacagcctagaaattttagccatagcttccaagtgtagcctgttaattatagttgattaaaggttctatgctgattttgaatttcaacacaaaagcagactaacttccaaacagtccctctcaggtccagtggctccgccccttccgtcttccaccctggagcctccccaggtctggtaaagatttggtggtgtccagactccttttttcctctcccagtctggaccagtcattctcctacctcagttccccagtcttaccatctgtaaagataaatatatccatctttcttgaaagagtctaccataaaattctgtaaaaacataaaacctcataaaattttagggaacatatccaatgaaattaaaatttacaaagtaaatctattttgtaaatatttattgatcttgtcagaatttttaggggttttagggtgcttgtgtataaggctgaaataaaacttttgaaaacatttctgggacgttgttgaaaacagactaaacggcctgtttagtaacccataatgtaagatgttagtaatcaggcatttatagactgaagtctgttacctctggcagaaaatacctagggaatgagtatatggcccctgcttctaaagattcttttgaatcagaggaaaacatatgcccaggaaaggatattaacacagttataaaataaagtagaacaaatgataagtgatataatataagcagtaaggacaaatgaagaagtgacagcatttgggagtgattaggaaaggtgttctcaaaaaggatatctttaaatttgtccattacttcaacaactttagttttatctttcttgattttaatgtgaatgaaggaaaagaatatttaacactattagttttctatcactgatcaaacaaattaccataaactcaatggcttaaaacaaccaatacttaaccatcactctattttcgtattttttgaatgttttcagttctgtaggtcagaagtctgacatgggtctcactggactaaatccagggtaccgattggcagggctgcagtcccttccaaaggctgaggggacatcccatttccttgccttttcctgcttctagaggctgcctacattccttggcccatggcctccttcctccatcttcaaagccagcaatggaaggttgggtccttttctagcacattctttgaacctggcttccatcatctcatcttgtctgacctgttctgcctccttcttcaacttttctggactcttgtgataacattgggcccacctggataaataatctagaatcacctccctatttgaaagtcagctgattagcaatcttaattccatctgcagcctgaatgcccctttgccgtgtaacctaacatattcacaggtcctggggattgggacgtggatatctttagggggccattattctgctaccacaaatacctgctgtgttgccctagacttcatgaaaaatacaacaagtcgcttataacctagttggagagaacaagaacatacaaaaagttaaaagaaaatcagataacagttgaaagctatggtggtagagacgttacaagttgtacttaattgtcagatcatttccatggagtctgatagttgctatgagagtgaaggagggctaaaacactcaggccctctttcacctccactgaacctcaaagagttcctaggtggaaaagaccatcaaaggaaatagaaaaggctgtgagcaaaaggtgtgtgagcctatttgggggacaaaggggaggcatgaaagaagagatgggaaagctaaacaaggacaatatgtcacactaaggagatgggatttcatcctgtatgcagcagggaagctccttttgtacaaataatagatgggggggtggtgcaagaaatttttaaaaatacagaaaagctcaaaatttttaaaaatacacacaaaaaaaatcaccctaaacctattattctgctacccagaaataagcattgttaatattttggtgggctttttctatttctatttagggagagctttcaacatttcaccgttcagtatgatatcgattgcagattttttttatactctttatcagtgtaagaaaactccctcctattcttagtttgtagaatttttaaaacagctattgctgttgtccacaggaaagtccctttgtgtctgcactattttaatcccaaaataaagaaaaatctgctaattccacaggtggttatatagatgctggggtttcagcacttcctgtttgaccggaaactctcagtgaagtaaaaaaaaaaaaaaatcagaaattgtggaagtttatttgtagagactcttgttttgccgttaggactgtgggtcccagaattctttggaatgacagccctagtcaaagtctagccatttctctcccaattatccaaacaaaggctggtttaggcactgcctgaaaggacttgatagatgtaatccaagtcccatatccttaagtgcctcaaccaaggggaagtcctgggtgggcctgattcagtcatatgagtaaaatataaattttcctttgtaggctggtttttactaaaaatgatattgctggattatccttggaatccatctcagcaaagtgttagaataatctcaagtataaaggcaggaggggctgggcacagtggctcatgcttgtaatcccagcactttgggatgccaaggtgggtggattgcatgaggccaggagctcaagaccagcctggccaacatggcaaaaccccgtctttactaaaaaatacaaaaaagtagccgggcatggtggcacacacctgtagtcccagttactagggaggctaaggtgggaggattgcttgaaccggggaggcagaggttgcagtgagctgagagtgcaccactgcactccagcctgggcgacagagcaagactctatttcaaaaaaaaggcaggagaagtagtttatataagatatttataactagtttagtggtctaatagcctatggatgagaagtgactggtacagtgggccatcctagaaagagaaaatcatgtctaggtgggctctatttgatggagccgttgatctggggccaggtttacagtctcttgtcactatctggactctgttctaggtatgcagctggctgtgcccctattaggatgaaccccctgtaggtgccctttccttctgatatgccagggatgctctgggacttcctgtcataggtgattcctaatgctcctgacccatggcagccaaataggttcccccttggaggcttccattctgccctgttacctgcccttattttcaaatttggaatgtttgtagaagtctgttagtatctctctcacttattttgggggtatcatactgttttcacagcaaaagagcttgcagtcagctttagcttcttcctttaatacatgaggggtaacacctgtgctatttgttttctttcctaaatgccttcacagaagcagttttgaaccagagaatatacacaattaagtaaaaggagttgagagaaatcacatggagagcaataaagaaaagaaactaaccattgttgacagtgcactgtgttctaggcactgtgtagctaccccctgcccccagtacctgcctttctttagagcacatattattttttaaatatttatttatcatcctcctgtctccattaaaatacaagttccacgagggcagacaatttagtcttttgtgttcttttctatacccaaacatctagaacagtagcacaataagtagttgttgaataaatgtcttttcttaaagaaaaaatgaaaaaaggggccaggcatggtggctcatgcctgtaatcccagcactttgggaggctgaggcgagcagatcacaaggtcaggggtttaagaccagcctgaccaaaatggtgaaaccccatctctactgaaaatacaaaaagtagtcaggcatggtggtgcacgcctgtagtcccagctgcttgggaggctaaggcagaagaatcccttgaactcaggaggcagaggttgcagtgagccaagatcgtgccactgcactccagcctgggcaacagagcgagactccatcaaaaaaaaaaaaagaaagaaaaaggaaagacatggggttaacttttttaacctttaaaaaagatctatggaaaagattggatagatgtcagaggtacttgattgtaatagctaatgcttgtttgtaaagtgagacgtaagaaagcttagatttggcttaattgatggcaagtttaagagactgaggtttacttgagactgacattagtataaatttaaaatgacttaaagaggaagtcatgggtatttgaactatttatattcatttcagatcctttcttttacatcattttgtaaaaactccttcgaaaaaaatagttcagtgcttatagctgacttttagcttctttctcaaaaaagaaaaaaataataaaagaggaatgagaaagtcagcttaagtactaccttcccttatcttttgactgagatataagaattatttgtgacataaatacattttatttaaagaaagttgaagattggatctgggttattttttggacaagttagaatatagtacttgatttctaattgttaacaactaatgttttaaaaaacaaatgttagagactgaaaaggaatctaaacctttccctttttctaattgtaatcatattttcaaatgtatatgggatttttttcttagtctttccacaaattataaacagcagcatttaccctgcattgagctgaaatgaataaacattttttaaatgaaaataatgacagtgaaaaccaatttagaaaagaaaggaaaaagatgcccataaatcacagacacttggaagagcatgtaagaaaagctaagaactacatttttcatattttacattttctctttaaaatcgctttccaaattgttgatggtttggcagctccaaggatgacatcaactcttccattgtgcagtatctgcttgcttttagataacttggtggcactttatcaggttttggtgattaagctgaattaaaaaccaactggatttgagtttaaattctcctaactgctaaaccaaacacattcctgaccgtaggcctacttttgaatacttctgaaaacttattattacccataggctgttttacttctagaaacaaaagtaagcaagtgagagaaaaatgcactccttagagttactaaccacatctgtcaaaatgcagtatattaccagtgcagctgttaaaatgcttttaaaccagccatcttcttttctgcctatcttaacctgactgaaaaccaagaggacaataatcttggcattgttttcctacttcagaaaatcacagatagttatgagctactgtctctctcagcagttgggggcagattctgatgattagttaagtcatgatgaaaagataataccagaaattaggctattaatgaggaagaaaacagcaggctgtgaacaggtctgataactttcctgtatatcctaggaactcacctgggaatactaggtgaaaacattggcattccacacatctggtctattaccctacacttaaagcagtgcctttcatacctgaatgtgcacacgaatcacctgattcagtcaggctggggtggggcccaaattcagcatttctaacagactcctgagtggtgccaatactgctgggtctctgactacaatttgaatattgagcccctagtctagaggactttcacccaatttgaagctcaatctttagaatttaaaatatttgtataagtatttaagactaaatattttttctaagatatctaattaaagacagagatgtaagaccttgaatttcagaactgttttataaattgtattagtctgttttgcgttgctgtaaaggaatgtctgagactgggtaatttaaaagaggtttatttcgctcatgattctgcaggctgtacaagcatggcaccagcatctgctcagcttatgatgaggcctcagacagaaggcaaagggagagcaggtatgcacatggcaagagtggcagcaagagagatgccaggctcttttaaagaacagctctttaaaacatgaacagaacaagactcaaggagggcatcaagccatttatgagagatctgcccctatggcccaaacactccccactgtgccccccctccaacattggggatcacatttcaacatgagatttggaggaaacagatatccaaattatatcataagtatttataatctcttcccccacatttctatttaagctagttgtatagcaatttacattatctttcagattatccaaatgccaaaatgttttctgatcctaaagtaacatgatgcatttgctgaaaaaaagtttaagatatattcaagccagcaagacatgaagattttagagctcatcacagaagcttggtctcttttccttttgttcctggttttctccttatgtgaacattcagaaagaaaacccaagcttctaaaaaatggcaaggagctcagtatctaccaccctagaagaaggtccctggaaatcaagaatcaggtagcagatttcttctcctatgaacattcttggggaaacctacttaggctatgggttctgacttctttcaagtacttcctctgatcttgcggaagtactatggatgggtataggcaaaccccaaaaagtccccagaaagagttttagtagagaaactaggtgattaggagtgccactactttgtgcaaaagaggaaaattccccatgctcatgcctcttaaatggctgagagatttctgtggcctggtattacacaccaggccaaagtagtcactgggacacccattggtcagttactgtgtctccaagggacacagagcatcttgcccagtgtcatcattatgtgagcttggcctgcctcctggactcagtgaacctgttttctcacctcccaaaaataaaagcaaaaacacacctacaatttcagagcatgtgaaaaatggatctaatcatcacattcatagggacaatggtagaatttattaatgttcctacagttttcctttaaagtgttttgagattagaaacaaaacattatatgcaatatttgagaggaaaaaccacaaaataataaaattttgtattcagtatctcagttgtgtaaaaataatatagacattaaaacaggattagaggccaggcgtgttggctcacgcctgtaatcccagcactttgggaggccgaggcgggcggatcatgaggtcaagagatcgagaccatcctggccaacatggtgaaaccctgcctctactaaaaatacaaaaattagctgggcatggtggcacacatctgtagtcccagctactcaggaggctgaggcaggagaatggcgtgaacccggaaggcagagcttgcagtaagccgagatcacgccactgcactccagcctgggtgacagagcaagactccgtctcaaaaaacaaacaaacgaagaaaaaaacaggattagaaagagaataccaaattgttataatggtcagttagctttagagggtgagattatgtataatttttagtatcgtttttattcaattcagtgtacctattacttttgcaactaaatttttgaaaaagaacaaagaaaaaaggcaacaaagcaacactgatcaggctgaaggtctcctgggcctaaacctcccaaccaccaagagtgtcaaaatctctgttcagggacttgggtctgtagttaattgttggatgtttttatgtggtataaatctgtgtactgccttgatgacagtaataaactagagtgtcttgataaagaccaaagtcatcaattttccaaaatctgtatttgattaattctccaaaggtccaggtcaaggttattcctcaaactttattattttaacatagaagcccaaagtttccaagtctgtcagaaaattcattatcactgtaaaacagcaaaaggtcacaaaatgtctctttctacaataaaatagcatataagaaaaaatctctttttctcaacaattcattaccccaacagaaaccaaaaaacctttgacatttcaggtctttttgcttcaggggaaataaatgttccatagatcatggagaaaaatgacaaacaaattaatgaaaaacaaatacactcctgcagtatccccagccacgccagaccaaacaagtcagagtcagcttttattcttgggtctttccaactctgaagagtgacagtttccataatggcatcagcagtttagttagagaaagctgtacacacaccaaagaaacacaaattaaagaaacatgtggtagaaaaacagaaagaggaattctgttatttcatgcatatttaactctagtgggaaagtcattgctggcaaagtgttattgaaatcttgagctaataagtagaagcattctagaagatatgcaccgcctcctcatagtgctttatacaaaattgtaacttgactgaatttagcagtgctcaattttcccacattctaaaaattccttccttgaattctgcctcactctcaccactaaaccttgtcagaagtagtttgcatgtgctttctccatatcttcaatttccattcatttactaattttaacaccaaatacatttccattttcattatttgtttaaacacagccatacaaataaaaccaaaattggcccagtgcagtggctcacgcctgtaatcccagcactttgggaggctgaggtgggtggatcatctgaggtcaggagttcgagaccaacctggctgacatggtgaaactctgtctctactaaaattacaaaaaaattagctgggcgtgctggtggatgcctgtaatcccagctactcaggaggctgaggcaggagaatagcttgaacccgggaggcagaggttgcagtgagctgagatcacgctattgcactctagcctgggtgacaagagcaaaactccgtctcagataaataaataaataaaacaaaacaaagttcactatgacccttattccctgtccccctccacagaggtgaccactgctaacagttttgactttatagaccactttagatgtgcttatgtatacaatatggatttatggagcagtggtgtgtacaatactttttttttttttacatagataatatcatataaaatgttgtggggttttttttttgccacatacttttttctgtcaatgatctgtcttggagatctttccagatccgtaagtataaatcagtggttttcaaccaggggctagtgagccccccaggggagatttggcaatttttgcaggcatttttggtggtcacgacctgagtggggaatgctattggcatctagtaggtagaagtcagggatgtactaaacatcccacaatgcacagaacagccctatgacaaagagttttccacctgaaatgtcaataatgctgaggctgagaaaccctgataaaggtctactttattcttttaactgctgcatggtattctgtagtttatttagccagtcatgtagcagtgtatatttacatgatttttttttcttttttgagttggagtcttgctctgttgcccaggctggagtgcagtggtgcgatttcgactcactgcaacctctacctcccgggttcaagcgattctcctgcctcagcctcccgagtaggtgggactataggcgtccaccaccacacccagctaatttctgtatttttagtagagacttttaaaaacatgtttatttgtagatatcagtgaatgtttcttccatttacttttgacccaactgcaatcaaccttctttcctaaatatccctaaatccattgctactgctttaacaaaataccacagactgggtaatttataaataataaaactttatttctcacagttctggaggctgggaagtctaagactgaggtgccggcagatttggtgtctggtgagggctcctttctgcttccaagatggtgccctgtggctgcatcttccagaggagagaaacattgagtcctcacgtggcagaagggacaaaaggggaaaagggaagaactctcttcctcaggttcttggataaaggcactaatcctatccatgagggtggagcccccagggcctaatcacttcccaatggccccacctcttaatgccatcaccttgggggttccaacatatggattttggagcaacaaaccatagcagccccctgcaggtgaccagtgggttttctgaatcccttggctccttttcagcatgagctgacttggcccttctgtgccatttgccagtgcttgtcctaaagcacttggcctcccaggccccttggctctgcctttttcctctctacctctgtggcccccttcagtctctgtggctctgccatctcctgagctcttgctgtcacagtgctaggcattagggatatgaagacgaactgtggaaggtcccagccctggagaccctccagtctagaagacaagcacatacacaaatctcccaaagggaagcatcacctagtcagggcacatttgaagtgtgctgagtgattgaataaataactaaatatagtagattttagaggacagtgggaaatgtttttccttcatgattcagaatttactgcatattttatcttcatgacaccttttctcacaacatacgttttgaaaaaaaataagtcacgaaaaagactttcctcatattttcccacccacagtctttttgtctgccttgaaacagcaactgcattgtttcacatacagggaatgcacttggtctttgccaaggcagagaacagatcaaatttgagaagcagccctgcttgctgctggctgagggatgggaagtgaggttggccctcggagcttccttcccctaccctttctttcaacctcctcatgatggtaggaccatcacctcccagcagccccttccttactcctgtggggagatttcagaagcagactgagtggcaactgccgcctggcccttttctccctggatcaagggatcttaagcacctacctgaaacctaacagcaaaggaaatctcaactataaatctaactccatgcagaaattaaactccttcaacgggtattcactgctcactgtgcaggccccagggaagtgtaaagatcaatgggacatggcctctgcccctaaggagccagagagggccagggcaagggtgggagggggcatctataaacaactgcttgcaatgcaaaacagaatcaagttagtcctaaaaagaggattgagcaaggttgcttaaggagaaaggaaggattcattatgataggagatcaagcaagacacttgaaaagcatgtcccttctggtagcgggtgcctgaagtcccagctactcaagaggctgaggcaggagaatggcatggacccaggaggcggagcttgcagtgagccgagattgagatcacgccactgcactccagcctgggcgacagagcgagactctgtctcaaaaaaaaaaaaaaaaaaaagagctttattttatgggttctttccatttaaacccaaggaaagtggggtttctgaaagaagaaatgaaatgcgaaccgtgcaagattctagatggccattctgctgagcaccatgtagtttgggtaaagccctgaaccttacaaatgggagtttttatctcagatatgtatctcagatgcaggacttttatctcagatataactaagagtatccaagattgcagctgtctcggccctagatgctcaagcctgtgcagccttagttgtatatcagagatctacagagatcttagttgtgtatcagagatctacagagatcttagtcgtgtatcagagatctacagagatcttagctgtatatcagagatccacagagatcttaattgtatatcagagatctttctttggggggcggcacagggggacggagtcttgctctgtcacccaggctggagtgcagtggtgtgatcttggttcactgcaacctctgtctcctgggttcaagtcattctcctacctcagccagctgagtagctgggaccacaggtacgtgctgccatgcccagctaatttttttgtatttttagtagagacgaggatttaccatgttggccaggctggtcttgaactcctgacctcaagtgatccacctgccttggcctcccaaagtgttgggattacagatgtaagccactgtgcccagcccttagttgtatatcagagacattttttgttttgtttttttgggttttttgaggcagagtctcgctgtcactctgttgcccaggctggagtacagtggcgtactctcagctcgctgcaacccttgcctcccaggttcaggagattctcctgcctcagcctcctgagtagctgggagtacaggcatatggcaccacacccagctaattcttgtatttttagtagagaggtggtttcaccatattggtcaggctggtctcggactcctgaccttaggtgattcacccctcttggcctcccaaagtgctgggagtacaggtgtgagccaccgcgcccggcctatcagagatcttaatttgatttatttctgttcaaatcagatctgactcttaaaggcacccatttattgccccagacctgactgtagatattctgcaggatctacacatacttttatctttatttatatttctatttgcttatgttgaagccgagtgggtcctgggaacataaaggatatagctcaaggatagaggcttttaccataaattgccaaagctcacctagagaaagaacagagaggaagctgtgaaggatgtgtgggtttggggagggaagcataaaccagagagagtgaagcagttggattattggtcagtgaacaaggacaacagtggtcaccatagctgttgttattttgtgcctactaatgatcattctttatctctcccagtagagaactgattgaactgaagtccggaagacaaggagggtactgctacagaagggcccagagggctgctgcatttatttcctatcgctgtatagcaaattaccacaaatttagcagcttaaaataacacctgtttactacctcacagttctgtaggtctgaaggctgggcaggctcaactgggttctctgcttagggtctcagagggctgaattcaaggtgtcagtcaggttgggctcttacctggaggctttgcagaagaaccttcttccaagcttgctcaggttgttggcagaattcagttgctgtggttgtaggactgaagtccctgttgtctccgcaaggactaccctcagcttctcaagttcttgtcccattgaccctttcatggtaaagtcagcaatggagaagcttcctcttgttgaatccctctcacaattagaatctctcaactgtaacaagaatctcgcttctgtaacaagctggagaaaattccctacttttaaaaggctcatgtgattaggttaggcccatgcagatgctctctgattagtaaccttaatggcatctgcagaattccttttcccaccaaacataacataatctcaggagtaacaccagggggtgaagaccatggagcccttggttccacctgaccttggaatgacacctggaaatccagggttcagggaccagaaatctgtgactgagggtggggctggggagtgacacacagaagggaaatattctccgggagccaaacagagaaggacttttggaggcagaatttgctgacagagctaatcaagcccccttaatcagtaagagtctttgttgagcaccttcttttctaggccctgttaggcactagaataatgaaggagacagtccttgccctttaggaattcacagtctagtgagattgtaagaaatctcctggactagaaatgcagtcctgatacaaccgtaccctgagaaatctgtatatcttcaggaaagtcattttgtgtgttttacagactggcctgagtgctcgctgctgttgtagctaccaccaactttctactgaagatgataacccagggcataagaaatgacttcagacccaaggttctgaaagggcccctcaaggcctcgggtggctcctgcagaagtggcagaagaggcgggaactaggaacctggcatcataggaaaagtgccttctccaagaaagaaggggccccaggaggctgtcttacttagatcaaccataaactaccacagatgggtcatttcttatattatttcaaaatatctttgaagatgagaattcatttgtgtccttcatagaccaaagttctttgtgttaccttttcccaaaagtaaattcctttccctttattcattccttgtggaaataaaatgcaagccctttatacttgtcttacagtaatatggcacatgtagcttacttttgagcatcccagtgaataatgtttggaacttttcttattacctaatagcatatagagaagagtgaagtcagctaaaaacagaaattttgaaaagccatcttcaggaaaatgtaggcccagatgctttcctccaccttttttgacaggctgccacatacagtttcacaggttgctaactgcacaggggcacagcctgtcctccatttgccaagtcacactttctggcacagagaggggtgtcttgttctaatttgtctttgtggcctgctctcttctgttcttgaagctgcaagccacagtgagatgagtgaaaagcagtcagtctcatagaaaaaagcagggaaaaagcaatagagacaagaaggaaagccaaggaaaggattcttggggaaggtcaacagggaagggtggagaaggggaaaggagatgaccattatgatcttctaattaggagtttaggggagatcgtttgccttattcagcaaccatgcgactagaaaataagcaatctctttaaaataatgctttactacagtcaacttcaataatcttttcgataattgggttgtgattaaacttacaggcacaagactaaataatcccaacgcctttaactttgcacattgttttttgtttgtttggttggttttgttgttttagtttggggttttttttactttgtgtgcccttatatattcaacaaatacttcttggtacccattctattcatagcactctcttagtccttgtatacaggggtcctcaatccttgatgtgaattaaagtcacctgggcagcatgctgaaaatgcagcttcctaggccctcccttcatgcagcttcaggatctctcagctatattttgatcaaacatccaaggaatttctggtgattcaaggaccacactttgaggaaggttgctgtagacatggaaagcatataatccatagttctttgtcctgtaagaccgtataactgagttagggaacaggaggtagacatacataaagataacgaacaacacccaacagtgggtgctacagaagcaagtgagtaacagagaaaatgatgaaccagtgacatattaggtgggaagaggaagaatgttcctacatggaattccctgaagacttcaaaaaaaagagtgggcctttaaaagagaggagagaccatttcagttgggaaaaatatgtaaataaaggcgcagtagctttatgtggtgagagacttagggaaagactgactcaacatctcttggcttcatgatgatcctttttgacccacaggttctttctcctttcttattaggttgcttttaagactatttcataagggatcgcagatgtgcatgtaaaaagagattaatcactattgaaatgtatgttctgactgatttgtgtgttacactattgaaaaactgtatagactccaaatggcatctgattattaaattcagatgccagagtctttgattaacagcatgtctttttgctctgtatattttccttcagaagtagcagggcttgcagacatctcaagctatgccacagaagagtcaaacagaggaagtggtcatgaaattaaatgtgaagacagtctattaacttttgcaatacagaacctttgtttactcataaaatccatatttggagctcattctttccaaatggattattatctaagtgtttttattggagactgtttggtacttgtgttttatagttctttttctttcactcaaacaattttgtatattagaaaacaatttcagcaaatattttatatttaaaaaatcagaagaaaatgaagatgaccctctcttttgccagtactcataataaatacaaaatgagaagagatttttatagtactgcatgactctattatctggagtacaaatcactgcttttttttttgttttgtgagacagggtctccctctgtcctccaggatgagcacaaaggcatcctctcggctcactgcagccttgagctccctggctcaagtgatcctcccacctcagcctcctgaatagctgggaccacaggcatgtgctaccatgcccaactaattttttattttttgtagagatggggactcactttgctgcccaggctggtcttgaattcctggactcaagtaatcctcctacctcagcctcacaaagtgttgggattacaggtgtgagtcactgtgcctggccttgcattttttaaaagtgataagtaaatgctatatgacttcaggtagagattatatctcatgtttaatttgtataactgcataagtagaaaaactgttcatgaaaatatattggctgggcgtggtggatcacacctgtaaactcagcactttgggaggctgaggtgggtggatctcctgaggtcaggagttcaagactagcctggccaacatggagaaaccccatctctactaaaaatacaaannnnnnnnnnnnnnnnnnnnaaaaaaaagaaaggaaggaaggaagaaatttacttattccatctctgtacacataatttgtaaacttttttatcatcaattattattataaattttttgagacagggtctcactgtgttgcccaggctggagcgtagtggtgtgagcacggctcactgcagcctcgatcacctgggctccagcaatcctcccatatcagcctcctgagtaactgagactataggcacatgccaccatgcccggttaatttttgtattttgtagagacagggtttcgccatgttacccaggctggtcttgaactcctgagctcaagcaatccacctgcctcagcctcccaaagtgctgggattacaggcatgagccaccacatcagcccatcaattattattaaactcatgtgtaccagtacaatttcaagccctctaagctgcatttaatgctaaattgtgatatcatgtgtgtgtgtgtgtgtgtgtgtgtgtgtttgaacagaatgttcatatgacttcatttctataataatgtgataatacaaatatttggggtcattttaatcgtattagcatttatctttaccaaattgatttgattgttgtgtagccacttctcatctgttacatatacacgttttacatatcattcaaacttgaaatttccttaaacaactttcccagcctggtttcggatgattgcttgttgagactttgtccatgctctgtcctcccctccccactgtaaatactcttcttttgggctagggggctgtgccctccagggtattgttttccttcctgttcagtgcccatgctcttgcctgtgtttctcctgtacctttcccaggacctagcagacagccgagcacctgcccactgctctgtaaatactgacctgcatctcaagtggggtagcctttgtgtactttcccatttccaagttgatttgcctgtgaatcccatatgtgaacacatatgcagatgtccctgatgtgctctttcctgcttggaggcacatgcaaggatgtggcactttttctaattgcttgaacagtcaagtggatctctcttaggcagcacttggccaaaaattctgaatatttaatcactggtacaggattagttcagttggccaaaaagaaaaaaaaaatgtatggatgaaatgtgaatacactgttaactttttcatctgcctttataattagtgttttttcaatattaagtttctgctttttatactgagtttttagggaaaaaatatgggaaggattccatattcattgcttcacacgatctatagttcctgagataactatataattatgaatgttgatacacccataagagactttgctttttcctctcacacatctgttttgctttaggcaagagaactttctcatgccagaatggctgcagtggatgtaggcaatctgctttatgttgagccgctacaattcacagatgcaaatgtttaaaaggttaacatggttatttcttcatctgaaacaaacgtccctagtcactacttttgtcctttaaaaaaaattgtattcttttataaatccattgtgtgtaatccttatacccttgtctcataatcctcatatcagagctgaattaactcttttgtggcctcctgtgatgaatttcagttgtcctactagtttctcttgctggtgtgattgtgtcctcttgatggaatttaggttcttagggagagaatgagggaagcagcttctctacccagaacagaatcccactaaccgaaagaatgctgccctgcaaaaaagtttctagtgtatccatgtgtgatctcaattatttaatcaacaaacattccagagcatccattgtttcactgtactaggaaatgggggcaagaccaggatagtatacggaggctaacctcagcaactgcagtccagttggaaagatgaaacctaacatgatgataggatggcagcgggttgtgagtgtcaaacgcatgcttctgtactgcgctcctgctgcctccaaaagcagggggagccttcagttcatcacacctacagctctggacattttttcatgttgttaaattaatctaacattgtaggatctgaattttctatagaaactttacctaacttttcttgtattgctaatttgttgtattgagtaagccttctgtgtagaaaacagtttaactatgttaacaacactatgtcaaagattcaaagcctttgagagcttaggagaaatccaaccccagtcattttctgacacaactgaacacagtactctgtggttgaaagttcctgaaactcccaaagcacaggaaggctgactacagatcctaaagatgtttaactcacatagtccttggtggcacttactgtttgcagctggagggccttgtattttcttaaaatgcatcctaaataaaaactcaaaagccattcaatgctaattcaagtttcatggttaaaggcgcagctttgctggcatctagaattagaaccgtgtggtgtgtcccccagaaaacgagctctcatggcaaaaacagacaaactctaccccctgccaaactaactgtcagcagaaatctggtctgctttctgaaatgggatgtaggtttccaaattctctagacaatctctttccaaagcaaaggagaaacaaataactcacaggcaccaactgcattttctgttcaaagcaagaagggttttcactgtgctgtttttacctgtcatttcacaactcagttctctctggagcacttgtaccaagggtacaagaaagtcatgagatcagagagctggttttggacatgcacttaatcactcccatccttatttcccctgcttccctgatgcccctgaatagcaggctctgtccccgaaagagaaatgagagttaaagaaatgaccacttaaccttttcctttggtagggaggttctaggaggccagtgaagcttgcgggggtcgggaaatttgagaagtgaatggagattaggagaacagagtttgctccagatgagctttggagctgtgccttttcttctggaactcactaccggatcaaggggtctagtggggtgcccaccacactggccaccagaccaggcttgatggaaagggcccagagatgggtcctgcttgtgcagtctacaactgccagcatcagctgccccctattcctctctgtggcccatggtcagccagaatcagagggccaaagcaatgggcctgtagcttgagaagcatgtcagcaggctggggttcaaggccaggcctacaggcccgcagtggagagggcaaggctggctccaggtccgatgggcaggttgccaggacgtgattttcagagcaggaaagtggagtgaagcgtgactggcagtgagtgtgagcagacagctgcagagtcgtctctgcctagtgttaggcctggccgcaggctctggcggccctcagcctgaccgtaggatgggtctcccagcttcagctgaaggcaagaagtgccgctgacttggggagctgagccagacctggctcctgccctcctccctgaacgtgctccaggatcatctgtctgcctgttgttcctcactctttttagctctccacggggctggcctttgttgtagacagagaagagaggcactgtgttatgtgccgaaagctctgtcacaagacacctacaccaccaatgtgctgccgtgcttttcctcatgctgttcccgttgcccaagtgacctttcctgcctttctgtgcctggtaaaatctggcttgttctttgagatccagttcaaatgtaagcttccttggcaagtccttcccagccgctctgaccaccacctttcctggcaggattgcatactgattgcaaccccctcggtgcccgctcagcgtgttctatgcacctgtagctctagcccattatgatagagttatttattcacattctttgttagatgctgaatctgtccaagacagggacctggacatctgtccattcatctctgtatccctcccagcacagtggctgaaacacagtttgtcatttatacatgtctgttttgcaaatccgttatctgagatgaaagcctgtagatttcattaacatcttagctctgactagttgagaaatcaaaagtagggcacatggcacagctaacacatattggcgtcttgctgtgtgctgccctagacaccccgtgtccagcaaaaagtcacacatcgttgacccgagcagagggagcccagggggccatcctgtgtccctccagcatcactgcaaacagggtgggggcaccagtggaggcaggagcgctgacctgtcttgaaggctgagagtaagatgggtcccttgtggccttcaaaagtatttggacttctgaagctgcctgtggctccggaaattagggaaatgctttagtgggagtgcttctgtgtgcggggaggtgtaagtgcaacatgaactgaatctcactccacccagtacaggatgtgcccggagagcatgctgagctaccctgtgccagctacgtgctctagaacagcatcctcccagccacccaggaggtcatgcaggcctcgtcatcagaaaagtggcttaaaaaccatgtggagtcagaccatttgaacactaactagaaatgggaggctattagggaattattgtgaatgttctaggaaacattgctcatctttgcacattaaattcctactaatataatagtatcatgattatgaggggtttatttttttaaggatccttgtcttttagggatatatgccaaaatatttaccgatgaaatatgatggttggaatttgcttggaaataatatggggaggagggggtgggaggtaaagataaagaaaattggccacaagttgatgattgttgggtacatggtgtttattatgatgctcagtctacttctgtgcatgtttgacatttttcatggcaaggtgttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctatgttttttaagtatttgagagattaaggggaaacagtattttgttctcatcccctcgtttcttggatttgctttattgtcccttttcctcacccctggttacctctgaggatctcctagttagagaagagggtccaaattgttgttctatctacccttttggtaccttcttaaaaggccttcccttaaggttccccaaatatgtttaaaagtctttggaaattaggtgcatttcctcccattggctcaggaaggggtggggagcagcatatggtactggaaaccaggctcccttgaagtgctccttgcccgggcttaggctctgttgaggtgaatcacttgcctccctccaatgaggagtatgctttcctgaggttgtagaagagaaatgtgccattttcactgtgcctgtacccaagggagccagaatgggagcattttaaaagaaagacactttcatatgactaaatcaacctggaagccaactgatgaagatgtgctatctgatagagcttggggaccaccaaccaactgggaacataaaatgtggagggcaggcttggccctggattattgactctctcaaatgtttctattatgtctcactcttaaggagggagactagaagctcttaagtccagtagcttaacatttttcagagtggatttttttcttggccttatttctaccaccctcgtgttcccaaaacaccccttccatcaccacaccccaacacggaatgctctgcactcactgtattgtcctcagccatttcccaccttcatggcccagctttctgccagtgcagaccacagatatggttgcaggaaagtggagaaagagtagctaatcggaggtgacagggagcggaagagtaagcatggcgagagcatgccagctggtggagtcttaaatggaactgtagagttcttggggatgtctgcccatttgaggtaaccgtcttgtctagcttcctgtccacatggcacattccggtggtgtgacttgaaggaagctaccaaaaccatatttatcacattccagaggccagagggcctatgagtaatcgtgagtatggagacgatgaagttggaatccaggagaagctgatggtggagcataatgaggcaaatctaataggccagaatgtcatcaggtcaatgtagagtgctgtgcgtgggccacctgcaaagcgcagggtgaggaggagtgactgacaaggaacttaataggaggcaacagtgtgatgtggctgcacagacctacaaatgctttaaaatccagttgcatggatacaggaggctgaaagcatcaatcctgtaatatatccagatgagaagtgccagtccaggaatcacattttgttccctgtaagtttctgaagggggccatctcagtaaatgatggttgttcatatgaaagatattattatttctctgatggtatctgatactgcatgttgcatgcagaagaagatctctaaagatctttacatattaacagcctatgacatccttcaggtatacagttgttacacatgccaggggacactgtgactttgttattgttttgtattttctctgcatttgggttaattttgtttgattattgtcatccctttagttcctaacttacacactagggtgttagagaggaaggtaatccagaacagattttataataataacaataaaggccaccctattttctctctattgtattgctcagtactcatagcgcattagtgcatttaacgctcacagaaacccaatgaaggtaggtggtagtattagtctcattttacagaaaagtaaaatattagaaagttaagcaatttgcccccaaggccgcacagctagaaagcaacaaggcagggactctgggagcccaagctcacagtgcctctccctggtgttgctttttccacagcagtgaataactgctcccctgaagtgctccttgcctggggttcggcaccgcgaccagttccacaggcatcgtgtctaagtgtgactgtgccccggaacccacagagccacccggctgctcagtcgatgataatcaaaaattttaaatttgcttccattggacattcctgctcatccagccacttttcttatcagaagacaaaggcatgctgaccatatgtttattatcattcctcctctttcctgcttgtttttctagtcaaggtcagagaggaccagaaacacccagtgctgagaagagtgagccttgctttctcagaaatggttcctacctctgtggaaagcagtgaaagagcctccagtagcctcttcctggagtggtggagggtggatagaaggaaaaacaattagaagtaacaataacgaatagaaacagaaagacgtctttcttcctaacaacctcattttgttttccttctaatcttattaaattttcacatacttggtataaaatcacaacagtttaggttctgataatgtcttatagctgcctgtgtgcctcgttggctgacttatgctctgatatgtccctaatatggcagattctccatacagataagtggaaagtaactcctcctacaggtaaacttgatgggactgtaggattaagccttttgcttgttatgcgactcagcaattattaggaaaaggctgggtgttttcagcagcccctgggaaatgtgatttatgacatgacaacgttggttggtcggggtctctgtttcactctccagtgtgcactcatttgagtaagtctgtgaggaacttcccacttgtaagaaacagtatcttgcgtgttgctatcactaaaccctggaggccggatgctgtgtccctgctaatggtctctggttggcaaatatacatgtgactctttctgagcaaagtgctatgtgtaatatgaaaggagcttgaatgggtagtccctgccctcaagtggccttgattttacaggagacttgccatggacctggaagatgcatggagcacggggcagcatttgcccattccctcagcgtgcacaggtataatggccactgtccgggagctgggaggtcagaggccaatgactgcagccaaccatactggggacagaaaggccagtccctaccaggctatccacattggttaaaataggaaccacccatttttgtctcctctccaggctttgaaagcatttgggtaattacagcttgcctttctgcctttggttgttagttttagtgtcttaattatctgccatgtcaaaagatttctcctgatccctctgagctctctcccttttgctcctagtggtgttttcaccctgcttgataagttagaattgtacagtggtttccatttcttctgtcatataaacagtaggcagttctcaaccttcccatcctctctaacttactctctactttttttccttaagagaggcttatgtgatgacattgaccaagtaagtcctctaacctcagtgatagggtggttcggatggggtggcaaggaaaggaaaagggaattgaatcagttttgattttttaaaaatcatgctgagctgaagtgaaacacttttttttttccacaaaaactgagtctgaagggatctttttttttttttcattccacattttggttacatctgcagtgagcagttgcaaatcctgagagacttctcttccctggcatttgtttcattttgcaagagtctcactgtgcctgtgtcttatgtgagctccttgaaatgaaagaacgttaatggctgaagactgttagagccatttgggtgcctgcttatacctttcactcagcaggactgccaggggccctgtctggctctgccaggtgccctcgggtgggagaataagggcactgaaacaacaaataggcccttgaccagacctccagctccttgcctgcagggaatagcactggagtacaacgtctagtacaaagtaggtgttcaataaataaccatcaaatgggataaaaccagttcctagcccagcacaggtgcagggtagatgctcagtaaatatttgttgaagaaacgaatacattactatatcccatgggggaagacctctggtcttcatagcacttgcatcatttgtagctctgcaagggctctgggctggatcgactaggaaagcagcctgagcagggaagcagatggctgatcaagccctccagccgaggagaccagcactgtttctgtgggaacttggatgccactgacctcactcatggaagcttgcaagagtggtgcaggccccagtggaccaaggccagggctctgtctgctccctttggcagtcggaaagcagcacacacttagctttgccaggacccagcttcagcggccttcatagcccagtaattacctcgtgatcaagggagggagggatgtgtgtagaaatcactttttagtagcacatatttctcttggaaaagccccagtaagctgccgactttctctcaagtgttcaaaggataccagggaactgacgggctaatttaattgtattaatacaagaggcggccgtccctagtgcagaggggagtgcgttagggagaattgtctgtcgggaggctggagttccagcttcaacatggaagtgaaaacactctccaggaaagcagacgagtcccactggggaggaaactgactctctccatggcccacagggcctgctcttcatctgtctgaagaagcctctttattgcattcagataagtgtttcacttgaaggagagcaaacacaaccaaataatgacctagatgtcccttcctcatgttttcaaacagtcccccttctctttaatccctgcaggagaaaatgtcctggagttgagatcttaggagacattggttcatttaagtccattatgagaccttcacaaggcaccccttaaatctggcagtaggaccacagttttatcctggccacaaatttaaagactttgatcctattccctctcaggtatcaatgcaaacagaacaattctaacatttttagtatggccaccccaacgtggacaccaattagctaagccagggaactttacttctatttcctcatctatgcaaaggggagaacaggttagatgatgtctaaggcccctcaagaacttgagtgctcttcattctgtaatcattatctctctaattagtttctcttctctaaactttattctcctccacggcctctgtttaggggtggaaggtagatgctgtaccctagtgtgtgtttcccggggctgtttctcagcctgctgctctgttctctccactctctatctgtccctattgcgatcattctcaaatctaactgtgactgcagcactccagttcattcatttattccataatatttctcaaacacccacacggtgctaggtgctgaatgaacagtacactggtgaacaagagtcatgatccctgctttttttggatcatatacttttctagggagacatgtattaaatatatttaatttaatttaacaaatataatttaaataatattaaatatattaaatgaatatataatgataaattgtaagacgtgttatggaagatgaacaggggttgccctgatttaatttgggaggtcaaaaaatatctgctctgaggaagtgttatttgatctgagacctggaaaaggagttatcaggcaaggagttgtagaaagtgctccaggtagaggaaagagctaacacaaagacctttgcagcagggaagggctagactggatgaacagagcttcgtgtgcccaaagaactgaaggaaaccagtgtggttggaacatacacagtgagagcagtggggtgagatgagactgggagaatgacagattagttaagataacgctggctgctggaacaaaccaaaactgacattcgaacagtatagacatttatttctcatttgcagaagtgcaaactagatattcctgagcagttagatatccctgttcaaagcagtgtcttggagaccacagctcctttcattttgcagctctgccatttttaatgacctgccaaggccagcgtgcttctctgcatggaaggctgtgcatgagagggttttctgggcccaggcctgcctggaagtggtgctcccaaccgcactcacattccgccagcacacacccaactgcaagggaggccgagaaatgtggtcagagtgtgatcccaagaaggagacagggcagatgacgcagacactgtgggccatgttgcagtttcagttttattcctagcgtgctgaggagtgtgagtgagagtgcacctgtggcaaatccatcagcacttctaaacctacacgttcaattgctaatgtcatgcaattcatcttcctccaaaagcaacatctctcacgtgttcttccagtgatgccattccagacctagcagtcctttttcctgctctattcatcgtctagacttacttgaccaatccaaccctggactggttcagtacttccccgactaggctcttcaattggtttctttctgctctgatacagaatgctaaggtacgtatttacaatgtagactatccccttccagtgacagagttattcctggctgttgtatagagcaacttttttgtactatcaggtcatcctagaaacttaattagtaatcagagtataatgaacatggagatgtgtctttctaaaacaggcctttcatccctgctaaaaaaaaattttacttgcttccaagtacctactgaataaagttctaacttctatatgttggaggtactaacgcaacccatcttttcctaacaattcttactttgtcctcctcaagccagccagggtgctcaactatccagagtccaaacaaacttggtgaattctcaccttgtactcttccacactctgcctgggatgtcctgttcctgctcatcctcctctctgaatcctactgatgttttagtgcaagccttcatcccctaagtctcaccttctctgggaagtctcccctccaaccaaccagaaatagactttccatctctggagttctgtagtgcttactcttcaaagtaattaatgcttaaattaacttgtgtcttaccactcctttggcatttatcatgtattgccttttattgacatttattctcccaattcattctaagcttcttaagtagagatacttttcctggtatctaaaacagtaccttgcacaccctccaaaaaattattaattaatttaatgtttttctgtaattcctgtgacaccttatacagtttcttaaacatggcagatgctcaaaaaattcttgttgatttgttattattgttattttaatgtataaccccctgtaaaatgcaaagtcttggtcagttaagggggagtgctttttctgggaattccagccccaaacggaggtctgggtaaaatgcatggtggagaggggagtctgtgagtgctcctccagcctctgtgcacagcttcctactttgctgctgctgctgctgcttttttttttttttttaattgagatggagtcttgctctgtcacccgggctggagtgcagtggtgtgatcttggtttactgcaacctctgcctcctgggttcaagcaatcttctcacctcagcctcctgagtagctgggactacaggtgcacaccaccacgcccagctaatttttgtatttttagtagaaatggggttttaccatgttggccaggctagtcttgaactcctgacctcaagtgatttgcctgcctcggcctcccaaagtgccgggattacagacgtgagccaccgcgactggccgctactttgcttctcttgctcattcagaaagccaactctgggtttgtcacagattgtttgcttacaaatattcccactttttcattcacaatccttctttccccaagaaagaggttggtcgcaaggtgtaggggtgttgccctggggctctgtctttccaattttcccttctatccagatttttcatctgccaaaccctatgagagccaggagagggcatcagatcaaccagccaaagcttcaaaatctgccttgactctgtggggttctgctcacctacacctttgtagggtaccatcctctagtaaaatgagcctctactatgatagcaggctcctgcattctatttctaaatctgcctgattctaaacattcttgtttgagtcagatgggaaatacagttctgtttcatttttctccccgtcttaattggttttccgtatgcgggttcagaagtaggattttgccatacacatcatccttcatgtgagtaggtgagcaccagcatcaggggaaggaaaagagacaaactgactgttagggagggagtctctctccagactcggctagccagcacagcttcagatcctgcccctcaagtgagtcacttcatgaatgtggctaaagtgtctaacggttggcatttctcaggaagcatgctgggattatggatgtgaaagttaacatgggttgagagaggactgaggcttcagcaatctcagaatgtctgtctgttgagcttcataaccaagctgccaaattcaaatctgcatctacagattcttgagcacttgaggcgggtgccctctgaagctggaccttttcaaagctgctctgaagagctgggtggcacctccttcatatttcattctaagtcaattgcagagctaagaaaccgtctttgcttactgtctcagatgtgtttccagttttcattggaaagagaaattgtgttctgaatcccagttcatgtgaaaccctgataacttctcaaaatataaaacgtccttactttcgggggctgctgtcaagaactagaggaggctggaaagagttgtctcaaatgtttgcttttttacctttggcaagcatcacctagtggccctcatgtcagtgactacagggtttgtgtaacatgcctgggtttgggccatggacagcaatgttgtggagggctgcccttggaagaacaccagccagcttcagttttctgcactgtaattgttgccactgctaccccagtatgggctcctggggtcaggagggatggcatcaccaagcttcccggagggggcaggcccacctgacagccattaaaaggctgattccgtgggcagggccctttttccaaattaagtattaaatgaacattatttcatccttatccaaaactgtgctcagagcctagacacgtctttcctgcacaccggaatatgaaccgtacaacacagggtgagctcagccttcagcaaggcgttttggatggtgaggctttgtggttgggattgcactaaatgccatgtagggggcgggggggtctttctcctttcatcccttgccagagactcagcctgggccatgctcatcatcataatcacaggctgaagaggaatattttgggtttagtttccctttttttttttttttttacacacaatgcctatttataaccatttgttgacagactctaccaattacttaaaaaaacgtgtatttagacagagacagaccaaaaatgtgaattcaatggtggccctagttctgtattcgattagcatctgctggtgccagaactggagatggctgtctgttgtcactttaattggaggatgattagaaaaaaatacttgcttttcttccaatcttatctttgttgttaccagctcatcagatccgcaagttcatgtttattatggccattatatgttaaaagctcagtgcattttctgtctccacatcatctataacatcctgttgccaaatccagttatctcctttcctgctttctcatactttccctctctttgacattaaccattttctccatggagtatttcccctggcttctgaggccttcttctagtctaactcctccttctcagccttttagaggccccttcccctatgctttgcctttcaaatggtgtttctttccagaattccatcctcctccctgttcttttctcagtccatatattttttccaccttaaatacagccagaagaagtggagacaaggcacccagtttgagagtccaggacttggcagtgcacatcggacattagagaggggttacccataaagctatcttaggggcagctgaatatacaggatctctgtgattcctacccttaccccaaaaagcaggatggctcacgggggcagcagaaaggtgatggagccagagagagtaggtaagctattgtccatggtggatacagggagagacaagctgaagaggttgaacctgttttgatggccaaggccagcagatggatgtcaatatccctatgtgaaatacaggagtggagcaccatcgaaggaatgatgtgagaaggaagtgagaaggctgggctttgttactgtgcaggttcacctgggctagaggcactatggttggatacacaaaacaacagtctgggttagagataagattctggagtctagaatacccagcgaaatgttgggcatggaaactagaggaacgaaaacattgaagagatgaacagtgaaaaaagaataagcaaatgaggctgaaaagaatggcaggtagaggccgggcgcagtggctcgtgcctgtaatcccggcactttcggagaccaaggcaggcggatcacaaggtcaagagatcgagacctgccgggcgcggtggctcacgcctgtaatcccagcactttgggaggccgaggcgggcggatcacgaggtcaggagatcgagaccatcccggctaaaacggtgaaaccccgtctctactaaaaaatacaaaaaattagccaggcatagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaagagatcgagaccatcctggccaacatggtgaaaccccgtctctactaaaaatacaaaaattagctgggcatggtggcgtgtgcctgtagtcccagctactcgggaggctgaggcaggagaatcacttgaacccaggaggcagaggttgcagtgagccaagattgtgccaccgcactccagcctggtgacagagtgagactccgtcaaaaaaaaaagaatggcaggtagaaatgagactcccaaagatgaacccagatggagcattttctctatgccaggcactgcagtaagtgctttgcacgcattgtctcacttagagactgaaaaggggaaggacaccttagaaagaagaaaatttcaaaaagagagaccctccttctgccttgatcatatttgtcactctttctttacctattgcattggcctatccatagggctcttcctggatcctcctggggaattggtatgtcttttggaatctcctagcactttgtgcgttttatttattcaggcaacaaatgtttattccactattttagaatttatggtggttaaacaaaattattttattattacctgctgaactccagcttattcattctgaagatttagtgtctaacacatatagtgatcaacaacataggtatttgtttagtaagtaaatgaataatatgaaataagttattttttcaagactcaaatttaaaccaaagcatgagaagagctcttgtcaacctatttcaggtataggtggcttaatttactacaacggtcatgagttgaggattcattgaatggttgttttctgtcatttttggtttacactgctcaatcaacactgctggctgatgtcagaccttaaccaattgttgaagttccctgtaacaccagcacattctctgaatacttactatgcacaatgcaataatgattaacatttgaactctgtctaggctgagtaagccacatcaaagctcttttttcactaggacttttaaaatatcagatatgaactgagtgagtaggtgtcagagaaattgactttgtaaactgaaaatcataaacttaagattcatttgaaatacgtcatgtggagtgcatatataaaaattatgagcattttaatttgtcccctgtaggtaataaataacatctgcaatattcctcctcacctttttctgattagcttcatgtctggcatatttttcccaacactcctgtttcgtgttgtaagaatttctccaaggacagacaggattctaagtaagtagtgagggtctaacagaaaacttgcagcaaccaggttcaagttcagaaatgagggaagtatttaatggtggtcaggcctccctattttactcttctttggtacacgctggcagagctgcacaggccccgaggggtggcagtgcctgtgaaaggcacagtgcctgtgaaaggtctataatctagacccacaagccagccccctcctccccaaagctggtgtggctcccaggccccctcactccccacatgtacctgcacccacatgggggcatccagcagagtgccctaggccaccagcatccccctagggtccatggagctggagggacctctggagactcccaaagatgaaccaaggtggacattggccacctctgctgggcagctgcatagagtttgtttgggaggaagattttgtccttaaaagtttgaaaaccactgccttaactgtgtaatttcaataactactatatgatgatgataacaataatagctaacatttattgagagcttactctctgccagggaccctattatgggctttcaatgtactatctcatttaattctcccaaaaaaatctctgaggcacttactgattttatcagctagaaaacagaggctaagtaaaatgcccatggttacagagttatgaagtaggagagctggcccatttagtctggctccaaagccagggatctcaatcttgctgctaatactgctattaattagctctggtaaaagtgaagaggcagcctggacaactggaaaacagaacagcacatgtttagtaagtgcctatgacagtcaggcgttaaatgatgcttgagccttagttactctgagcttcactctatccctctcaccccagtggcctcacctaattttggaaaagttggacaagcagtgagacagacagggtaaaaagaaaaaattggcttgtaaatactccccgaatatcctgcctgataaaacattcttcctcctctccctcctcctccttcctatcacctctccctttgcctttctccccaaccccacctctcttctttgttttctgttttctttttgcctcccttatcggtcctgtcttctttgccttgtgttagattctttaggctcctatttcaggacaggtcacatttactcttgcttctacactaggacacaccctcccctcttactactcagtgttagttcactggcctcaataaacactggatgtttttattttatttcatgtttgtgcacttgaagactattgaattcattctgtgtgtttttttttccaaaatgatatatgaattagaattgcccttttgagccaagaaccctggtgggttttgttttgttttttaacagagccgcaagcccaggaatgagaaatcagttcataaaatcaatagcaagcaaatttagaatccactacagcacctatacccagcttatagtaagcctgagaagcagactcctacaggatgagattgattccagcagtgtggttagatatttggaaatgcctaaagaaatgtttatgctcaagttaaggttgcagcagaaaccatataacttgagaatttctggggcctaaatgtacgggctctacagaatgtactacgttgctttgtgcctctgcccagatcactattctccttttccactttcctcccatgctgcccccagcacacgcatacttgcctcatcgcctcaaaaaaaaaataataaaaattgaaatctttctaatgccaattcagccttccagtttcatctgagacatcacttcttcagggagatcttctcctttccctagactaatcaaggtccccaccttgccttcctagagcccccatccctagccacaacacccatcaaaattgatcatcactgcttgtctccttgccttcctccacctggctgtgtgcccagcaactaggactagttcaagaagtatttgttgacgaagtaaatcaatttagtttggggggaccatggccacaggatcaagacacttctcagctctctgctgtctccttactcttgctttccagactctgattcccgagcagttgggaagacatctttttgtttcttccattctgaaattcactgaccaactgcgtacatccatgctcataaacatttgatttagctataaaatctattttaaataaaaatgccaattagagtagaaacttcctgctcctccctgtccccactatgtgtaaggtaagtgtggaggtgggaaaaagagcgttgtcttctaaggagtgggagttgaatgtctcctaggtgcccactgcaggcagcatgaaaataataggatggatactataggaggcacatttgagatctttcaaattgctccagctgaccatccatgacatgggctacctggtgaggcaggaagtcctgtgtgggactgtcctagggcaatagctgtgcaaagaccatcataagtgcaacagatgctgctgaagatggtaatttcaggcagcctatgttaggccagggctcagctgggctagactaagggaaccaaagacaggtatgaaagggactgtaggctccagtgaccccaaggcagaaccagaattgggaatctctgttctattgcactctgtttttacaattctggccagacctgtagtgtggcataccactacaggttatgtggggaaaatgttaccacatattccccacataattttctaacaatacctcgttccctttgcagctggttcagatctcacagtcataagagggttgagcagttggtcacaccttgacttgacagctgtcagtcagaggccataggttcaacatatattgaaatgatttctttcagttggtcagttggttttacctatttgcctgggcttatggcgaccaccgtggaaattcaagagacctgtacccagaatccgtgcacttatggtgcacagaatgctcactacgtgtagaatcttatttcctcttcacactcattctatttaggtagtattttggttctcatttttgcatacaaggaaacaggaactcagagtggttaaatgactttataagataagaaaaagagcttgttctaaaggctattgaaatgccagtgattgatttctctgagttacttttcagaactagagtgatggcatagggcaagcttattcaaacccatggcccacgggctgcacgtggcccaggatggccttgaatgcgtaactttttttttttttttttgcgacagattctcactctgtcgtccaggctggagtacagtgatgcgatctcggctcgctgcaacctccacctcctgggttcaagtgcttctcatgcctcagcctcctgagtagctgggattacaggcatgcaccgtcacacctggctaatttttgtatttttagtagagatggggttttaccacagtggcccggctggtctcgaactcctggcctcaagtgatctgcccgcctcagcctcccaaagtgctgggattacaggcgtgagccaccatgcctgtaaactttctgaaaattcataagctttcttaaaacattatgagttttcttgcaatttctttttttttttagctcatcagctgtcattagtgttagtgtattttatgtgtggcccaagacaattcttcttcttccagtgtggctcaaggaagccagaagattggacacgcctggcatacggcataccactgcgccatccaaaacagctgtgcacagccccacttcccagctgttaggggcttttttcatcttcaaaaattaagcaaagaggttcactaaagcatcagttcagagtgtggggcttctagtcagtgtattttagggaattaattttaggaagaaactatttttaggtccacgattatttttaaaaacaaaaatctagacaacagtgcatacatgcacgtctggatatgtaagcccttaccacacagcgagatgagagggtggccttggccaaagcctgcagttgttgggacattcaaaaccatgagcagactggagatttgagccacatgtgcaccagcgcagtcgctcagatgcggcctgggtgcgctgatctgggagggggactcacgggctctgggtctctgactagctggcacatgaaggaccttaatgacttgaacctcactttcagtttgagatcctttgaacttttgttagagtgagccataaagaagtggtcagccaatcagatgtttagtataaactgaactttagcgtaaataagctttaagagacacatttgatttacataataaataaacaagctacttttaggaacttttaagtacaaaagttgaagatagttgctaattaaacctaaatcttgcctgtacattaaaaacatactcgacagaatttccagtttagaaaactcctcaagaaccaaatttctgggacagctggggtgtttttctcacttagcccaagtgagtaagttttactgtaagtaaatatgcatacatcattaagtgaaggtggcatcacactggcagggaaagtcagatgggttattggcgaagaatgaaattttgctgatcttcataaattgtgaaatgataaaaaacaaatagaactcagtagaaatgaatggcaggccaaacaaaccggacagaaaaggggctacagactaaaagtggtaaattacagcttctacacataaatcctttttaccccaaccctctttaaattctggaacataaatgggggaacaaatatagaccctttctaaatccacaccagagaagtgactttggttgtttttttgtttggttttattttgtttttctgatataatagtgatttttgcctcctttcctcctctttgtaaggtcttgggtagaagaggttgtaaaagaaaatgaaactatattatactgatgataatagctaccattcagtgatagttattgacagatgttaatatctgtttcatagagcaaggattaaatgagttatacatagaacacttaaagcagtgttttatgtttataagcatgtagtatttaagtattagatattattatctttaatgttggcaattgtcttaacaatataacagatattctactaagcactatatatgtcttatctcacttgctactgttatgttaattttatagatagtaatctgaggcatgggaagtttaaaaagttgcctgagattgcacgggtggtaataactgcgcactttctatatgctgtacttagtactagacatttttaatgtatcgttgcatttagacctcacaacaatactgaaactgaggcctagggaggccagctaacaccaagatcacacagccagtgagtgatggagctgagattcaaacccaagcagtctggctccaaaagtgcatgttctatgctactgtgtactatggcctcctggagaagggctggtaggatgccacttcaatgatacagccctttcctccatcctcattaccatccctagcactgctttccttcagggtcacaacagtaggtcttcctaagccccattctccaatcatgtccagctcattgtacttgagcagcatttcggagaggaaatgcctctagaccctcccgttcaccctacagcgctgtttgtgccacgcttccctcaccaccctgccaagcccttgcttgcacacctctaatgccagaaaatcatcctcccaaggaaactcattctttctgtcttggggaagctctgtctggtggaaacatattcctcatattgacccaaatggtgctatgtgcctttaacctttctgtgcctcagtttattcatccatgggactttcacgaggattaaattagacaccaagtgcttaaaacaatgcctcatctgtattatgtttgctaaatattagctgctattactattttattattattagttctctctatggcttccaccccaaatgctttatagtacaaattgagtccttcttgaattcactctttttcacccttttgtcagctgcagcctgccctccaggatatgatggtggcctttgtgatgactttgtagactcaataccatatcactccagtctgctgtacatgcatcgttaagaactgtctttctgggatattgcttttgtacatcatttccctcttcagaagccaaactggttcttggttgctttcatactttggatggattattagattctctactaatttcttgctgatctctacccatgctcttctctctgagcatgaaaacttcctgtcttccatggactttcctcttcttatttgcaggtcagctcacatatttattttgtttaaacattatgtagttaaaagtctcaaaggctatatacgaaaatgttaacagcaactaataaattaacaggtcatttttattttccttttcatgtttttctgtgttttccaacatatatacaacaaacatataaattgcattgttatgaaaaatactgtgtttcctaaaagtacaatcatagactgtattatacaatactttccaaggtcaagaggatgccttgtgcagtcaagagagtaggattgcctttcatgaagatcagaagtatctccagccctcccctcagtcccttccctttttggtgaacccattggaatcactaattagtgtatttcaaactatatatattagccatagaccctttcttcaaacaaaaatgtaggccaggtgtggtggctcacacttataatacctcagcactttgggaagccaaggtgggaggatggcttgaggccaggagtttcagaccagccaggtaacgtagggaaacaattacaaaaatcatagtggcctctttaaaaattttttttctaatttttttaaaattagctaggtatggtagcacatgcctgtggtcctaaccactcaggaggctgaggtaggaggatcatttgagccaagaagttcaaggctgcagtaagctagtaagctgtgatctcaccactgtattttagcctgagcaacagtgtaagaccttatctcaaaaaataaaaaaataaattaaaaaaatgtagagaagtacaacatatttagcagatattatagattcttccttaaggagttgaactctgttgaaatggagatggtgaacctggaccccgacccactaactcaccatcctatttcaagacaacttctgagttacttccagaacctactttgggtctggagaacacagttctccactgaaaccaccaccaggccacctcattctggtaacaaacaactcccaatttctaggggttgctcagataaggagtgctgtaagtttactacgtattatgtaacatatttcatcagtcctaaaattttctgctgatctcctttttcccatccaaaatcaatacacacggctaatccatcttatagctgaatatttctgtctggccagaaagctttattatctcagaggtggctttcagctcagaaggaaacgagaaaaatttgtttgtttatacttctctcttaactccctagcttctgctcattcatcaagctaatagatggaatatttggctcttctgattcgccatctgaaaccctctgctctcttggcttctgtaatgtcctgtttaactggttcacttcctcatattattttcctctctactccgtttgctgttttcctttggccctcagtgctctgtttctgggcgtctgctttcttgcttccctccctaggcagcgaatccacttctagggttaagcaatcactgcattgcgggtggtgcttagtgtgtgcctcagtctgtcagacagaggccagtcctatagctccaatatgttgtggagccgtctaccttgagctcaagttaattcctaaaatcagtatgtctcattccagaatcctttactccccactatttcccgtctgaacatctctattctgccaatatcaacagtattctctcaatcaccaaactcaaaaccttggattttatttatcttttatattcttttgtcaccaaatatcttggctttcaccttgggaacttctcttagatgtctctttgctcatcacttcatgtcatggaattccagaacacagtgctgtattaccacatacagttgttaatcaacaaatatttcttaaattggcatctagtccaactctgtcaacgaaattttaaaagtttgttaacattctaagaaacctctgcctcctgtcttgggtcctgacagtttatccaatacactgtcaagttaatagtgaaaacacccagtgcggccaaagcaatcttgggaaaaaataaaagtgggaggactcaggcttgctgatttctaaggttactactaagcttgacaagtcctggtagtgtggtactggcataagaatagacatagatcagctatgtgtgtggctcacacctgtaatcccagcactttgggaggctggatcgcttgaggccaggagctagagaccagcctggccaacatagtgaaacctgtatctatatagatagatagatagatagatagatagatagatagatagatagatagatggttatcgattttttaataactatagatcaatggaatggcatcgagagtccagaaataaaccctcatgcttatggtcaattgggttttgacaaggataccaagacaattaaagaggaaaaaaatactctctcagacaaatggttctggagacaactgagatatctatatacaaaaggatgaaattgggtgggtatggtggctcatgcctgtaatcccagcactttggaaggctggagtgagaggattgcttgaggccagaagacaagcctgggtaacattgcaagacccccatctctataaaaaatcagctgggcatgatggcatgtgcctgtagtccccgctattctggaggctaaggtgagaggatcgcttgagcctaggagtttaaggatgcagtgagctaaagctaagatcgcactccagcctgggtgatggagtgagatcctgtctctaaaaagaataaaattgagaatgtaatacagaacacatttcagccattttttaatgctctgcagttactcgaaaggttaaacatagacttaccatataactcagcaattctgcttctagatatatacccaagagaggtgaagatgtacatccacactgaaattgtacatgaatgttaatggtacattactcgtagtcgccaaaaagtataaacaaagaagtgtccattaattgatgaataaagaaaatgtggtatatttttggcaatatacaggaatgaaaggaatattattcattatttaaaaagaatgaagtactgatacatgctacaaaatgaatgaaccttgagaacattatgccaagtgaaagaagccagacacgaaaggccacatattgtctgatcctatttatataaaatgtccagaataggtaaatccagagcacaaagtgggttaagggttgcctagggctggagggtgtgggagtaaatggggattaactgccaatggtgcagggtttctttctggggtgataaaaatgttctaaaatatgttacagtgatggttatacaactttgtgaatatatcatactaaaaaccatagaattttacactaaaaatgggtgaatttgatcatatgtgaactatatgatatactctttaaaaaatatatttaaattcctcttatgtctccctattgattagaaggaaaagttgccacctctctgacccttcttctgcagccacatctccctctgaccataatcaagaagtactccttgcatttatgaactcatgtcattagatcgggcccatccagataaatctgagataatcctcacatcttacaggtcttacctataatcatacctgcagagtcccttatggcatggaaggtgatgtattcataggttctgggagattaggatgttgacattttgaggaaccattatcctgcctatcataccctgttttatacttctttctattgcataagagtctcacacatgttgacagatggatggaaaaaatatattatgcaggtactaacagcagcaacaatgacagctaaaaactgagctatcctatacatcagataaagtagatttaaaggaggaaagcactattagaattaaagagggagttttcaaaataattatccagtcatagaagagatttttaacatacctctctcagtaactgatagaacaagcaaacaaacaaaaatgtccataaagatataaaagatttgaacaccatagttaacaaacttgacctaaatgatatacagagcattgagcccaacaacttcagactacatgttttttacattggtgcttggataattcatagtccgtattagaaatgaaaatgttgaatatctgttattcaaaaggttataaaaaaaataacaaattaagcccaaagaaaataaaaggagggaaataataaagataaaagaagttaatgaaatagaaaacaaacatactacagataggatctacaaggccaaaagtttgttgtttgaaaagaccaataaaatcaggccaggtgcggtgactcacgcctgtaatcccagcactttgggaggccaaggcgggcggatcatgaggtcaggagttccagaccagcctggccaacatggtgaaactctgtctctactaaaaatacaaaaaattagctgggcatggtggcatgcacctgtaatcccagctactcaggaggctgaggcaggagaattgcttgaactccagaggcagaggttgcagtgagccaagatcgcaccactgcactccagcctgggtgacagagcaagactccatctaaaaaaaaaaaaaaaaaaagactaataaaatcaattaaacactagcaaaacgtatcttgggaaaaaatgaaaagcatgaattgccaatatcaggaataaacaggcaatattactacagatgctacaaacatttaaaagataatacaaaacaaaagttcacatgtactacacaaattcctaataaaatacaagttatcaaaactgacaaagggagaaatagaagatctaaatggtcctatacctgctcaggaaattaaatcaataatttcaaaccttcccacaaagaaaactctaggcctagatggctttaccaacaaactcttttttgtggatgaatagtattccattgtgtctatatatcacattttctttatccattcatctattgatggacacttaggttgattccatatcttgactattataaatagtgttgcaataaacatggaggtgcaggtaaccctttagtataccgatttcctttcgtttggataaatacctagtggtgggattactgcactgtatggtagttctatttttaattttttgaggaacctccatactgtcttccataatacctttactaatttacactcccaccaacagtacacacatacatttttaaagcataaaacagtgctatatattatcccttggcacatatgtattctgcattttaaaatggctgaaggatgcactgaagtcacaatagcagcagcctctagaggagtaaatgaaaggacagggtttgaggataagaacaaaggagacttcaacttcatttttattgtccagtttcttttattttttttaaaaaaaggcaaacatggtaaaatgttaacatctgttcattttgggtgatggctcatagggtgttagtcatattattctttgtaattttccctttgtttaatttctcaaaatgaaaacaataaagtcaagataatagtatctttcatagtttagtcttaggcttatttattgtttaggtattttatgttcctgtttgtcttaagaaaaaaatgtgtataaatataagtatagatgagatagttaaatttcctttttttgtttgtgttcacaaaacatgcttgttttatttaacattctttggtatcaaaatgtggccttcatacaaacttgtgaggagtaaaccatgagggttcacagttttaccacagtctgtatgttagcaaccatttcctgtgatagacatgctcatgcacctcaagtactagaagtatccatttgtattggagccaaaatatccgcaagcagagaaacaagaagtcaaaaatattttcctctttggtgctaaagatttgctgctgtgtgattgttgagactgaagttctgaaagcaccagtgtttgccggatctgtctccagcttgtctctacaaggtcatttccaaaagactgtcaaaagaatggcatgtcccgccttttccaccaccgacacaccctgcatgaaaaccccaggagcacagaagtcctgcttgggtgaggataagggctctctcaaagtctattatcgaaggaaggcagacagatgggttaaccactccaatggagtctatacttttacagacatatcacatattatgacaattaattattaggctggtggttcagcaacctttcgaagtgatcccaagatgattgctgtgaccatatttgaaaagctaacagataaatgtgggcttaaaacagactatatgttattcagctaggcctcaaccataggcataagtaggagtgaggtgagggcccttgtggacccaccagggtcttccacaagagtagaactcttgccttgttcactcctttcataatcaggcaaaggaaggagttattcaaaaggaggaactgagcatgttcaaccgagaccctttttgctgtccaatttccagccagcctgtcacctggatatatgtaagcactctggtctgctcttggctgtgtgctctaagggagcccactgggtgttcagcaagatcaatggtgaggattaaatctttctaagtcaagggtcagttacaaacaagatctctctgctacagatctgaagctgtattctctccagtcaattttgtcagtaacaaaagcagtattttttgttccatctgtctatcttctacctcttaattggtttcaaacttaagaggtggtagagattagtaattgctccccacaaaagcaaaaaaccaacctgatgatcaattaagatctcaaaaatgataaattaatataatccatgataccagccaaaaatttgtataccaaatttgttcttacccccatagttatcctgtctgaatagttaactgagcactgctcacttttagattccttaagagttgttaaaaaataagtctttgtactctatcatggcatgcatgaactctcatagcttgaaatgactgcatgaaaatgtacattttataatttcttatactatttacataggtataagtatacacagaaagtgtgtttaaatgtttaacagccaaaaacaaaaaccaaaaaaaagtcactctgctgtaacagaacactgttctgcatatggctagctgtacattggcagaacatagcgattttaaggatgaattagtgttgtaatctctttgggatttcctttatatttgcggtggtttatgactgacatttcatgtaactatagctttctgtttggatttaataaaagattcatttctgtggcaagatacacatttgcactccagtgttgaataaaagctactgttctgcaagggtataaaatgctgatttataacaacacgttccaataacagtgatctaattctttcaaactatttcttcccaggtcccaggaacagcatggctccagcaaaggatgactcttctcttccagaatattcagcctttaacacatctgtccatgctgcaattagacatggaaattggaaactcctcacgggctacccaggtagagtccttagcttagcaaacttcccttcccgtggtagacaaagcagggctgtgtcctcagggcagtatctccagtctatctgccctcctgggatttgattcccacggccatttctctggaaagagaggacattatcactcttgttctaaccgtttcccacctcttcctctgtggctcctcctcaaggcccctaagccctaccacttacctcactttgctcagatacctgaaatcttaatttgtctttctaatctttcatgatccctcctgatatatgtcctagaaagacaactatttattcagggttttcttttcccaattctaagactccgcctgttcccaattacacagcttccatcattgtcatggtgcaagtaagctttcccagtggatcatcaaggagaagcttaccgaagtaacaaatgccttttgcaaaacatatctctggggctgctgaatgaggagataggaagaaatggtttaacctactcgtcctaaccaaaaaaaaaaaaaaaaaaaaaaaaagagagagagagagaaagacagagagaattaactgtagcaggggtgaaaggaagaaatgtcactcttatgcttcatggaaaatacggattttaaatatatgtggctatcaagcacagcacatttagctaacaaagagagtctctgagagctacaccctcaaccagtggtatagctggggaaggaggttgctcctctgattatattctctaagagtgatatcttttcaatacttttaaaatatgtgggatgatggttaaggctgtgatgtaattaatcaatgtttacaatgagaacatttttggcgtttgcaatatgacaagtcttttttgactgggattgtcccatgtattgcaagactttagcatcactagctcatgcccactaaatgccaggagcacccctatgccctagtccttgtgacaaggacatacacacatgcacacacgtttctgggtgtccttgcttgtgaagcagtgagacatgtctagttaaagcaccagaagtcaagtctgagaagcatctagagacagcatctagggccgcatctttttatgtttccacacccacaacccagtgcagccttggcctcagactccttccctgaaattagaacctgcctctgtgcttctccctcagtaaactgttttgttttctttgctaggctgtggttactggttccctccaccgtctcaatacaatgtttctgagataccctcatcagacccaccaaccaagaccctctggctctttgatattgatcgggaccctgaagaaagacatgacctgtccagagaatatcctcacatcgtcacaaagctcctgtcccgcctacagttctaccataaacactcagtccccgtgtacttccctgcacaggacccccgctgtgatcccaaggccactggggtgtggggcccttggatgtaggatttcagggaggctagaaaacctttcaattggaagttggacctcaggccttttctcacgactcttgtctcatttgttatcccaacctgggttcacttggcccttctcttgctcttaaaccacaccgaggtgtctaatttcaacccctaatgcatttaagaagctgataaaatctgcaacactcctgctgttggctggagcatgtgtctagaggtgggggtggctgggtttatccccctttcctaagccttgggacagctgggaacttaacttgaaataggaagttctcactgaatcctggaggctggaacagctggctcttttagactcacaagtcagacgttcgattcccctctgccaatagccagttttattggagtgaatcacatttcttacgcaaatgaagggagcagacagtgattaatggttctgttggccaaggcttctccctgtcggtgaaggatcatgttcaggcactccaagtgaaccacccctcttggttcaccccttactcacttatctcatcacagagcataaggcccattttgttgttcaggtcaacagcaaaatgcctgcaccatgactgtggcttttaaaataaagaaatgtgtttttatcgtaatttatttccccccagccattgctcactctgtctagacttcctgccacttccaattcttctgtggcttttcctgcctttccttttgacctcagtagtcctatccctgggaaggccactttgcttctctacctgagcacccctgatttctggaacgctgctgagccctgccttacttttgcccctagggctgaagctagaggcctccccgtaataggcggtggagttgctctgtgaggatgttcatggtagacactaagagggctgggtgggagatgcttggctctgtggcatctgttcagcgaggcttttcctatattgcatggagttagtcattgtgattgtagctttatttcataatatattaagacttgcactgctatttactagcagtgagaagaaacctcaggaaaggatatgaaaaagcaagtggccagtgtctgggatactgggccttggtaaagcagaggagggcacacccacagtcctcttattctctgttttactgcttgttttgaggttctggggtctggcaaagaggatgcagtttgacacctgcagccctttctcaatcccactaatgtcttactaatgtggaacagtccatattagctccagagagtgtcaaacccagagacatgtgtgcaaaaatgatactcttttctgcattagccccaccattgtgttcaccaatgcttggaacactgcctgaaggcactcattttttaatttttattttatttttaattttttatatctttatgagacgatctcactctgtcaccaggttggagtacagtggtacaatcacaactcaccgtagcctcaaactcctgggctcaagtgattctcccacctcaggcacccaaatagctggaactacaggcatataccgccacacccagctaattttattttttgaaaagacaaggttccctatgttgcccagctggtcttaaactcctgggctccagcaattatcccagcttgggctccaaaagtgctgggattacaggcatgagtcaccatgcctggcctcattttttaaaacaaatgaataaatggacaaatgagtaaatgagaaagtctcacaccatgaaagatgctagtccaatgagctgaatacagaggtaatataaatgtcttccagctgttgcttttctgttctcaagctgcccctcctggggtaggagcataatctacatcactgggcagtcacaggacactctatagcaaggttgtagcgtcctctccagtggggggagaaaaggaactgtgcctaccaaaggtactctcttgtcagcaatttccatttctatactttatgggacactagaaactaaaagcaacaaataatctgatataagtccttgtatagtcatccttcaattcagtagcaatattttctggtcactactaacctgtattgtattaaaatgagactattggaaggaaatggtgctaaaactaataacatctcttaccaacctttacccaactcctgggttggcaaacagctgaccaaactgccatcacctcccacttggaagtgtatggccgacagcatgaaatagctgagcccagatgttccttctgcatcctccgaatcccagggctgggtgtaggtagccgttggaggccatcgctacagggcacctatctgttatcgctgctgtcctcccaacagctgtctccagttctagttccttggttttcaggcacagtgggggatgttctgcacccagtggacttcaaaagagttttgaagacttaattttttgtaaaacaagtacttgagattttggtttatccataatagaatgtatttcattagattctctgattctatataagaatgtgaaaagattgatatattgttgttagaaataatgttatttctttccaattttttttttttttttttttgagatggagtctcgctctgtcacccaggctggagtgcagtggtgtgatctcggctcactgcagcctctaactccc

SEQ ID NO: 803 - DNA, 76638 bp, Human
gtatttatctggaactgatgttaaaaaaaatagagagccaaaaattatagtagtcatcttgtctctgtaaaatgtaattaaataaatatgtcatgtacactgtatatacataagcaaacatgcaaataaaaaagcagcctactcaaaggttacaataatgttgcaacaattctggtagtaaccttgggatttagggacacagtgctttcaaaacgtttctctgatacactgccagtagcatctctgactgcttatttaaatgtcaatcagtaggctaggtgttctaggactttggtctcaaccctgtttcctgagtcagaatctacattttgtaaaagttcccctgggaattctgatggtctgccaactttgggagacactgataatattgtagataaagaagtgtaagcaactgttcagttagggagacaatagatacctgcatggaataacaaaaggtaattaacatgattatataatttgaatagtgttgtaatagttcataaaatggaaaagccaatttgagcccagaatctgggagataggcagaactctggactgtaaagaatggcccagcaaagaggaagaaaatgggcattctaagttggtgcaataatatcagcacaggagaaaagacagaatattggggggagtggggagggaggaagaggctgttgatgagcctgatatcattaacagagacctcatgtgaggtgccagattacaatttattgaatgtactgaatgcataaagcataagacagaaacctggagccatgcagatacagggaacccaggacaagtcattatgatgcctcagacaatataattcgcagattctctatcaatagcaaagtaagatttaaggtgctgtgaaacagtcagatccttcaagaaaaacaagaatacaaggggtcctggagacaggaaaatatgatcataataataaatttgtgattccttctttctctctttttctctttctttctttttctttctttcttttttttttttgatggagttttgctctcgttgcccaggctggagtaaaatggcatgatatcagctcactgcaaactccaccttccaggttcaagcaattctcttgcctcaatctctcgagtaggtgggattacaggtgtccaccacaacgcccggctaattttttatatttttagtagagaagggtttcaccatgttggccaggctggtcttgaactcctgacctcaggtgattcacccgccttggcctcccaaagtactgggattacaggcgtgagccactgcgcctagcctctgtgtgttaagtgctggaactatagtttacagtagcattttatcctcccaacataccctatcaggaaaaattattattgtcatccttatttcacagatgtcaaaactgaacagagaggtacagtaacttgcccaagacaacacagctagtaagtgaaactgaaatctggacaactgatttttttcagccaagctcttcaagcccgctgctatgctgcagcttagctggcgacaggcccttatcaaggcagaactgtgccttgatagaggccaggaaggcgattcagagcagtaggccttgtccatgtgtttgttccctgcttcttcaccacttgaaaatagtgtttcagtgcccagtaacagggcacaatactcttttcctcagattaaaaggggagccatctgcttaaggtggttgggtgccactgcactgcacagaaggttctccaagtgtgagcttggacccaggcaggcctcaggtcagtggtaacggacgactgcttccgtggtgttggcaggtggaaatggagggatacagctttgtccggctcatgaatccctgggcattgtcccgcctgctagagcctctgatctctgccccttcttcacctgcagtaaaacagtcactagtttggttgctctccctaatacctctggtcactgggagctgtgatctcaccaaacccctgccaggaaaagccccagaaaaagcggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaaggtaactcaggtgtggagtccgggtgggcttctctagagaggaaaatctatttcttttagagaacattccctttgcaatgtcatggctttttttttttttaacttcaggtaagtaaatataactaataggagagtatactgaattaaataaactgggcaaatgctaattttgcatccaacaatgtagtttatcattctgagggtttagaaagcaccctatttgattggttagatgctaccttcttttcaagtttattttcaatacagttttgttagtatgtttgtgttggcttatatattggttaattcaaaggcaccaggcacttgctccctcattagcccttcctgcaaactcctgttccagatttttagttgtatagtatttttatgagactcctagttacatattatttattccattgtctacatagcttcatcttctaaaactaaaaatgaacaccttgtgctttttgtcatataattttattgctgccttataaatgactttcaaaatatcatcagttcttgtatgtttttgtactttcaccttttttctgcttcatatttgacttatttatcctattgaatgtgactcttcatttttttttctctctgttcatcatgtcctgggatatggtttaccttggctacttaaaggcatatgtaactgagaggaggtttaattcagataaaatactatccttgagttgcaaactattttttctaattgaaatgttaaaaataagacttctcagaaattaactaaatcatacagtctattcaatatttccagttagttattttttaaatggtaaacctgctagtgtgactcactttttttccttacatcacacttcattatgaaagatgtgttcctcttttacaattacaaaaccaaagtaatctgccaaaaaataatgtaatattttgagatcttttagtgtataatattaacctttttaaaactctcattgtaactgggttattttggagggtattacataccatcttggtcttataataagaagagatccctccttctcaaaaataatcattttaaatatcgtacttcaaagtgataatctaggtcacacccacaccctttgggaactgccgtaagctaaaaccccaaggaaaataacagtccttctaacactaatcttgcctgctcatgagtagaatgcagacttggttgttggctttcttgtagcatgctgggttcatgcttgggagttttttctcttgtctgtagttagcgttgaaaataacaagcaaaataccggaggcagaaccagatagggcaaaggtctgattcacatggtgagtacacagggaaccatgactggtcattctgtcccctcatcctgtgggtaagtttccaaagttctggagattcgttcctctggtagcaattgttgagtcaaaaccatagaaacacaacccagacaaactgtcatattgtttaaccctaaatcatatcatttctctctagcattttcttatgaaaaatctaatccatatatctggctgcttaaactaagaacttgttctaacttgtcctgcccctagagctatgatactcactaggtgaatatcaacatagccaactccatcttttggcaaagtgtattttagcacaaagcagacatctatctacttatttcatataatattagcaggacaatgccttttaaaggtaaaatgtatctattattcttgctccaagtctaaggtgaacactttcaaaaatttccttagaaaacttgtttagtcactcacatgtatacaaagagatattgaagaaaagatatacatacattttccttctagggttctagctttatatgattttgtgattatgaacaaatcatctttaaacaatccttataaatgaaaaactcgtcgtacacattgtttgaattcatatgatctgtaactttttaatcagatagattattttccaatagaaattgttcagatcaaaatagacatacctcagtatgaatacacagcatacatagtaaaaacatgttaggaaacatctctctgttgaaattactccacgtaagagactgatattttttagtaaagattttacaccatcatctacatttctgtattaaagatctggggcaggggaggacaataacttttcaattgtactaaaaataaataaataaaaatggacttccacattagggacattagtatatagaatcctggaattcttaagttagaagaatgctaagagttcatttaattcatattcaacttccacgctttaaccttctacttttcccctttccctcagcaccaatgaccttaccaagtagttgtctaatttctacttgaatgcttccagtgatggagaatccactaccttctctatctagctattctaaaagtacttacgtgcctcctttaattctgcccccacatattaacacagtttctgtattccacatattacaatttgtgagcattactgtaactacagatttgtttttgctttctgagaaaacctgaagggtaaagactaactcttattacatttacaaaataatattactagctaacatggattgagtatttctagtgtgccagctctatgccttttgcacatatcaacttatttaaaattatacaacaattctgtgaaggagatttcagtattaatctcatttcatagttgtagaaactgaggcacaaatggatgaagtaaacttttcaaagtaaaacaataagaggtagatataggcttcaagtccagagatactgaattcacagcctgcaccctagccaccgcgctgtatagaagtcatggcatatgtgggtgctgttatgtcttgattatggctgggccactgtccccacattaggaagcaaaacaaagccactctgatcaactgatttagacatttgcaaggtattttctccaaattctctttccttttaccctcatctttgagtttaagacaaggataagactgatttgcctttagaggtacagaacaataacaacaacagcaaaaacaggaaagtaacccaccactcacaactctccctgttgtctgtcctctctctaattttatttaaaatcatgaatgcagtggtttcacattttttaatcttggttctgccacttatcaactgtatctcttggacaagttactgactctttccaaaacagttttttcatttgtttgtttccaatatgaatcccagggcttttaccccattagccatctctcacctctcaactagaaataaattccaccaaatcaatactttttcacaatgttccccagtagattaaaactatatttgattgatcagttgaaaaacagctcatatatttattcataaaggatttggtcatattttaatcatataaaatctaaacctacagtttgggtttctactgtgatattgggttctttttagaaaattgattctgaggaatgatattagggtagattaacttgtgaacaaatagttatcacaacaggatatttttgaagagaccaataattatttcattaactttacttattgatcatatttataaaactgtggacttctgaaatacaataaagatactggtattctactagaagtctgaagatatgagagatctactttttttgtaatgtgagaaatagatattgaatatgcctttcaaattagtttttgtattttatttccagtttgaatctttctgtaacttcctttaagaaaattgtctacagagagtatgaaccatattttaagaaagaaaaaccacaatctaccatttcaggtaagcctgaaatatacttttttaattttaaagataaatttctatgggtaatttggcattcacatgcatctaaaatatccatttactgaaaatttatagaaacgtgtggttttttttttaagaagtactggctacataatatgtggggcccagtgcaaaatgaaaatgtgagtccccttgttcatattattgaaaatttcacagtgactgcaaagcattaaaccaagccaggggccctttggggcatggggccctgtgaaactgcccaggtcacatacccatgaagctggctctgtttttaaccttgattaaaataactaaataaaacttataagtgtttgaatttttattcattcatctaaaaaactgttattgagtacctggtatgggctgggcattgaaataggcattgtggatgcaatagtggacaagacagtctcatatcctgggttcatggagattatggtctagtttaatgagcatagatgtgccttcgcaaaatgatattttgcttccatttggctccctagattcattcaaaggaactatgtatggctgactcttttgcatctctttcccgtctattcttctgtttatttagtgtgatatatacaatagccataatttttaaagaaaatctcttattttttcctcatctcttcctttatcaagaagactgggttgaatagggttctaatatcttaactatgataccatattccgcagggatgatagagaccatcaagggagaacttcctccagttgaatccccttgtcagtaattcacctgtccctttccccaatcagatgaagacctgctgtctttcccagaatcatcctagtctgtcctgcctcttctgatctcctttaatcttcaatatttagtcaatgggagtcttcctttcagttaaaaatcaacgactaaaccaaaaccaaatcaaaccatgtccagttaactcctatctagaaaaagaaaaaaaaaaatctccccttgaccctgcctgccttttccttttctctcctttccttcactaccagttttctgtatgagaactctgtatcattctctacatttcttcgcctatattccttccctaatctgctttagtatgaataagtctactaaaattactctcacaaaagggcacctaggacttgaggtgccagagcctatgttcttttactactagacattactaggacatttaacactcttcctttctgaagctctcgctttacctgttttttctagtgccacttccccttggttttctcagacttctcttaccactcctgctcagtatccccaccagatattcttccccagggttcgaatctcacccaaaaccaaggctttcactactacctacccagaagccactttccctctgaagctacattgacaccccctcaataccagcagaattaaatcttccctcttctatacatccccagtaccttgaattaatccctaccttctaaagatattaagaggatcaattgagttaataagtacaaagtatttataatgatgctgacacataataggcactcagtagaagttagctacattattgttattgttgctgctattactaatcataacttagatcatatatatcatagtattatggatatctatatatctatatttctccactcatttatatagtcttcacatgtgttcatttatatatttatttaattttaaacagatctgcatttaaatattcttttatttttaaataattgtgtattgaggccaggcgtggtggctcatgcactttgggaggccaaggcagatggatcacttgaggtcaggagttccagaccagcctggcccacatggtgaaaccccgcctctactgaaaatacaaaaattagttgtgcatgatggtacatgcctgtagtcccagctactcaggaggctgagacatgagaatcacttgaacccaggaggtggaggctgcagtgagctgacatcgcatcacttcactccaacctgggtgacagagcgaaactctatctcaaaaaaaaaaaaacaacaacaacaacaacaaaaaagtatattgagaacctactacattctaggctctgggataaagtgaataagacatggaccttgatttccaggagccaatcagctattggggataacctatggatagacaagcaatgacagtagagtaataaggaagaactatgatgaggattctgtagtaggacataggagacctatctccagtctggtggtcaggaaagtatttctatttctagattgatagctgaaaaaagagtaggatcttggaaagccaagtggggaggcaaggggttgggtgatagatgcattttaaaccaaggcacagaatgtttaaaagtttggaggtgagagtatggtatatttgtggaaccataactggatcagcacagttggaccacaaacttcagggaaggaattaacaagagatgcaactagatggggatcagggatccatgctaggctttatattgagaggaatagggagtccctaaaaggatttcagcaggagaaatatttgtcctttagaaagattatgttgtccaattatagagaatagattggagaaagaccagtccagagccagagaaagtagtcatgggactgttgtatcaatccagatagcagagaagctgagatggagtccaaagatatttaggagctaaagttgattaaacttggtgactcattagatgcagataatgaggaagaaaagggaattgttatggacttcaaggtgtctggtttgaacagcagaatggatagggtgccattcagtgagaaagaaaatgtaagaaaaggagatagtttgtgagagaaggtgataagtatagatttggagtctgaggtgtgtatagaatatctacctagagatgttaagtgagcagacgggtgtagaagtttggccctcaaaagagagatctgagctagctgtcaacatttgggagacatcagaacaaagatggcaaatgaagaatttagagggtgtgaactcacccagggaggatgtgatgagaagagaaggctgcagacagagctcaaagtagcagcaaagtccaagggatgagccaagaaagaaaagtttaccaaggagcttgagaaagcctgttcagggaggggagaagaaatctagagaatgtgttatcctggaggcaaagggtcaaatgctattaatataagggtcaaaatatggtccctttgttatggaatagtgggacaagaccagatggcagggtgttgaggagtgaatggaaggcgaggaaactgaagcacaagggtcttatagataactcttccctgaaacttggttccagatgggaggagagacagggtagtttcgggggtgggggtgggtactgaggagcttaaggacatttgagaattttataaaaaggaatacagagacttaaatatttaagggaagactctatagaaatgccatgaagtcctttccaatagaaaatgtggggataaaacatctgagagagaatgattaatggagacttagaagaagcaggaagcattgggattcaaaccttgggctggcttggccttaggtagaatggctaccaccttcatggggggccaggaaagcagaggataacgttgcaaataaaattaagtttgtagttatgagtaggaagttgaaggatgtcctgtcctatatcacagagtctattcattttcatagctccagctccaagcttagcatgtacaatagatacttaagaactatttaattaaattaaattgtaggtagatgaagggaatataaggtgggaaacatactcattagggccaggaaaagaggattggggccggtatttgaaggtgtaccttttgtggcttttgccaagctaagcaaattttaatccctttgctgtgtgagacattgtgctaaatgccataagagacggaaaggactaattccaggctgaagacttttaaacaataaaaaggcatggatagcttttgaagaaaagggttctgtgatcaaagtcctttcagatgattaaattttttagtgatttcctgatttaaccttgttagaggtagactctgacagttggtgagaacagtctccaatttatgtgtgaggcctttgcacctttctgtcaacccctgtgtatctcagaatatatttgtttcatgtggacaaaggtgtttcgacgtccattttaatgtaatctcttcctgaatgtccaaagttgcttaactatgaacttatgaagtgcaggagtggtatcttattcacctttgtaactctatagtagttgatacaaggaggcaaatctggcgtgaaggaaaagccttttattttgactgagaagatctggatttgaacactgccattaactatgtggcctctcccattccccagactagtcctgtgttatttgtacctttcccctatgtcctgctccactcatctgctgggtgtgattctagctgagccctgaaaaagtcatgagcctcactcctgcagcatgaactattgttgttgttagttcttgtaattgtagggggctgggctgtaggattggaggtatgaagatgcccatccaataaggtttgtggacatttgggcaggtgagggagtacagctggggtcatttttaggaattctgtcttgggctttaaaatggctagtcttggctgggcatagtggctcatgactgtaatcccagcactttgggaggccaaggtgggaggattgcttgaggccaggagttttagaccagcctgggcaatgtagtgagactctgtttctatttaaaaaaatacatacatatatatatatatatatatatatatatatatatatatatatatttaaattagccagacatggtggtacatacctgtcatttcagctactggggaggctaaggcaagagggtcatttaggacaagagcatcacttgagcccaggagttggaggctgcagtgagttatgatcacaccactgcactccagcctgggtgacaaaataagacctcatctctaaataaataaataattaattaaattggctagttttgagtctgcatatttttcagggacaaattataaaatgtttgtccctgaaggagttttgaaatagctgcaacaatcactaccttgtgttatgtaatgcattgttcacctaagagcaggggattggattagttgaccttctgcagtcctttccagttccacaactgcactaaattgggtacatgctgtgctggcttccccaagccctgaagtaggccactcctttccccaatccagctttgggcactgaggagagggttagaagggttttaggccatctggctgttggaggagctaaagagcagcttgaaaaccatttagccatgtgttttcctacatgcgtgaaagtatttggtatgcatttatgaaaacatccttttgttttgccttaaatctgaagaagcaggaggggaggttgaataaatactccaaactgtccactgaagtaataggtcttattaggttaaataacttaggagactttctctgggcatctggtatttgcaggcatgtgatgccaacaaacaaatcaaccaagcaagagaaccatggcaactaaatgcggcacacaattggcagcatagtcagcaccctgttgggctcattggcagctggggtaggtgggaatagtcagtggaaacttccatcaggagccaagacagagggtagcagctggaagaggggggtcagtcagtggagtccgacatgtcaggagtcaaaagaggtgtagacatctggactattctataaagatgggggcctgagcctgccccgtggaaggaatagggagagctttggctcaggagtccagagatctgagttctgatcccagcaatgctaccagatcactgactgaccttgggcaagtcacctttgtcccccgattcctacctcccaggctttgttaactaaaataaggactgaactttgtgacctccacagtcctgtgtaaagctaacataaaaacaaacaaaaagcttcaggcacaagatcagaataaactccaggagtaggagttcaaggaaaggaataggacaaccgtgggtggcaagacaggggtagggaaagataggacctctgtcccagaaatcagagtttaccattgcttctgtaaccagttactgcaaacttagtggctaaaacaacacaaatttattcttttatgattatatatctgcagatgagaagtccaaaatgggttttattgggctaaaatcaaggtgttggcagagctgcattccttctggaggctctgggggagaattgtttccttgtcttttccagttactggaagctgcctacactcacgggctcatggccccttcctccatcttcaaaaccagctgagtagcatcttccaagctcttcctaactcagattctcctgcatccctctgataaggacctttgttattacatgggatccacctggacagcccagaagaatctcatctcaagattcttaatcatagatacacagtcccttttgccatataaagtagcatatttccaggtcccagagattaggacgtggacatctcagcaggggcacattattctgcctactacacccaccaaacaaagccctcccacggtgtcctccatctcagagaatggcaccctcctccacccagctccccaaatcagaacctcatcagccatccacagcaactgatgtcctttattctctaccccacatccaatccatcttcaagttccaactattttatctcataaatacatcactaatatattctctcctcatcatctcatcataatctcagtcaccaccatctctcctggagtcttctatctgttctctcaattgttctctgctcagtctcctccgagatcatcctccacaaatacagccagagattttaaaaccaaaatctggtccatgttgcacccctgatgaaaactctttaatggcttccagatactcttaggctaaagggaaaactctatgaggcttacaaagccctgcatgatgggactctgaggatgccttcggcttcaccttctgccccttcctttcacatactaagctccacctccccactggataactgtcagttctctaaaaaggccacattttctggcacctcagggcctttgcgcacgctactctaactttttagaatgtctttggccatcccttttcctctctgcctttggacctcagttaaaggattaattcctcgggaagggattccccaactcacctccaattggactagattccactgtcaaatactcttcagagtattccctccttttctgtcataatatttaccataggtttaaattgaatgtttttgtgatcatttgtttaaaatctgtctttcctactataaaaacgtataaagttatagaactataaaaatgtttgacttttataaactctatgaaggcagggagtgggtgtatctattttactcttttacgcaccattgcaattctgatgcctaggataatataggcacttgatattcattgaataaataaaggaatgaataaaggaatgaatacaaggtggaggtgtagtataaagaagtggcttaaaagtcacgatctagagacagacatattaaactttaaatcatgatgctgtgtgatattaggcaagatatttaaactctctgaggctcagtgtcctcacctataaaatgaggatcttaatatctaccttaaaaacttgtgaggattaatgtagggacttacagtgcttgaatgtattaagggaaacagtacaggaaagccttattatgattatcatcaccactgcaaacaaatgctggctgaactccatgagtgccgtgacttccttctcctgcttctaggacgcctaatggcgagaagccaatcccatgacacttgtggatggctcagaaatgacagtagttgatttctgtcacttgtctggaatggggcttttggtcatagattctcaagatttcaaagacatcaagatcaccaaggagcacacgttaaagtccagattcccaagtttcacctccagaactcagattcattgaggctgaggtgatatttggaaatctgcctcttattaagaccctaggtgattctgatgcagagactccaaggactacactttggaaattctagtacagtcatcccttggtatccacagggtattggttccaggactactcacagataccaaaatttgcagatgctcaagtcccttatataaaatttcatagtatttgcaataacctatgcacatcctctcatatactttaaatcatctttaaattagttataatactgaatgcaatgtaaatactatgtaaattgctattatgttagagttttatttgtattgtttttattgtttattttttattgttgttttttgaatatttttgatccaaaattggttgactccatggatgtgtaaccatgaatatgaaccatggtcatggagggctgactatatacaattcctcaaattctgactcagccatcaactttttccctaactccccagacagaatttgtgcttcatcctctcttcttctgtaatattttgcccatatctcagcagtcgctcctatcatacatctatctccaaactagcttgtgagttccttcagtacagggactgtatttgatccaggtagccagaaactttctaacacagtgcctggcatgtagaaagtaaaacctcattcttgatttctgcacccataacctcctgtctctgctgtgttctcccattgcagtaactaataacatcatttacccagttgttctgataaaacaccttgaggtcatccttgacttctgtctctcacaagccacatgcaatccatcagcaagtcttgtttgccttacctacaaaaatgtccagactccaaccactactcatcacgttctgctacatgtgctggcccagtacactgcagtctctttcctatactgcctaatctctctgcttccattcttgtccctacacagactattctctacacagcagctatgatgaactttttgttttaggatgaacttttaatacacgttatactatgtctctgctgtacaaagtggtttttcattttacttagaaatgctccatttcacttagacgaggcgtggtggctcacacctgtaatcccagcactttgggaggctgaggcgggtgtatcacctgaggtcaggagtttgagaccagcctggccaacatggtgaaaagtcatctctactaaaaatacaaaaattagctgggtgtggtggtgcatgcctgcaatcccagctacttgggaggttgaggtaggagaattgcttgaacccaggaggcggaggttgcagtgggtcctgagattgcatcactgcactccagcctaggagacagagcgagactccatctcaaaaaaaaaaagaaaaatgctccagtgatgtcccatttcacttagaagaaaattcaagttcttaccgtagcccatagggcctcccttgttctacacacctaccatccacctcatctcttctttcttcccgtactgtttttcttactgttccttagatacatcaagactactcctgcctcagagccagagagctgtgtgatttggttcctcaattcatctaggtctctgagcacacccatgtcagagaaatctaaagtaactaccctctcgcatcaccctctgtaattgaaatgaacatctttcttaagcaaagaaagttattgctaaggaatgacagtgggtcaaagtgggcaagacttggccagaactatttctcctactctgttgacttcttttgggtccaggacaagtgtttctaccattctattgtgatctgtgtacatgtaatgttgagttaatgagctgctaaaaccttctagattgaaaataagtgagtcagcctcaggaccaggaggaatggtagcaatcactcttggtatcatctgtttgtttttcttgcttagcaactctgcctttgatgaccctgaatacagacatagtttaaatatttgttttcacaggacttcttgggcctactttatatgctgaagtcggagacatcataaaagttcactttaaaaataaggcagataagcccttgagcatccatcctcaaggaattaggtacagtaaattatcagaaggtaagataaatctaatatttttctgaaaagggaaaatgtctaagtctttaataccagcatcaacatttaaaactatactgttaaccacgtgttgttagggaaatctcttgcaactggtaattataaaaattgttgctgttgtaagttttgagagaagaaaaggaaaaggttttggagtcctctagacctgcatttttcactgggttcttactctttaatgtttgggagggcaagttatctaatttctctgaattctcatatgttcatcttaaaatgggaataataatacatacattgaaagatggtttaaggcgggggtcagtaaatttttccgtaaagggccagatagtaagtttgtttggctttgcaggccataagatctctgttgcaagtactcaactctgccttttagtacaaaagcagccatagacgatacctatttttttggctttggttacagatgccagaactaattaactttgttaccgtattctttccctcaagtcatacaccagagtaagaccgcctctgacaatacaattttatttacaaaaacaggaaattggttgggtttggcccatgagccactgacatagtgacatagaactagcctgatataggcttcctggcacatagatgacactcaataagtggtatttggtggtggtgagactagaagcattaatagtattagacttttggacatagtgaagtggttaagaaagtaagctttaaaggcagacaagttaaaattctagctttatcatttctgattctacgactttagcatctctgagcctcagttttctcatctataaaatggaaatgattataaccacccataagattgcctgaaatttaaatgaagtcacttaggtagagtactaaacatggttcctgggatcggataagctctctataaataatgatgacaatgatggcaataatcataaagataatagtcatgcaagttattgtatcagccgctgaatagtaagtacctgatgttaatatggttctaattatcccattatgctgatgttcagatcattgtaagcatagtagagttccatcaggcactggtataaaaaattgtatccatattataatagttgttggtatgagaacattttaaaataatttcagacttttcatggttcacatttaaatatctttccttctacatgttccagccatcatacctttgagagaataattgagtaggagagtggtttatgtgcaggttttagaactagactaataagtgcaaatcctggctcagtgacttttatgaagttatttaacctctgtgtgcctcatctttctcatctgtaaaatggtaataataatcatgtctctgtcatacaggtttgttgtcgtgaaatcttagaataatgactggcatataacagataataaatattagccatgatagtaaagataattcttcaattaaaatgtgttcaaataatttagtatttatcttaaaacttgttagtttcagaaaaaatcagaaagtaatttttaaatttattgttttctatataaactgttgtcaaactcatacccactaaggtataagtgactgataataggtcaatgaactaccttccttaggagtacttgcattagcacttaatctttggcttgaggaaaaacaatgaagcattaactgtggcactgagatttcttccaaagtgaatttggcaagactctgggtgaggtagtgggaacaggagtttctcctatgttcttaaaatcatacagtgacatagtgaacaaccacttcacctacttatgaggcttctagacgactgcatcagaagttcagcaatgtaaagaagaagggggagaaacctcaaaatatcaaaatgtcacatgcaggtttcatttcaaataagggaggaggtaagaattgtagactttggaccctacctgggctgtttgcacagtgaatgaaccttgcaacactatccctcttcctttactgtttatttgtccctacattccctacagccagcaattatttatgagcaattgcttaaaatgctcccacagctttcactggagacatgattattggcatataatattgcctctggtcctatgaatctaagaaaggtaaatacatattggtagggaaagtaaaattttaccttggaaatgagatgcaaacctagtaagcagatagtatcttttatggtaaaagacaagccttataagttgattttattatgccctctgcattaaaataaaacatctcctcctccatgtctgacactcaccctcacctatagcctccctctgtggtttgagctatttttttgggagtggggataaactaactgcatgctgagccagttacatgagaatccagattcctctatctcagaggtagatatttgagagataggtggtagggggttaagatagtattacactggcttgagaaaccacaacagaacataagagaactctggataaccctttttgacagaatggacaaacggtgatttgtaaaaatgcttgtaaggacatttcctttaataatgtatttaataagactgtcttagatcagggaataaagtatctgcaactgtaactaatcacttaaaagctgtcactaaagggtttcaatttgaggttaaattttcagaaactctgtaactagcatgcatcaaattgacttcaatgctgcacctttgagcaaagtttgttgttcagtaaaattttcaaagtcgttttggtcaattacctttaaaaagcttgtttcatggagaatttaatattattcttttcttttagttatattctcatattttaaatatatgagttgcatatgaatgtgatgtcacaaaattagttctataatatatagccatctgctggtaagccagctctccaaataaaacacgttttctgccagacattgttcgttgtatctaagtgttgccaaattctctatacaaaaatttgctcttctagatttttccaaaacattccaatgcttgacttaatgtaggtgattacattttttcacttctcatctgaatattttggccttatgtagagacttccttgagtatatgataaacacctgaaacaaactataacggctatagtttgtatatttaataaatcacaaaaatgtggatcccttttccaaagagacttgcaagtcctgtgcaatgaaatcagctctttataaaacgtcagcattgattcgcccattgcctacattatagcttctaaaagaatattctgaatctttgaatgtagtgaagcattcactaagtttattaacttaggagaggaaaagagttgttcacaaaaataagtaacaagggaagagttactgagtgagcaccctaatgagtaaccaaaaaggctctttatgtaacttcactttcccaaagcttgtatgcaccatttttcatttttaaaaaatactgagagcctttggcaagtaattagtacatcatgacaagaataaatacaatacaaagctgactatcgactgagcaggaaatgaacagaactgagtaaatataaatgaagagctacccttgtgtaaagattttattccagcaagcagctgaacaaggacttcttgtgctctagcacaatagttgtccctgtccatttctcttcttttcagtttagagcttaattttttttattttgattacaaagtcaaaatcacattcaccaaaactgcatctcacaaatgcttcctcttaatagctgtttgtattttatactttatattaatgtatgttgtaaaatcaaagatacaacaaacctgttttattctagactaaaggtaaaataatttgaagtgaaaagaataaaagcattgataaaattacaccccaattgtctcattagccatctcactcagtgtaattatagaatatatcctatgtacaagtctatatcattcactgtttcaagatgctcataattcaacttttagtagtatactaaacttaattaacatcattcatttaattatttgaaattcatcttatatgtaactgacaggcgaatgtgaaattctgagtaatttagtttgatcaattagacagacattaatttgtgtgactagagtaacctttcattatctatctcaaaatatcatgtacacaagtatatacaataattttttaagcccagtatgtgttaaaataaatctaggtgtgaaacattgattgtttacagataggttcaatattgttagaaaatcagtcaccctgctatacctagcacaagtgttatagcatcttgggcaatttttagatacttacattggttggttctcattccagattgacagtgtgttctaattgtagccctagaagaaatctagaggtcaaacctatcacaattagggcaccaacatgtaccctagagttaactaggcagagcccctcaggggcccaggccctgtcttctttacatttgtactctggcatttagcacagagcctggaacctagtggatgatgatggtcatgatcatgatgatattaatcattactgaactaaactgaggggccgaggactgattagaaagtaaggactatgcattatttttcccttgctttaaaattattgattttgctgataattttgagcaggtactttgtcttacttattaccaaaaaaaaaaaaaaaaagtacttttaccaaaaaagtcttatttactttcatcgcctttggaatagatacatcactacaatggattggaagtttgtgtcctccaaaaattcacatactgaaatctaacctccagtgtgatggcattagcaggtggggcctttgggagatttttttttattatactttaagttttagggtacatgtgcacattgtgcaggttagttacatatgtatacatgtgccatgctggtgcgctgcacccactaactcgtcatctagcattaggtatatctcccaatgctatccctcccccctcctttgggagatttttaggtaatgaggatggagccctcatgatgagattagtgcccttataaaagggaccctctcactcaccctctttctaccatgtgaggatacaaggagaagatggcagtctacaacctggaagagaccctgcaccagaacccaaccatgctggcaccctgattttaaacttccagcctccagaactgtgaggaagaagtgtccgttgtttataagccactcaatccagggtactttgttaacagcaacccaaactaagaaaatcaccaatttctatcttactcacatgtgttaccagaactcaagcacacttaagatctatcttatctaaagtagaacataaaggaaagaggctgtattaattgcaacatgactgggaaagaaaatacttaaccaaaatgtgaacatgtattcccacaggctatcagagcatttgttaggagccagaaattttacaaatattttccagtcttcataacccatcaaaaaggataaagttatctctagaaaaaggattatattatcttaaattataaatgaaaaaactgaggttaaagggacttcaagaaaccttcccaagttcccacagttagcaaatgatacaaccaccaagatattttcaactctgaccctgaagttcaagtgctttctcccactatctagcagaaaaaagtatcgttaaccatatagtctcacaaatactgaattacaaatggcgatgagtgctgtcaaaaaaccaacaacaaacaaacaggtatcacaatcagagatcaagaagggtgtaagatgatatttgatctgacatctgaagaatgagcacacatttacccagaaaaataaagggaggaagaacttcaaaagttatctcctaccctgcaaagaatataatgttttgcccttaggggagcttgtgaaggcagtggaaagaatatcattttctactatagaaaccccatgtgatgttttaacagttgaaacagtggaagctgcctgtccagaaacatcatttttcaactttatgaggccatgtagcaagaagcattgaagaagggctgtcatgcttgattcaaggtagatggtgcagctcatcaactagccatgctaatttcagttaatagacaagttctgacctgagagggcaactctccttatcagtcctgtttgtgctttgttaccaaagctcttttgtaatctttcacagataatgcttcctgcttattagtggagactttctccataaactttttttcttttatagactagaattatgttataacttacaggaagtgacttaagcttttatcatttctcagctcttgacagttttattatcaaagtgaaagtacagcctagagtaaatattagttattagtgtcaagctatcctttggggtgtgttgggggaagacacaacaaagtccactttatgctagcgcaaagttcacaaactcagatgcctatagtagccagataagtagttcagtgaacaaaattggtccagtaagaactgatcatcagaaagcagaaaagggcagctaagatccagatccaacaaaattctgtgcaggagtttggtcctgttgttaaccagatctccaggtttttgttttttaaagagaaaccagtaatccaaattcttatataatttctccggatgtttaatgttggcatttaatctattttaacattacgcaatcataacaacacacagccatgagctttgacttgttgacctaggctgtagcccataggaccttaaattttaggagtttaataaatattcactgagcatcttcttcatgttcatgttccatgcttctctaggtacctatggaaggcaccagagacactaagacaaatacaatccagcacttttccttgaggaactcacacttgggtgaccaaaatgtgcaggacacaaatacttatgatctagtagaagaaaatgaattagtcacataatctcacaggcatttaattacaaattgtgatgggtgctgtaaaagaaaaaaatgtgtatcagaattggagataaaggtagaagtgaacagatattcaaggtgatgtctgaatgatgagcacatatttatcaaaaggaagacgggaggaagagcactctaggcagagggaatggcatctgcaaagaccctgaggtaggacagaacttggatgtctggggaactgacaggggacccaagggacaaggagcccatagtaaacaagagaaaagacgtatgataagactgaagagagaagtagaggtaaatcatacatggacttgtggtccacgttaaggactttatgcaagaagtaaatctagatatacctactcaacttatggtttccatgctcagaacctcatgagatacattgcacgttactgtagtacctgaatccttcattgctattgaatggatgtgccttattttccactcccacctggagaatccaaacatatgctgatgccatgcaaactcatgcaaagcgttttgagtggaatagattttccacagttgggatggggaaaggtacaattaaagaagggaagctgacattgctgtaatgtaaaaaaatattttatatggaaatttagcatctcagactttggcttcagaacataaggaaccagatttaccctttttctcaacaactagacaggcagacaaaacatataaaacagaagttttcagacatcgaatgacagacaactcaagacagtaaaagaagagtaacaaaccagatgtgccctatgagcacctaagcttactgcttgaagagtgtttccagggaacagcacaagcagggagaacccagacagagtctctatgggttgaggaaatagagtttggacttcggagaagctcaaatggctagaatttgtgattttagggcagagtcctgcagaggacagtataatcacagagaaagagctctagagaatctacagagaggttttgtcaagttgaatactgatctgcacatacatgtgaggaaagtactgagggtaagaaaaatgtcacttgaaaggaacaggtggaacagtccctggaccttactcagggccggtaatcgtttatgttcctaccatcaaacatagaaagacctcctaataaatgagcactggatagaattgtcagaaggatttagaaacagtgggtggataaaattagactacaggctgctgaggaggcaacagaataaaaaacaagatttgatttcaagtatcttaactgtgaataaaactcaatactagttaacaagaatgcaacaaacaacaatgtaaattcacaatgttaataaaaataaacaagcattagaagaagcagaaagagatgactcataaccaagaaaaaactcaacagattgagaagtgaaagagagaatagaagcagcaggcagagacagtaagacagctatcataaatcttctcaatatgttccagaaagcagagaaaagcatgagcatgatgaagatagagaatataaatatgcatacacagaacttctgtagatgaatacaattgttgacatgaaaagtaaaaaataaagcatagaaaagaaaggtaaaaaataaaggataaaaaaatatattataaactgaaggataccactaatacaacaaacactggatgaaattaatagcacattagacactgtgaaaggaaatagtagaaaatattaatacattgcaatagaaactgcaaagtgaaatacagagattaaaaaggctgaagaaagtgaacagagcatcagtgaactgtgggaccatatcaagtgatctaacatatgtgtaattggatcccagaagtagcaggaacagaaaaagtatttgaagaaataatgactgaaaaattcccaaatgtaatgtaaactacaaaccaacagattcaagatgtttgacaaaactaagaagaaggaacatgaagaaaaccacaccaagccacatcactatcaagttgctggaaaccagtgataaagagaaaatattggaagcagtgagagataaaaacacacaccacatacaggggaacaaaaccaagaaatgatagcagacttatcgttagaaactatgcacaccagaagacaattagggacatctttaaagtgttgggagggtagaagataggggaatctgtctgtttagtattctataccaagtcaaaaagtcttttttaaatgaaggcaaaataaagagtgttttagacatacaaatgcagaaagaatttctcactaacagagcagaaaaaaatgttaaaggaactcctttagatagaagaaatattatgtcagagagacatttagattcataagaaggaatgaaaagttccagaagttgataaatatagagaaattttttcctcgttttaatctattaaaaaggcaattgattatctaaatgttaaagcaaaatagtaacaatttattgtggggtatattatgtatatataaataaaatgtatgacaatagcacaaaggctgggagggaagaaatggaaatatattattgcaaggttcttacaagtgaaatagtataatattatttgaaggaagtttgtgacaagttaaaaatgtactatatattgtaaacggaagggcaccactaagaaaacaaagctaagaaggcaacaatggagattaaacatcactaactatactcaatccaaaagaaaacagaaaggaaggggaaaaggaataaagaccagatagacaaatagaaaataaatataaagatggcagttttaaattcaaccatatcatcaattacattaaaagtaaatggaaagaacactacaattaagaaacaaataagattgaataaaaaagcaatgctaaactgtatgcagaatttaagaaatccactttaatgagagagacaaagataggtaaaaaataaaggatagaaaattatataccataccagctaacactaatccaacacaaaagggtgtgtaatgatgattccattgatatgacattacagaaaagccaaattatagtgaaataaagcagattagtggttgtctgggcccagagggcattggctacaaatggcatgaagaaatgttttggaatgatggaactcttctctatcttgattggaactatagctataagactgggtaattgttttaatcaaagctcagcaaatattatacttaaaagtggtaaatgttattatatgcaaattatacctcaatgaggataatgaaaggaagaaagagagggaaggagggtggggaatagggaaggaagaagacaaagaaaggaagaaaggagaaaagaaaagaaactaggaaaggaaaaagaaaagaaagggaagagaaaggaaggggagggaaaggattaatcatttcagttttcaaaaagtgtagttgcttcagtaagaggagttttattggccttttaccccatcatgtaaaacatttcaggcttttttccccagatccttgttgtctgcctacatccacactgatgttctcaccttcttctcgtaaagaatttatcaagttattgtaccaaacaaaaataactgcatcccaaagagaaattctgtcaccagctgatgatagggaatctttcacctaattaaatgaggaattcctcaggcagaggaaactgttcattccacttggctctctatggcactcacctctccccttcctgacctcacttgctccattttattattgaaaacctcacccaaccctctacacttcttttaatattgagtatctcagttccttctcttcaataaagaagaccaatttcttcatcctctccctctcctatcagtagggaaagtccaatatacatggaggtgttaatgatgtgtctttgggtgcacaaagtacaaagtaagacatctaagtttcaggggatggacacatttcatattcatacagacaaccagcctgcataggggagttagacgctgtggctcgggggaaaaaattgagataatcagatggctaagatgaaataaagagataaaacaaagctgaggatcacagcagttggaaagaagatctgaaatagcaaaacaaaataatacataaacagctctgactatcctcccatctcatgttaataggctaagtatgtcttattaaacaccacaaagaagatatcacccattcttatattctgagatggtttactaatcaaaggcgattcaattctctgattatatttaaataataattgttcaggtaccctggaaaattaacttgctaaactttaatttacaaataacatttgttattcttaagatcaccatgttatcaaagcctttgtaagtacatgagcatagaaatgggcatatgtgaatctttccaaataataaaagttcactattgaaggacatatgcatctccagagaactcatcttagctatccccagatttgagagtggtgaaaacgcaatcctcagaaactgcccacatgtcttgatggctgttactcctccaggtgcttcttaccttgaccacacattccctgcggagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaaggtaagaacacccccaccaaaagattcaacaactaaatgttggaatggtcaggagttctgtcatgggacaaagcttgggagcatcttggtaacttcttgtacatcaagcagaggaagacggcacggagaccagatcattgtttgacaagagaaaaaaacacctgctatttcagggtgtggatccacctctgtttcttctcattcctccttcatctcagtccttaaggttctcccaggcaaattcctgtttgagagtatgttctgatgtcatgcttgtatgatctgtaacatttacctcaaggccaaagtcttttagaaagtatacagtagcctatactctgctgaaagagctcttggaaagaactttggctaacatgtttgacatatctgaggtttgggctggtaatttgctctataaacacgtgaaatgccagcttcctttcttacaaacaagttgaaaactttgggtggtaggtttcaaacacactcaagtgactttacaagaacttttattggctgggcttcttaggagcaagcttggattttcattttatcccatgagaatccagcccatctttcattaaaacaaacaaccacagtgagccacagcatgggaaataacgtgatggactcaccatctgcctatacatacacgctcaggccatacctacatacatgcccaatgtatttactcattatacaaagactttttttccatttcctggtatatataagatactgtgatggtactgaaaaaaaccttaaaacttacaaaagactcttcttgcattttaccatcagcagcatgtttttctcatagtgagaatggattaatgctgatacttccacccaattatctaatgccccctttcatatacaaataagatgacagcattaaacttggggcatgatgcttttaccaactgagctaacgtatctatatactcttctattgagactgggggaaatggatacttgtacagagtcttgagagtcaccaaatgttttcttcccaagctggatgaaataaagcctgttccccaaagcaagaaggtatcaaagaagacagtgtggcaccagattttaaataaccctagaaccattattacttgataaatatgctattttaaaaaataagaatttcttcaagttgaaatcattatggttgattgcttgccctaaactctttgctatccaggaaagctaatgagcgtcttctatctgcagtgctactgaaaacatgtctttcctttcatagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccaggtaacacgagggctgtgtaccattaaacaacagtaaaatcattagtaatttttcggtcctgttttcttcaaagcactagagaagttgaccatactcactgttttgcaactccctatcaagaaggaaatattttctctttttttttttaaacaggaaatagaagagacaaattagaagctagagaagaaatgtgcagccttgttaggtatagtgacctgagtaggtttcaccttggcctgtactttgaataagaccttaaggtatcagctcagccactctctccgagttctgcagttcctctatatgatgaccatggcttcttcaaggacaagccctagcaggaaggatcagcaggaagattgcagtaaagatgaacagattaggagtaatcctcaacacacaaaaaaaaccagcatttcaaaaggtgacagaagagtaatattcagtggcatctagaatattttctctttccatttgcatttgggcacttatgagaaggcaaaatcatagcaatcgttaagagaaaaaataactaattcccacttagaccacatctcttctatttctctctggtagaactgacctacaactaaagatccagggtatatgatactagcctgagggaaaaacattaaaaaattaaaatgccactttactaaataaaccatatttcaaaacactaaacttcttagaggttattctctaatgccatctgaaaatcacaaatagcttcacttactaaaacacaaatattgttaagagttgagatctgggtagtgtttttaaattgtattctatttcatttgactacattttccacttggttttctgaaaatatactcatatgactctcaatgttgatcccaagttccaatactaggagcttgtaaaaactggggcttagttaactgacctcgaccttagataatctgagttcagacttcagattatcagactaccttctgtggccctggataaattagttgtctcaatgtgcttacttacaaaagtggactaaccatttatcctaacatctatttcctggcagagtgaacaatctgtataagtatatggatgccaagaaaagcaaaaccatatgcacaaaaataaaaataaattgatctgagcttagagtttacgaatttatagttcccaaaagaataattgggggtaaatgggacaaggtagggaaagaccatcagtagaaactaagaatagtaaacatttgtaaaaaccctctgccttataaagcagaataaattgaatacatatgataaatgctaacacagatatgttaattgctgaactcaatataagcatttctttggcatggataaacgcttccaccaaagcctcctagtgatgcaaggaatcctggctttgttgcaatggtctcctaaaaaaaacaagcctttgtgtgggtaaggaactgattctcaggcccattatctagtatctagtgattatgtatctgagatgtaaaacagaaacctaaaagccaaggatggagtctccccacagagcaaatgagcattttcccagtgactgtaggagcaaagaaggagcaaaactaagtttttatattcagttatcactactccttccatgaaaagctcccaatggctcagcataatgaggacttgtacactgcattttaaggagagtgtgtaaccccaaagtgatttcgttgacttgtcattaaaacaatcaaaaagtaagtaaaaataacaattgaaaatcctcatatcatcttcacatcttcttcccttaggcagagcttcgaccactacagctagagagctgagaggattaagtgcttgaactcagccctattggcggttctggtgatttgactccctccagctgagatcagactggggtgaccaaacattccattttgccgtggactttttaccagttctaatagttaaagtcctgaatcttgggaaacccctcagaccagaacagtcggttaccttcttggttcccttcttggcctaatcctttagcaatccctgtgtttttgagttcacatccaccatctctaagctctgttgttacctgtataatgccatttatcacaatgagttgtcactgcttgtttgctggtcactcagatgtctgcttttgcagggcacaaactacaactggagtgtctgttccctcaaagctttatacaatgcctgacacacagcaggtgctcaatacacttggtgagtgaatgtttgatcacagagtacttgactgaatgcttattttggcctgtgtctctccctctttctcagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaaggcaagaaactctcctgacagtcttgcttctcaatgcagaatcctttcttcccatgcactaactccctctttctcccttgccctttcaagccacctgcaccgcagacaaactttcctcagttcctaacaaccaaacttagatattttgctcttagatttataacttgctctttggggatggagaaagcgaaggaattggcaaaggttttttttttttttttttttttttttttaattaagcaaaagctaaagagatctctaacttcctcgaaagaagaaaagaggaagaaaacaaatgcatacatagagatattctttcttcgggttacttcatatgcaaaaaagacctagatgctagcacaagacaaactgcaaatttacagaagcactaagttgtagaaagtgtaaaagtttagcatgaaaacattaacctttacagtgggatgaacacaaagtctagcacagagaggaactcaatgaatgtgtgttgaatggatcatacatggcatatactgaggggtgagctccaaagaacactggggaattcaggtgggaaaataaatcaacccacgttatgtggtatcgtgtaaacaaaataactgattgttctactacacatttttgctttaaaactgttgagattagagttcatataaatggagactaaaatctaaggaaatgatatcacaataggaaatcattttgttaccaaaataatgtataagcaacacatataaggaagagatacttcatgagatcatttctgtttcttttcacacgagtagtcaaaattatatttgaagtaataaaaccatcatgatatccgtggaagatagagttcccaataatattaaaacaacaatgtaacttttgtttctttgttgaggataagtgcattatgtattgttattaatatttaatttttaacaacaattttattaggtactggtgctacttcattttatagattaagggacagatgacagaaaaatgagaatttaacaagacttaattcataaggtcttaagaagttaaaaattattagaaatttgcctgctcaagaagaaataaagggaatctttccaaattttttccctaacccctcctccttttcccccttttaaaattcttgccttttctggatgccacttaaagagttccaaactaaaatgttcaaaaattgcctgagcattactttcactcttattatattaatataaaccttccacaagttgatttaaaggatatgcatttcaatcaaccataatttcttctcttgagttatttcattgtctttctgtcctaactcagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaagtgagttgttggggttcataccactgggcaaaggttcaagacacattccatagggtcctagatgtttggggtgaaatgtaagttcacagctctcaaggggacacatgtattggtttctattcaagtctttttgtaaaaattaatcttgaattacccccaaatcaccaaagaaattcagcctaataataataaaaatgacaacagcagctaccttttgttgaatgtttgccattgccaagcactgtattgtccctttctgagagcttcgcttcaactctacaaactagatactgctcttatttctttttatagatgaggaaatgggtctgagagattaagagatttggaaattcaaatagctcttaaacccttgaaaagttactcaaattcactcataataacagaaatgcaaattaaacttcatgggaatactacttttatctatcacattcacaagtccagatgacatcatctgttgacaaggctgtgagaaaaaagaactatcatatattgttcgtggaagattaaattggtaaaaggattctgaagaataacttggcaatatgtatcaaaattctaaatgcatataccctttgactcagctatctcactctggaaatctaactatacagatacacttgttcacaggtgaaatgatgtatgtacaacatattcactgttgcaacgttagtagtagtaagactggaaacaacccaaaatgtccatcagtagaaaactagtttaataaattaggatacattcatacaatggaatactaagcatcaaaaaaagaggatgcaaacactctgtatgtactaatacaaaaagttctccaagatatgttattaaattaaaaagctgggatgtagtatagcgtgtatacatagctgccttttgttaaaggagtgaaagggataagaatatttatattttcttatttgtaagacataaaggtattctggaattacacgcatgaaattaatatatggctacctagaaaattcagggagggtagggaggtcattttgagagtcatcagagaaaagtgagagttttcactgtaataaaaattatgtgaatgtattttctattaaaaacaattaaactaggaaaaagaacaaaaaaaatttggccaagattatagaattgttgacagaactgagataggaatccaggagtgtttggcaacagtcagtgctttccactgggaaaaataaattcataaaatgatattccatcttaaaagattgctgggttaaatgatatttctgactttaggtcttggaggaactgccatactgtcttccacaatggctgaattaatttacattccaccaagagtgtataagtgttcctttctctccatgaccttgccagcatctcttctttcttgacttttcaatcatcgccattctgactggcatgagagggcatctcattgcgtttttctttctttttttgagacggagtctcgctctgtcgcccaggctggagtgcagtggcgcaatctctgctcactgcaagctccgcctcccaggctcacgccattctcctgcctcagcctcccgagtagctgagactacaggggcccgccaacacaaatacaaaatacaaaaaatataattttttgtatttttagtagagatggggtttcaccgtgttagccaggatggtctcgatctcctgacctcgtgatttgcccgcctcggcctcccaaagtgctgagagtacaggcgtgagccaccgcgcccggcctcattgtggttttgatttgcatttctctcatgaacactgatgttgagctttttaaaatgtgctttttggccgcatgtagttgcttttgcaaactaaggtaataaagagggcaggggaaaagtggttcatgtttctgctcccaaagtatttatcccagtagctacaaaagatgggtgaaggaggttgcttttcagtcagctcagagaattggctagatggtggaagagatagcccaatagcacagaactatgattaacaatgctagtaaatgtttcctggggttggaagttgcttttagggattaagaaatacctttaaaaccaaaaaggctatcatagaataagtgataggacagactttagaaaaattcctagtatcttttcagccagtataggccttttcccagagatatcaaatgtctgctgtagcaataagaatgacaggaagatctaagtagctgcttctaaccagttacctatgacttttatcagtgatgcaggagacaaatcagaagtttccagttttccaactagacagaaaacataaggactttgcaaactacactaagaaatttttagagaactagtatgttagctaatctaagagcagaatgtttaagcacaagggtttccccatcctaccgagatctctatttgagaaagtggtttaatttttttttacttcactttaagaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaagtaagtaacacaaatacagaatcatgggagaaattacatagtaaaatattatggagtacctggttattttttaattttaaaagaaaaagatgctcatataattttaaattcaaatgcaacttttagtttttatttagtatttgtatttatttacagcttactcagtaatacaaaggatctgagacagtttctcaagttataaaggcataaaacaaggagtctatgtaattgggatagaatatgcggacaaagaaaataaagccacagataagtagataccatgtgaccctgtaaggctgtcttcaaattttgtcctaagctttatggcagtcagtgtaaaaaaggaaatatgtcagggtgaagtttacatcatctacaaaaagaaagcaccatttatcctgatgttaagatctaagaggaacttctttaatgagttctacaaaagagagtgctgagtgatacagtagatggcatccttgataaaattcttataaccagcataatagattaaaagttgcataaaataatagattaaaagttgcattaaaatatttctcattatagctaagatataacagtaaacacaattgaatagaaacaatttttactcattttttaatgtagtctaggtatgcagctctctaatggttggactctgatgaaggtaaactccatgtatcaagagcacggagttttcctcagacaattctccttaaatgtcatgtcacttcaccaagatagataagaattggacagcagagaattaaaggttgcaatctttgacaaaatcctagagtgtagttaatctacagacaaaggatgatccaaaggctttgacaatcaaccaaatagaagataggattaaggttctcttttgcagattaaagagcctaactaggactcctgtgtgttttatgcacctgacaaggtctattctgttcatttaaaatagccaaaggacaaaagcagttttttttctccatgcctctttcccttcttccatttctgatcccttttatgtgctctcagcaagtgtagacataccttattaaaagttcaggatctggctatttgtctgtgcctctcaagcaagtagcttttccccctcaccaagggtcttactctgtcacccaggctggagtgcagtggtgtgatcatggctcactgcaacctccacttcctgggctcaggcgattctcgcacctcagcctctcaagtagctgggactacaggcacacgccccaacgcctggctaatttttgtatttttttgtagagatgaggtttcaccatgttgcccaggctggtcttgaactcctgagctcaagtgatccacctgcttcagcctcccaaagtgctggggttacaggtttgagccactgaacctagctgagaagatgacttcaaagacagtgtcctaaaaaatctaccgggcaggggaaggggatcatggtctagagatgagaagcagattcaaaatgagatgtggcccaagctgaaaagagaagggcaggggaaggaggacttgcttggagagagtgatactgtgaggaaaacgtcacttctcctaacctatcctctaaagtcagacttctctttccattttccaccttaatgtgtgagtgaaacactctctccaatgctcctgccaagtgatgaggggaggttactgctcagataaacagatctaattttcctactgtgtgtacacatgtatacacacacaccatccaaaaggtgaatatgcaaagctagtatcttatattatttgtcatgatcaaccttaaatcctagaataaatttgatttaactttgtagatcgtgttcaaaaatatggccagccgcccctatagcatttaccctcatggagtgaccttctcgccttatgaagatgaagtcaactcttctttcacctcaggtttgaatctttcacttctactgaatccaactagtaacttctgagaggctgccacatttttctgctattctccttgcccggtggtgtcactactgcagtcaggtagtatacatgtaggagtatcctaaaaatcacagccaaacccttctcacttcaggagttttgtctcttagtggtaacaaaatatggtgtcttttattagtgtcatagtggcctctagtggagcattatctaatggctacatgttatccaggttccaagtagaatatttaaagaattcaattgaacaatgagaacatttagacacaggatggggaacatcacacaccggggcctgtcggggggggggggtggggggcggggggagggatagcattaggagatatacctaatgttaatgacaagttaatgggtgcagcacaccaacatgacacatgtatacatatgtaacaaacctgcatgttgtgcacatgtaccctagaacttaaagtataatttaaaaaaaataaaaataaaagaattccttttgcaatattaattggttccagcgaaagcttatttatttatttattatcatgaaataactttgcaaatgaaaacaattttgaatatattttctttcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacaggtattttgtccttgaagtaacctttcagaaattctgagaatttcttctggctagaacatgttaggtctcctggctaaataatggggcatttccttcaagagaacagtaattgtcaagtagtcctttttagcaccagtgtgataacatttattcttttttttttttgtcttgtctatttttatcagtaccatcactgccgaaggcaagtctagagtgtgataacatattttgtcttagtttcaaattccaggtctgttggtatcggatgtgttgagcaagttgattagcctttcctaatttcttccttttatcaaatgggtaataaccctcctaaaaatgttacaggtctgtttgggggttcagtgagataccatctggtaaaagtataaagctctttaccagtctttgctatttttagagacctgcaatagggagacagaggagagattctctgaaagcaaccaaatttagagacatagttcctagtgaaattggacccagattatggcccatctctgttgagactaaagtatacagaagaatgtgaacaaagatactgaatttctgagtttgtcttcattgaagaattgtagtctcatattattaaactaaaattcccaattatgctaaactgtaaccaaagaggtcttatctcaaggcatacaaaataaacatatgcctagaaaaagcagaaatgaatttctggacatatggaagatcctgatttattgagctaggaaaggaaacaggtagtagaagcataaggcttttctattgcaaccttctctttcatcctttgcacttattcagagcatattcagtcaatcattcatgttgaaaggtgtgcaattacagagatagacagactttcagctgccatagcgaaatgagatttttcttttgggatttgttttttttttttttttcttttgagacagagtctcactctgtcacccaggctggagagcagtggcaccattttagatcactgcaacctctgcctcctgggttcaagtgattctcctgcctcagtctcttgagtagctgggattacaggcgcccgccaccacccccatgtaatttttgtattttttagtagagacagggtttcaccatgttggctaggctggtctcgaactcctgacctaaggtgttccacctgcctcagcctcccaaagtgctggtattacaggtgtgagccactgtgcccggctcttttgggatattttaatctctgaattttcttatctgttctgtttgcttttgcatattacctttagctctaacaagtgctgtgtacacaatggactctcataaatgcctgaattatatggcttcagtagttccaagaactatgtcactttggtttctgagaactcagtggtgtagataatttgctgcaatgttaatgactgaatacagcacttttttttcttttttttttactcttaagttcaggggtacttatgtgcaggatgtgcaggtttgttacataggtaaacatgtgtcatggaggtctgttgtacttactacttcatcacccaggtattaagcctagtatccattagttattttttctgatcctctccctctttccaccctccatcctctgataggccccagtatgtattgttcccttctatgtgtccatgtgttctcataatttagctttcacttgtaagtgaaaacatgcagtatgtggttttctgttcttgcgttaacttgcttagaataatggcctccagctccatccatgtccctgcaaaggacataatcttgttctttttgatggtcacatagtattctatggtgtatatgtaccatattttcttcatccagtctgtcattgatgggcatttgggttgatttcatgtctttgctattgtgaagagtgcgaaaatgaacatacgcatgcatgtgtctttataacagaatgatttatattcctttgggtacataccaagtaatggaattgctgggttcaaaggtatttctgactttaggtctttgaggactcaccatggtatcttccacaatggttgaactaatttacactcccaccaagagtgtataagtgttcctttttctccacaaccttgccaacatctgttagtttttgactttttaataatagccattcttattggtgcgagatggtatctcattgtggttttgatttgcatttctctaatgatcagtgatgttgagcgtttttttcatatgctctttggccacatgtgtgtcttcttttgaaaagtgtctgttcctgtccttggcctactttttaatggggctgtttgtttttttcttgtaaatttaagttccttataaatgctccatattagacctttgccagatgcatagtttgcaaaaattttctcccattctgaatgttgtctgtttactctcttgatagtttcttttgctgtgcaggagctctttatttcaattaaatcccatttgacaatttttgcttttgttgctattgcttttggcatgttcgtcatgaaagctttgcccatccctatgtcccaaataatattgcctaggttgtcttccagggtttttgtagtttggggttttacgtttaagtgtgttgttgttgttttttgtttgtttgtttctgttatttttgagatggagtctcgttctgttgcccaggctggagtgcagtggtacgatctcagctcactgcaacctctgcctcccatgttcaggtgattctcctgcctcggcccctcggcctcccgagtagctgggattacaggcataagccacgatgcctggctaattttcttttcttttcttttcttttcttttttttttttttttagtagagacgggttttgccatgttgaccagactggtcttcaactcctgacctcaggtgatccacccgccttggcctcccaaagtgctggtattacaggcgtgagccaccgcgccaggcctacatttaagtctttaatccatcttgagttaatttttgtatatgatgtaagaaaggggtccagtttcaattttctgcctacggctagccagttttcccagaaccatttatggaatagagaatcctttccctattgcttgcttttgtcacagatcagatagttgtaggtgcgcagccttatttctgagttctctattctgttccattggtctatgcgtctgttcttgtaccagtactatactgttttgtcctccagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcagtaagtcagagtactatttttgttcatcagtttttcattcctgtggttgaaatatgactgtgcctagagtcagagacatggattaaaatctactcgctaaggggcacctccaatcctcacttccagtccaaagacttggtgatgaaatccgtgggtgacatcatagcaacatttttaagcaagaggtcaaaggctcacatccttagaaatgcgtttgatcttctattccaagcgtgtgtgtgtgtgtgtgtgtgtgtgtgtacacagacatactctgcgtggtgaggaaaagggtgagagagtaggactaatggaaggtgttatagtccatgtcaatagtatcctagactgagttcagggtgaatatatggctaggacagaaagaaggcaagtaatccaaagatggattgacacatcaaagtagagcaaaatgagtatagggacccaagagtcttggaaaggcatgcatgaagacatttcaagtgatcagtaagattttcagaacaaaaggaattccctgaatgagggttccggcatttgctgcagttctaaagttcagtggccaaaagcactgccatggcagtctgagagaaatgtcactgagccagctggaagcaaacttctccacaacagccagggtccccctactgatcctcagagtctagagtcatggtaatcaccttctctagtaggtaatcacacatgtgaggatgatttctgcatgttctgttcatatagcttcagatgaccgacagctagggattatcagagctgacaggtgccaggtcaaataattcaaacagaaaattactctcagctttctttgcataacttccttttggcagtgaatctatcatagttctagaccagtgctgtccaatagaaactacgtatgagctacatgcgtaatttaaaattttctgatagcaacattaaaaagtaaagagaaataggtgacattaattttagtaatatgttttacttaactcagtatatcctgaatattatcatttcaacatgtaaccaatataaaaattaatgagacttactttattactaagtctttgaaattcaatgtatattttatactcacagcatatctcagtccagtctacccatatttcaagtgctcgataaccacttgtagccagtggctaccatattgaacaatgcagttatagaccatttagaaaaacatctagaatgaggtataaactaataatacatcatgtaaattattaaagtcacttaagtgatttaagtaggtatttaaatatttgttaatgccagtcattatactggtactaaggctaagagtggtaatcgaggtagacatgagccctgcccttgtagaaatcatacctttggttttttactatgcttagtacataagtaaataaaaatattgcctacagcagtgtcccttttaacaataatgaaatgtatgaactggatactcaaatggaaactgtgaatactatgtagattataagacagcaataaaaactataaaatatgctaaatgggctttatttttagggacattacttcttacccaatgactaatatatcaaaaagatgaatttcttatattatgcttttcctccaagtggaattattagaatatctttaaaggcagagaatggagcacaaaatatttactatacatttgacgaatgactaaatcaatgtaaatggaaggctttatctttttcctgagatttctcctttggctaatttaggagaataatctctcatttgaaaattctgagtttgatcttctagtcacatgttagactagataaagcttatcttggataatcactgctttgacacaaccaaattaacatggagacatttatcttaggtataattagacacatgcccttttgttggcatagacttggaattttaacagattttacactttcagctatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggtgagtaagagtctggacactcacagaggaagcttgctttgaatttctggtctataaaggtctgctgcaactctccaggctaccagtgctcctctatgtatctccctgaccccctgcaggcttttctttcaatgtttctcatgatttctctttgagaaattaatgacttaaatggatccagttctttagtgtgggttatatttttccttctctgggcaaagtaggaagtaaaaatatacaacagcagaaaaataaggcataactctgaggaagaagcataaatattttggccacaaaagagcatttcttttatcaaaatgccctattcggttttttgcaacagtcatcttcaatcatcaggtacagtgccttaaaggctgcttcagcaacagctttggagtttgtcagactggaatgcaagtcctgatctgccaatcgattgctgtgtaaccttacacaagttacttggccacactgagccacaagtcatttatctggaaaacagtgtaatcacatctcacagagttactttgaccattaaaatagtaatatgcgccaagtgcctagcactcagtagacaccaacaatggtaactattggagactcaccaagaaatctttgatgttccagcaatgcatgccatttcagagattcaaaattgtcctcgtgaattattacttagaaacatctaaatgtctcttatttgtggggatagagctcatcaccatccctttaattctaagacaagatgtgctgttaggatatttatgatattaaaagtccattttattcttgattcatccctttcttaatatattttaaaatagtgagcaactatctgtgctgaaagaccttttttcccctctaatctccactaagcaacacttttgttttttattctgttaagcgagatgaacgcactggtcatgtgcttagagtcacagcaatgtcaaattgctttagaaaaacaaaagtttactaaatatttcattctcatttttctctccttgtgttattttgacccagtaatcaataggtcacagacaagcagtggtccacagcccatacttgaatattcctgacgaaagtttattagaaattacctgccacaatggattattgtgttttcatgtcttttcccagacttccagatctctcttctgtctgtctctcttctgtaggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaatcaggtcattccgaaactcatcattgaatcaggaagaagaagagttcaatcttactgccctagctctggagaatggcactgaattcgtttcttcaaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcaaaagtcaagaacatgctaagcataagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccctttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaactctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaaggtttggccagttttctccttttttattctcatttttccattactgctgaaaaaagtagctactacaattcagggggataattgtgggcaaattatactaagaacagtgtggttcccctattgcaagttggcctgttctttttcctttgtcaattccaagattgcttctttaccttagatgacccctggacaatataagaacaatcactgtgagaactctataatattctgtaattaagcatttttctgtgtcctctcctcttactacccatgtttctactgactcttattgctccaggcagagcccaacctatccatagctatatgctaatcaatatgatttaattgaagttagcctcaaatccaaactcaaatatgatgtagaaatctcctttttgcatttacttgtttagatcagaatttctaagagatccaaatcccttttttaaaagaatatttacaattcagttttgcttaggggtagaaagccatgttgaactgggctctttgttctgggatgaagatacagaaagagaagagagaggaggaaaggagcaaggcttagtcaactacaaattctcagggatatagcatgatgactgtgcatcagctgtctagatatgcccacagcttttactaaagctgttacactaatcacttaaaaaaccaaagtgtaattacagtaggcaaacacaatgtatggtgtgacttatgcatatgagttcattaatctgatgcctgacatctccacattagaactctgtttaaaacaccttttcctatgacttcctatttaaatgttgcactcaataccacatgagaacaactagctacctgagtatttctaagcaaggccccgagggagtgagatgcagggcctgtccagagtgaatagggatggaaccaccttcaaaatcttgtattccattcaaggctcacaacccacttttatggcattcggagttgctttacccactcccttgtgttctgtgagtttgcatgttatgctcagagtctggaaagatgggattagtaggggaggtagaccagaagaaaggcagaaggagattctctgttgatgactcacagtatatagcaaatattatgggtttgatgggtgagtgtttggcttgtttccacaggcttgggaaatgtgagagtcagtgggagaattcgacatgcttcagtcctagactgagccaatgaactagatggaaataatgtgctttatttatttatttataatttgtaattaaactttttattttggaacaaaaataaaatagattcacatacagtcaagagaaataatacggagagatcctttgggtatcctgagtattctttacccagtttctcccaggggtaacattttgcaaatctataatactatatcacaaccagcacactgatgttgatactgtcaagacacagaatgttcaccatcaccataaaaatccctctcattacccctttatagtcacatctgccttcctcccaccatagcccttccttattccctggcaaccagtagtctgatctccatttctataattttgtcatttcaagaatattacataaatggaatcaggcaacatgtaacctttggggactggtattttttcactcagtataattctctggagattcatctggttattgcatgtattccattatatgggtgtaccccagtttttttgttgttgttgttttatacacatttatggtgtaaacatgatgttttaatatatttataaattgtgaattggctaaatcaagctaattaacctatgcattacctcacatacttttttgtggttagaacacttaaaatgtactcagcaatgttaaaaattcagtgtgttgttattaactacagtcaccatcttatacaacagatcttctaaatttatttcttctaactgaattttatcttttgaccattttctcaatgctccacctctgtatccctttgttaaccactgttctaccttctgcttctatgagctcaatgtttttagtttccacattataagtgagatcctgcagtacttgtctttctgtgcctggcttattttatgtaacataacgacctcctggttcagtcatgttgtcacaaatggcatttcttcgttttcttttttttaaatgctaaatagtatttcattgtttatgtagatcacatttaagaaatccattcatttgtttatagacatttgggttgcttccctatcttggctaatgtggctaatgctgcagtgaacgtgggacagcagatatctcttcaacatactgatttcattttctttgggtatatacccaaaagtgggattgatggatcatgtggtaattctatttttaatttttaaaggaacctcccatactgttttccataatggctgtactaatttacactctcaccaagagtatacaagagttcccttttcttcacatccatgccaacatttatctcttgtcatttttataatagccatcctaacggtgtgaggtgagccctcattgtgattttaaattgcatttctctgattattagtaatgttgagcatcttttcatatatttgttggtcatttgtatgtcttcttttacgaaatgtctattcaagtcttttgctcattttttaatcaggctatttgggttttttgctgaattgagttccttatatttttaatattaatattcttatcagatatctggttttcaagaatattctcccattccaaaggttgtctcttcactctgttatttcctttgctgtgcataaacttttgagtttgatggcaatcccatttgtctatttctgcttttgttgcctgtactttcgaggtcaaatccaaaaaatctttgtccacaccaatgtcaagaagcttaagaataatggacattagcaaaaaacaaatgtgagaagagtggctacttttagggtacaaaacattcacccatccagtgactttcataagtgtgaccttctaattaatctgaccattgtcacctgatagccccaagctctggcactgtcccattacatggctttgtctgcctttgatcttaaaatttggtgtgttaacatacgattatatttatacattcatttatatgtttgacaaaaatttattaagttcctgctgtgtgtcagataatgtgcttaccactggagagagtactatgagcaaactaggcacaatggctgacctcatggcacttatacccagtgagagacagatattaatagataatctcacaaataaattatatataatctacaatatatattctagagatattataagaatactacaggaatttactatatatactataataatactatagaaatatgagaaattgatatagagacttgacctagtctaaaaggtcataggaagacttacctataaaataatatttgagttaggaattgaaagatatttactggcttttgtttttatccacttatatatttactcatttatccaccaagtatttattaaagaccttctctatgctagatgctatatttagaaagagacaatttcctaaattctgggaacagtctttaatttcttcttttacacaaatagtattattatttcagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagtaagtcttttgagcactgctaagatcttcggaggaatttccacaagcaccagagggttgtaaaggtgcaggtggcaagagagctataggtgatttgtttgttttccaggattaatgaataattacatttcttttcaaagactccttgccaagcaatttggcaatcttcgaactaaaaaaaaaaaagatctcattttttaaatgctgaaaactatataatctgtggaaaatctttctgtaatttctatctaaagctaacctatctaaagttaacacagaaaattaatatattcaagagcaattgaattgggtttcatagcagtggtggtggtggtggcagtagcagtgctagtagtaatagtaatttagaaatatcttcaggtgttttcctaaaaattaaataaaatgaagttaaataaaatgagtaaggaaagtaaagatgtctccatgccctccaaaagtgagcaagtttcttcagtgtcttcctagttctggtaatttctttcaaaatcttgtgtccagacccacgattataacttgcttttataacaaagtttacttccgccatttttgctaaccgctcacattcaaaaacccagaaagaaccctgattctaaagtaagctattctagattttaaaatataatctactatacctgtgtaagcattcactacattttcagtgaccatttgctctttttaaaaacgtaaacaagtacatagggatataagaatcttaattattctaaattttccatgaagctatgggaggcaatattctcttttatgattaggggatcctttttcaagatgaacgataatttaacacaatatttaaaaaacttattctaagtaactcaggaatcaaaaaccagacactgtatgttctcacttacaaatgggagataaactgcgggtatgcgaaggcagacagattggtataatggacattggagactcaaaagggaacgggggatggatgaaaagctacctattgggtacagggtacactactcaggtgacaggtacactaaaatcctagacttcaccactatacaattcatccatgtaaccaaaaaccacttgcattcctaaagcaactgaagttttttaaaaaatttaaaaatcaaaattaatgcacgaaagccacaataaacaaaacctcacaattgtgaataaagacaggataagtaacaatgttgcattgagacatactggagccttaggcaaaaggaaaaaaatcaaatactgaatctttgttttagccctggatttcactagataaaaatgacttcatttgtgtatttttaaaataattttaacttttattttagattcagggggcatatgtgcagttttgttatctgggtatattatgtgatgctgttgtttagggtatgattgatcccatcatccaagtagcgtgcatagtacccaatagtttttcatcccttgctcatctccttccttcccccttctagaagtccccagtgtttattgccatctttatgttcatgagtacccaatgtttagctcccacttataagtgagaacatgtggtatttggctttctgtttctgcattaattcacttagcataatagcctccagctggcatccatgttgttgcaaaggacgtgatttcagtctttgttatggctgcgtagtattccatggtgcatatgtaccatattttctttatgtagtccaccactgatgggcacctagattgattccatgtctttgctactgtgaataatgctgtgatgaacatcctagtacatgtgtcttttcagtagaacaatgtattttctgtctttctttcttttttttttttttgagatggagtctcactctgtcgcccaggctggagtacagaggtatgatctcaactcactgcaacctctgcctcccaggttcaagcaattctcctgcctcagcctcccgagtagctgggattacaggcacccaccaccatgcccagctaatttttgtatttttagtagagacagggttttaccatgttggccaggctggtctcaaactcctgacctcgggcaatctgcctgcctcagcttcccaaagtgctgggattacaggcatgagccattgcgcccggctgaacaatttattttcttttttggctatatacccagtaatagaattgctaggtcaaattgtagcaggacaagccacagacaaaaacccctcagacaccaagttaaagaaggaagggctttattcagccgggagctttggcaagactcatgtctccaacaaccgagctccccgagtgagcaattcctgtcccttttaagggctcacaactctaagagggtccacgtgagtgggtcgtgattgattgagcaaggagggggtacgtgactgggggctgcatgcaccagtaattagaacagaacagaacaggacagggattttcacagtgcttttctatacaatgtctgtaatctatagataacataaccgattaggtcacgggtcgatctttaactaccaggtccagggtgtggcgccgggctgtctgcttgtggatttcatttctgccttttagtttttacttcttctttctttggaggcagaaattgggcataagacaatatgaggggtggtctcctcccttaaaatagtagttctgtttcaaattctttgagaaacccccaaacttctttccacagtggctaatttacattctaagcagcagtgtataagcattcccttttcttcacagcctcaccagcatctattttttgactttgtactaatagccattctgactggtgtgagatggtatttcactgtggtattgatttgcatttctctgatgattagtgatgttgagcatttttttcacatttgttggctatttgtatgtcttcttttgataagtatctgttcatgtcttttgcccactttttaatggggttatttgtatttcgcttgttcaattgtttaactatcttatagtttctggatattagacctttgtcagatacatactttgtgaatattttttctattctgtgtctgttcactctgtagatagcttcttttgctgagcagaagctctttagtttaatttgtcaatttttgcttttgttgaaatgcttttgaggaattagtcataaattctttcccaaggctgatatccagaatggtgtttcctaggtttttcttctaggattcttatagtttgaggtctgacatttaaatctttaatccattttgagttaatttttgtatatgatgaatccagtttcattggattcattggggttcagtttcattcttccacatatgggtagccggctattccagcaccatttattaaatatgagtccttttccccttgttttttgttgttgttgttgctgttgttgttgactttgtcaaagttcaggtggttgtaagtgtgtggctttatttctgggttctttattctgtttcattggcctatgtgtctgtttttgtatcagtaccatgctattttggttattgtaactttatagtatagtttcaagtcaggtactgtgatacctccagatttgttctttttgcttaggattgctttggctattcaggctcttttttgattccatatgaattttagaatagctttgtctaatcctgaggaaaatgattccagtagttgttaaaaaatagtgttgaatctgtagattgctttgggcacaatggctattttaacaatactgattcttccaatacataagcatagaatgtttttccatttgtttgtgtcatctatgatttctttcatcagtgttttgtaattcttcttatagagatctttcacctctttggttagatgttttcctaggtattttgtatgtgtgtgtggctatgtttaatgggatttcgttcttgatttcgctctcagtttgaacattactgatgtatagaaatgctattttgtacatttgtacattttattttgtataattgattttgtacattaatcttgcatcctgaaactttactgaagtcatttatcagttcctggagccttttcatggagtctttagggttttctaggtacagaatcatattgccaatgaagagagatactttaacttcttttcttctttggttgccttttatttctttctcttgcttgattgctgtgactagaatttccagtactatgttgaataagagtgatgagattgggcatccatgtcttgttccagttctcacggggaaggctttcagcttttgctcattcagtatgatgttggctgtaggtttgtcatagatggctcctattagtttgaagtatgttccttcaatgcctagtttgttgagggtttttatcatgaagggatgttaggttttatcaaaagctttttccacatttattgagatgatgatactgtttttgtttttaatgcggtttatgtggtgaatcacatttattgatttgcatatgtggagccactttgcatcctaggaatgaagcctatgtgattgtgatgaattaatttttaatttgctgctggatttggtttgccaatattttgttgaagatttttgtgtctatgtacatcagagatattggccggtagttttcattattcattgtgtctttgccaggttttgttattagggtgatgctggctttgtagaataaaataaggaacagacaattagggagtctttaatcactagaagttatagaagggctgggaggagcttcatgggtctgactgctggggtgtgaagacttctcatatggcatttaagtcctttaccatctggccccaacctgctccttttctagcctcatttctcaccaggttccacctgtccctgtgcatttcacagcccagttccaccgagatccttgctattccccaaactcttcctttactcccctgctcacaggcatccttctgcccttctgagagtctgaaatgtctttctagctcctgttcattctatgatggccaattccatttcctctaagaaacttaccttaattcttccaaccactcctaaatattcaaccaaattgttcctccagggcattgtcatctgaacccacttagactttgtatatagcacctgttgtctccagatttgtagtgtggatgcccatgtgcatgtctgtttcagcagtagcttaaaagcttcttatgaacaagaatcaagcttctttcatcttcacatctccactacctatcactctcatttcattagtagataatgtcagtactttagccttgagcctaagaacaaatatcttttggtatttctggagaaaactacttgggccatatctcacaggatggttatgaaaattaaatgaaataatatacataagttattttgtaccttatatcttagctccgattttataaccagccattttgacttataatgctgacatttttgtggtttagatttttgttaagcttaagtacatttgtggatcattccttttcctaggttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagtaggtactttcattgaaagtttttctcattcccctaacctcgtaatctgaagtccaccaaatggaagagtcggggttatttcttgtcaaatgtctgtcttgcttttcatgaggaatgcataagggtgtggttaacagtctgcatttatcataaccagggactctccatgcagctcttcagatgacagagagagaaacatttattcagtggagaggaggaaagattacttgaatgattggccatgaattagaatgcctacatttacagaagatggcatttatttgaaattttcttgaacaagtattagctatgttctgctctttctttatgaaaagaactgcaaagtcaagactcctttatctgacattctgcaatgtatatatacttcaaaacaatatgtcatacacagtatatgcatacaattttatctgtcaattaaaaagagaaacaactcctccatttcaggcatagtggaaagagcacagactcagatttaaatttttaccctgtcaatgcataatcctaggaaattccttgacctctcttagcctggtatcagaagttaaaaatgagataacagtacatagtgcatggtaagcacttggtaaatatttgttcaatgaatgaatttatatttaccatataagatagttgtcaggattaaatgggagattgcaggcaaatcatttaatatagtaatagattctcaataaatagtatcccttatattatcaatttattattatcatcattgttactgggataaagatcaatcagaggaaggaggattatgaatacaacagaattaggtgataaatatccaggcttattatgccattcatttataatcttcatcttcaaattcagagcctatcagaaagtttccttttctatatgatgagtgattatcagaagagcaaggaaattcctgagaaagaggcaatacaatttactctgtttttccaggaaaaagatattcactcaggcttgataggtcccctcctaatctgccaaaaaggaatactacataaggacagcaacatgcctatggacatgagagaatttgtcttactatttatgacctttgatgaaaagaagagctggtactatgaaaagaagtcccgaagttcttggagactcacatcctcagaaatgaaaaaatcccatgagtttcacggtattttcctcggactttgatctaatctcctaattaaatcacactgggtcacagtgatttctgcccttagatattcacaagattagacatgagatgcttctgagacacccagagctacaactaaaaccggttccttaacattccagagggctgatgtaatctggcaggtgacactgtgggtgaggcaaaaagagaaagtctgaaagatagcacagagaagctgctgcaaaacaaaccaacagaaaaccacaacaacaaaaagccagtgtgcttcagctggtaacatacattgaaaaggaattaacattgttctgcaatttaaagttaataagcttgtttctggatctctaaaggcacaagtgtttatataaaagaaatgatcacctgtgtgtcttttctaaaataagaatgacgctaacagttttagctctcagcagctaccaggtggcacccaaagcatatgagaacaaaatgagataagaaactaggtacccaggtaataggagaatagtggcaagagagcatttgggtggtcacactgggaaaagtgtgcctatttggaaattcacaaggaaaatttgccctgtaagctagtaactgaaacagaaactgagaagagaaaggtacgagcttgtgttatgaatatgtagataggtgttctcacgcctgatataatttgaaggatgcccaaatgatctcaacccgtccctctccaaaaattcacctgcctggtttctgaaatttcacagcagttcctctaacttaagaaggaggaaacaaagcacttccctcactttggtttcagttaaacgtttggtaacactaaactttatctttacagttttgtgttacatttttaaggtgatcaagtttctcaggaactttttaaaaaatccgcgtattttactgtggggagagtagataaagcctgagaaccctagttatctaatctgagaagtgggcagaggagttgtcataccaataagagaataaacatgacttgctatggttgctggatacaccaacgataaactcctaattttataaactcctagacttcctaatttgcctgaaactttctctgaatttagaaggccttaaggtgacatgctgcatatctccttgctgactctaatccctggagtttactttgtctgcccatatttgtatttatcttttgtagttaaggaaaattaagactgttaatggaaagtatacacgggtaaagcacggaactgtaaaagctgaggaaaagagtgataaactgcttggaaagggagttccccctgccttctgctgtaggctggtgtgaatgatatgagaaggactagtggttctgctttagcctctcactaatgtgacatacaagagggccctttccatggctaggtaggcctgggaatgcagaatcatgaggaacatgggtgttgagtgggttgccccatatttccttaccactcgccctctctgtgtcaacagatttttaattgatttcaactctttgtcctttcagccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggtaaagattgggtaatgggaagaggtccctgctaagaaatacagggaaaaggcaatctgtaactccttctcatttcttccttgtgcatatacttcctaaggggtcagaacacagggttctggcatagagcctaggcaaacccatagacccaaagtatatacggagtacaaaaatgtcacctaatttatgaactatttgcagcaccacacaggctaaatgtgtgacccaactcagttgcaacataacatgcagtttctcccaagccactgtgtgtcatacagatgaggtcttaagcagatgaaaaaatgaatcccacagggctcaggcagctacagctatctctgctgggagggtttccagattcttcagttctgctcctcttctaggccctatcaccctaatatctttgggcaagtgactccaggaatcacattcttaaactgacttatagactgtttgaagaggaaaacatttttaaaaaataataataaaagttaaagaataacaaaggtatttagaacttttcatgtgcaaaataaagataaatgtagatttaaacagtctacaattatacagaagggatgtttctgtgccaatgagttgtttgtaagtgtatctacttgtgcagcagtataaaaacctaggaagtcagttaaaatgcagatgtgaaggcagagggattttgttctcagagactttaaagtagattttgggcagaattccaaggagtctgtatttttaacaagcagccttccttctattttgccttctattaaaagtaatggcaaaaaccgcaattatagtttgcaccaacctaacacatgctgcctgaggagttagtgaaggcagcccctcgacagcactttgggtgacgttgtgtgaatctgcctcagatgcagacacagaagtccaaatggactggtttgattaagagcagggaaaaaaagagggttcttattggtttttcacatgccagtaactcactaatacatctagagagtattaattgtattatattaatatcatattaattaattaatataataattaatagataatttattgtattaaaatcagagacagaagagattcagtcaaatttactcatcttttcatcaagtattagaagatcagtcatccttcctatcagcctgcagacagactgagaagctaggattggctggtgtctctaaatctgcaaacctaaatacctgcattggagagaggaaaactggagacatttttcagtgtgtttgaggaagataatcatatctattcattttcacccacaatctgggaaacagtcataaattatagtcaacagaatttaaatattaactgccagggggtaatgttaaataccagaatggatagccagaggttttagaaatctcattctttcagtgttttttctgagcaatttatgtaaatctctattcaaatatgtaagctttatggaaaacttgaaaacatggaggaagaaggttttatttttattttcttatataaaaaagagaaaaaagcaaaaatgaaaagagggaaaggaaacatgtatgatatttttgaagcccaatgatgtcattcgaggtcactttgataattaggactgtgaagctgtattgtatgtgagttaatttgtaacattatatttagataagtgaaagtttcttctagtgaggtgtggtggtgatttaaaattttttttagttatctctgtgtatgtgttgttattgttttgtttttatctgttatactttcagtcctacctaaagaaaaatggttaaattctatttgaaagcctcttgtgaagcaggaattttaggattcttagagaactatcaaccacaatatttacttgttaatttttgcaaatgtaatgttgttctttttattttaggttcatttaaaactcttgaaatgaaggcatcaaaacctggctggtggctcctaaacacagaggttggagaaaaccagagagcagggatgcaaacgccatttcttatcatggacagaggtatcacaagagccatgtgatatttggtttggcaggagagtgcctattactagaatattaccaacttttagattggaaatattcaactctaagaactctgatgtgacaaaggcataatttgtagccataattgcttttattccggcccatggtctgattgcattgaaaacacatcagtcagatcaaaagcattcctgtcaattgggaaacctgtgtaaagcatccttcttcatgacttgtgatccatggacaagtgcatataagaaattttccagcttccaagagttgaggagggaaaaggtcacaggaatttaacaatgactgagtcactaaacttgacatttcagcatttaggaaacacagttttcatctgtccatctgttcatccattctttaagccattactaagcactgttgagtatgaagcactgtgccaacatccaggtagcacagtggctggtatcccttccttgatcaagatataaataaccttgtaactttgaggtcaacttttgagaacatagtctcatcaggactagaactttttttcatatttttatattttgtatttttattttttttgtagagaagaggttgcccaagatcaaactcctggcctcaagtaatcctcccccctcggcctcccagagtgctaggattacaggcatgagccactgcacctggccatggatggtacctaatgttgtaaaatagcataatttaagataaaagcagaagaaaatcagtttaaaaaatgattacatttcaggatttcagttgctttcttctaggatgccactatatctattaaagcaccagtcttgttagtgcatttaccattttataatcagatatatttaagtcagggccacacaaggtaggtaaaaatatctaattattgagtcagaaacataatccctaaccatggagttttactttattgtatatattttctaagcaaaaattattcattttttttctgtttttcatagactgtaggatgccaatgggactaagcactggtatcatatctgattcacagatcaaggcttcagagtttctgggtaagttgtagcaccatggtctgtgaatggtaccccctacagttgtgcagcatgcagcctatgaaaccatacatgacaatcctatctatgaatcagtttttctctttatgcttttctctacgacaatgtagtgaagcagctccatttggggtacatatatggtaaaggaaggaacactatggtaggagctaaaggcctgttagtgtgctcttaacactgccacctcttctggtgtataatgatcccaaagagtcttttccaggaaaaaccgatagctgggggtcattgatttctctacataaaaagcccagcctctctgcagggatttggcaaggatcagataccttagtcttatgaccacgcgcccatttccaaaactctcctcagtcatcttttctgggtttgaccacacatgtagtatttcagccagattcacagggtcttatcagccaggcattatagtccccattaatatggccctttgcctgtggcaaccattcatctattcagaaaactttgttgaacctccactatatgtgaggaactcctccaaagttttcccacactgcctcaaagcccttcccaagatcaagaggtcatgatcaagaggatgatgaggctcccatatacccttccatgtcttcctgttaggcaggcacattcagcattaggaatataaacacaacagaaaaaatcaaacatgacctgtgtgcaagaaaggggataggaggtggttggcagttgaccaaacacagacctgaagcccagatttcatcatcaaggactggcctagtagctgaggcccatgcctagactcctgactacaacacaggtcctccaaggatctggttttccactggattaaactcacttgagaaattgctgggtttttaaaaaattcagaataaatctttttcttcccttgagtttaggttactgggagcccagattagcaagattaaacaatggtggatcttataatgcttggagtgtagaaaaacttgcagcagaatttgcctctaaaccttggatccaggtttgtcttaatagactgataatatttactgctatcgtaataataaaaatgaaagtgatttagtaattccttgttattgttcttgcaatgttgttaggggaaatagcaagtactaagtgtgaggcactgttctaagtactttatatccttaaaatcaaccctctgaggttggttctaataatatcttgttttatagattaaaaaacaaaaggcacagagatactacctaccttcccaaagtaacacacagctaattagtcattgagttgggattcaaatttaggtactctgtgcccaaatatgaattgcatgtagtcattgtatcagtttgctaagatcttatgtgctagctctttagttctgaagaaagctgattgtataatgaatttaggcagtgtgtgacttgttgacaaggacagttctgtttactggctttcctatattgcaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatggtttgtgtgcatatttctatctgaatctctagactctagacttggcctagaattattatgactatacctaatgattatgtattttaaaaaatacctttctgggtattagaaatgtgaatggctttctaagggtcatatggagaaaagcagtaatatgataggtctgtgtcttacaaattaaagagagaagcagggttactgaaacttcaaaaccccacaaaactttaaaaaatcattttatcatcaaacaaaatacccagatttctcagactggccaatggtatacggcagagtagaacatctggtcttgcgcctcaaggagctcatgctaaaaattggctaccaagacttttgattttactattgtagtttgttttgttctttatttcagtgtacctgaagtaaatagtagtgttaatgctagtaagcctctgaggcagtgtgattctcagactttttggggggccatgcctgaggaatgacattctccttctggttcttccaggggctcagccataagccctaactcttctcctcctctctattcccttccccaaagaagtctgaatgcaaggagtctgcctgccattattataccaataaccttgagtctgtttctgcttatattttatataaaattatttactgtttattagttacctatttttaataattatttatactatgtctcagaaccattgaaatcctaaattatggttcttactaatcagtattatgagagaaaacacagattgcagttgagtccatagcataaagattttgtcgtctatgttcatgagaggatattggtatatagttttatttttttaattgtctttttctgtttttgataccacagttatactagctttcataaaattggtaagcatgctcttttctacattctaggagaaaatgtctgcaattggtaataattctttaaatatttggtaggaatcactagtgaaaccatctgggcctgcagatttctttttgggcagtttttaaattacagatcctatgttctaaatagttacagggctattaaaattatctatgtcatattgggtgaattgaaatactttgtatatttcaattaactggtcaattccctctacgttgttaagtttatatgtgtagagttgtttgtatattcccttatcctttttcatgtttgtagtgattttgcctgtttcatctctgatattgtcatctgcccctcctttcttttttgtgtgaatcttgctagagatttgtcgattttaaaaaaatcttcttggccgggcgcagtggctcacgtctgtaatcccagcactttgggaggccgaggtgggcagatcacgaggtcaagagatcaagaccatcctgaccaacatggtgaaaccccctctctactaaaaatattaaaaaaaattaggcagggtggcgtgcacttgtaatcccagctacttgggaggctgaggcaggagtatcgcttgaatccggaaggcagaggttgcagtgagccgagatcacgccactgcactccagcctggtgacggagtgagactccgtctcaaaaacaaaaaaaaaaaaaaaatcttttcacagaaccagccttgttttattgatttttctctattgtttttctgttttcagtattaccgatacctgctccaatcttctgttttaaaaagttggctttttctgacattgctctgtcaggaaaaggggtagggcacagcctgtttactgccaagtgggggtcaaagtccaggttccccactccattgccacctaagaagggattgttccttggtggctgggtgggaagggaagttccccatttggcctccactgatactgcaggggcaggagcttcattaggggctggagatgaaagccctaaatccctacatggccttttctgacacaaccccagtgagggtgtagggtgcctctttagcctcaggagcatagaagtctaggctccccattcagcctttgctgttgtgggttggggaggggcctcaggtttttctgtggtgtttggctaaaggagagaagtcagtgtccaccagttttctatcatatctcgctatgctgccctttactggtactttggttagagaaagcagattttatttgggctttttcagtctgtactcattggtgtttccaggttgccggcttcttcatctctaagtctgggatttatgaggcaaaaagaaaattcaagacactgatcaccattttgttccttccgagaaccctagccagtctgtcttctgagctcttttcagggtcttatgtttctctgagctataatgtccaaagtttttagttgtacttagcaggaggaatagggcaaagtacatatatacaatcttcctggaactggaattatccccaagtatattttataaccaaattgatttagtttggaccccatgaaaatgtagtattacaatattaaattagatcaaaattttaatataaagtcactttatagatcattgttacataactaaactttcctcttttcttctagtattttaatggcaattcagatgcctctacaataaaagagaatcagtttgacccacctattgtggctagatatattaggatctctccaactcgagcctataacagacctacccttcgattggaactgcaaggttgtgaggtaaatggtaaggtacaaagatgcattattttctcactgccactcaaagaatcaagatttgggaggtataggagaatgagtagaatttttagttcttttcagtgacttaggctcctaggaaaacctttgtgaaacagaggttctactcaggtaaactctcagtgtgatctagaccaagaatggttctgccaatcagagtgccgacagcatctctgtgaagaaagtgcctggattatatagacacatcacaactctccaaggaagggctctaatttggaattacctccatcagcccattttcaataagacctacctgagattcaaactaggcctgactcttccaaagtcctcaggtcactcaaacttcaatgtcatgacagtatctggcaacatcactgccatatatatggtgttcaatgagtgtttttgaaatctgaattggcttcccaacttcctgaaaccacaattcttctttatattttctttcataccctgtgtaggtactcaagtcttttctatgttagctgctatttctcaggggctgtaatgtgacctgtggtataaataaatccaggtaatcataaatggtcataataaaattctactatatatagcaaggatgtttaagagtcttaactgttcttcttggactcttaaagcagtgctttccaatattttttacttcaaagcacacaaagaaaataatatctgcctggcattctgaggtaaaagaatgaagcaataaatctaaggcttggctgatccaggccccacttggctgctgaagggctggaggtgggaagagggatcaataaataggtgcactagaaacctgccatggcacacctgtcaggagttgcagtacttccctttgggtggagagaagccaccatgattcacaatggagaaagtagctgaaacctggaatcagtttcctgttgaagcagataatggcacagtatacccttggatggatatgggtattttgccaatgtccagatagcagtagtctaaaacatctcccaaataaaacacagatcttgtatcggcaggaccactccttgaaacagttccataagtcattgcgtttttttctttccatatggtataaatagatttgttcagatcctaataaactaccctaaaatgtgacattcaattctgctaacttatttaaaacatctattttttatacaagaagcattattttcttcttattcattttcttgatacttaggtaattattagcagtgggtattatttttaggaccctttgtttttttcatggagaaagtaaggcatcacttcaagaaaatttctgcatgatttaccaacaagaacaaagtgtcacagagatgatgggtggtcagccaggttcactcactagctgtgtttcttacagtcacaggtctgccttgctgcctatgatattcaaattacaccttggaaaaattccaaagggtacataactcgaattaccctctaagggttgaaacagaaaatattaaatagtgactgagggtccattgtatcttcttggtagcttttgttagaagaaacagagtatttttatatatagataatttaggattattgtcacctgaaagcaaagaccaaagtttccaagactctcagaaggaggaagtgagtttaaatgtttagaacatggtatttggtatcagattgtctgaactcaattcagtttctgattcttgtggctgtgttaccttagacaagttactgtgttttggctgtactaaaatggagatatttatgagcattatataatacatgtaaagcctgagaacagtatttggcacttggattcaataaatcttcattgttgtggttattgtttttgtcatttgttggtagtaatattatttcttatctcctctgcagtgcatgaagccatgcagggaatattggtgtgtaattaatcacgttacttttcttttgataggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggtcaagtatactctatgcatggtgttctcttagggctccagaagaaagcaaaggccctcactaccacaaacatggaggatctgggaagcaggagtattttaatctgtttctgcagattaaaatcctaggtccaagagtccaggatgtctgtggacttgatagctttgactataactttgtctcagagagaagtcatttatcatctctgtggtttttggtctagtcttgatttaaaccaataataagcaaattaatttttctgcaaagggatagatggtaaatattttagtctttgtgggccatacattctctgccataactactcaactctgccattgtagcagtaaagtagccataaacaatatgtaaatgaatgagctggctgtgttctaataaaactttgtttacaaaaaacaggcagcgggccaaatttggcccatggatcatagtttgccaactcctcatttagacagcttacattagtgataaaaaaatgatttagatttgcaacatcatctcttattttttctttacaatttagcaatattttttcattttcctaaatgaaatgtcatctaaacttttttgttctcttccccgccctccttattttaagagctttgtgatattccttgaggcaactagaagcatagtaaaatgttgcaaaaccagagttataaaatcagtgatctaagttaaacaaacaccttccagagagttatactgtccctgatattagcccactgagtaattcaggtgatttaatttgggggtaactcttaatatttgactcatttttattaattctttaaatgacctgagatatcagaatggcatgaataacttgatgatcccttcagccaactaaatccaaattccctaatttctatcctcatatctccctcccttaagatacctacactccaatttcctggctttctatagaattccagggcctatccttaaattaggccactagaaaggaaaaaagaattgtggtgctggtggggtaaatagaaaagattggattccacacagtcttgggaactgatatctgtgtcttgaaactcattctggcccaatatggaatcacagaatgttacagtagcaaggagcaaagcatctggtctagatttttccttttaattctaaatacacaggagattaaataattttagcttagtttggtagcagaatcaggactagaatcccattctcccagtaaacaggccatgctccttccaccatttgaagcagcccaaatacctcattttgcaattttgcagagggcaaagctgacacccagagaagttaaaataataaaaatagtgttatattacatttatataatttacatagcaatataaataataattaaagagatgttatccaattctttttcagatgactctttagacttgttcatggtataaccttgtcactccatacttcattttacaatcttttaaaaaaatttgcactctctataatttgctcttagtctttgtgatataacaagggcctcaaagataaaatgctaatttttaatggtgtcatttcaaagttagaattcgggatcagaaatatgtgttttacttaacccccttccattcacatgaaatgtctttatatggtctctttagagaggttgaaaatcaaagctggacatatgcagtgatgcacatagatgctgttctctccataactaaaatgtctctacctcttttatgcctgtgaaaacctctagctggttatactctgcatcactggtacaaccttgatatgaagacacactaagataccacccagatgtcactagaggatgttatagacttaaaagttttctcatataatcattctaattcagttaatttgcttttaaaatacatatagcatgtgaatttttgtgtatacacatatatacacatacacctatatatacacatacacttatgtatgtgtgggtgatgttgaagaaacatatcaatattatttcctttagaattgaatgaggttatggtagacgataaatctcccaaaggtaaaaatttatcttagatgactctaaaactcagtttagaccttctgatctttctccaaacacatatcaccaaccatgtgattaggcattttgttaggccagagacaggacaataactgtactgtgtatcaagctctacttatggttttatcaggtctctcaaatgttacatttatttgaaatattagaagaaattgaactatttctgctctttgacattaacagggggaaagagaagttgtgttttgtaaaacaggtgaaatagagagagaatgctatccaattatttcccagataaccctgcagcaatattaccagagtatttaaagaaatttgcttaagaaaataatattcacagataatttagcagtttaattatttttccaaataaagctcatttattcattcatttattcaacaactatttattgaacaccaactgagtgtcttaacattgtggtgagtaccaggaaacaaaatgaaataagcctctacccttaagcagtaaggaatgctaagaaggaaacaattatagtacaatgtgtgaaatacttcaataaaaatttacacacatattgtggcaatgaagaagaaagagggaaagcttctaggagactgtgaatcctaagggataagatagaacaaaatccttttgagctctgtgcttttttgcataacttggtctaaaaaaaaagcaaaggttttaacatcttccttatctatgtgtttttgtcattttcataggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaaggtagagtggcatctgggcaaagagaaagcaatctgaagactgtgctataatgagaataacagtattttgcatttgacaaatatgcagtgacatgtaccacctctttaagtcttctaaatcttagttcttaaggtgcctggtctcagacaaactcctggttgtctgttttggtttgttttatttctcactacaccaggttgccctcataggaggataaatatcattgtcataaaaaaaaagagtgattttatttctggtgtgtgtaaaccttggggaacttgctgatgatggaagggggaaagttatacactttagttgaggatataaggtacatgccaacaagaataaataaattaaaatgcatggtcacattttaaatgttagcaatagtcaaacatttattggtggccacttcctggcacttactatgcacttacgttgacatacatttttaaatatttacaatgacttctgtgaggtaaaatgttattatccttattttgccaatgaggaaatgaagaatcagagaataagtaacttgttcagtcatacagctaatacagacgggctgaaggcagaaatggttttgcagctgctccacagcaccatgtgagacttgtttatttttcactaatttaagtcagatcactggtgagatgaaatctatctggcatgtgatttcataactgatagaggatcatctctgtgagagtgttctatgtgttctttgatatgctcattttgagctaataggataaaaaattttctgggttgggcatgatggctcatgtctgcaatgccagcactttggaaggctgaggcaagaggattacttgagaggagtttaaggctgcagtgagccatgactgtgccactggactcaagcctgggcaacagaataagaccctgtctaaaaaaaaacaaaaacaaaaaaccttagccatttatgttgtcattaaagattttctcttatttggctttcagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaagaagcttttataatgtaactccttgctaccagtaagtaagataatggctattacttctgcattaatttgaatacaggtaggaaaatatcaagaaccaacaagaaaagggcttatctttcttaatgattgaaaatgctatgaagtaatatttatgtagttaaaatgcttcattataactcttttaaatcctttacacactagtaaaacagatattactttaaataataattgatagacctggataactttcacaaacacatgattttttaatggtttttcttgagtgaagagaaaaacaatattatcaaatgaaataagtacttaaaatatcctgtctttcccatataacaatgatttttctgactttccatgagtaaaaaaacagccaagcatctttccagtagccccattgaaattgtgaatccgtcctggtctccctaaggactgcacacattgatattcaaggttggtggtcattagatatggaacagaactgaaataaccatggtagaactgaatgtgtaatgttggctttattctagctggtactacatggcacacagtttcaaaacataatttcacctactggaaagctcagacctgtaaaacagagcatgggaactgctggtctaaatgcagttgttcctgctcaaagagacctctggccaaactggcaagcagttaaagttttctttcagggccttcctctctatggcctcaacttcctcctctctcttcttccagcaacttcccctttcatcattcctttccctggggacttggcattcagtgatcctgtagatattgcacaactggggaacctttagacatccttaaaatcacatgagatagacagtcatttggggtgtctgaaataaaccaccccaaaacttagtgttaaaagagcaaccaaaaaaaatttatgtgagattatggatttgttacttagcttgatttaatcatcctgtaatgtgtacatatatcaaaatgttatgtataccataaatatataaaattttatcaacgaaattcataacaatctctcagaccacagagaaatcaaattagaactgaggactaagaaactcactcgaaaccacacaactacatggaaactgaacaacctgctcctgaatgactactgggtaaataatgaaattaaggcagaaataaataagttccttaaaaccaatgagaacaaagagacaacataccagaatctctaggagacagggctttgcttttgctgcattctattcgttgtgaacacaaattacaggccagtctcgattcagtgtagaagggaactgcataaggaccacataccaggaggcataattcactgggagcatctttagaaactaccagagttacctgttgcccataccagtggggtaagccctatgaatgtatatgagagtttcaaacatccacaaaacattggctttctaatattcgtattcccactattcctttcttttcatgattcatgtcattgtcccatcaacatttctaagatttccattccgttaagagcaaaagagaatgttggaaggtgggggaaaacatttctttgttttctacagggccagcttcttggatgtgtgtgatctgttcagttgcaaagggtcacatgctcagaaggaccgcatgctaaatttaatgctttgcagttaccctcttgaaatcctttattttttaagaaggaattcgacatttccatttttcaatgagccccacaaattacgcagctagtcctgggcttctctactctgaaattgggcaggatctctcttgatctagaatttactaaggcataataggggcaagaaaatcttatgaaataatggggggtagggaagagatgggaatggagcatgagatccagcttcgttattctctacttgagaaaaataaggccccaaagattaaacaacttgcccaaggatattgcttgttagtgtcagaactgaaaccagaaaccaaatgatcatatccctagacttttagtctgctttctcttccataaaatgaaacttataatgtttctaatccattgctcagacaggtagacatgaatattaattgataatgactattaattgatctggaaaatacttgtttggggatcaataatatgtttgggctattatctaatgctgtgtagaaatattaaaacccctcttattttgaaataaaaaagatacccactttttatttctc

SEQ ID NO: 804 - DNA, 10327 bp, Human
aaaattagccgggcgtggtggcgcatgcctgtaatcccagctactcgggaggttgaggcaagagaattgcttgaacctgggaggcggaggttgcggtgagctgagattgcaccatgagcctgggcaacaagagtgaaactccgtctcaaaaataaataaataaataaatagaattaagttaacacttaaaatagtgactatacagagctttctccactagacaaacaaacttagagtttcaaggaagaaaacggtggggaagagaagagacagaaaggtgaaataacgtacatatataaaactggaaggaaagccatgccagtgctgtcttgggcttattgactgcatgtagacattcttgtatcacaccagctctcattagaagttctaggccaatattaccaagcttggtttcctcacattcagatatatccctggggccttggagtctcctctaggtatctactcctccctgcccccctccactgatacagcatgtcctaaatagtaccagacgataatccatatgttacaaccctgaccccagtgtattatggttcctcccataatctttgatcacatctaacgctactaaattctatctcctcagggccgttttagagagagctgattcacttatatcagtgtgagcatcctaatgtgagagattatcaggtctgcaaactggactgcacaacttaatcctcaaggatactgtaccattaaaagtagaaatggcttcatggccgttctgaaacatataaagagactaaaggataatattatagtatatctgatgctaaattttttaacatgtaactcatagcaagtaatcacttacatggaataatattagaaaaaataaaaaggaatagacaatacaaataaatcaatagcttcagataaattagaaagcctttattcataaaagctcctagctctaataatagaatttataaagtaatttataattataatatatctaatatgttaaaaaccaaatgagagcagagggagacttacaattaaatcagagataggggagctatttaggcacaacttctagcagtgtaactgagcaatatactaccagaataattccttatcagagttgatttaattttggaagctatatcccagtgtttctccaaaatatttttataaatctctctttattttttttctattaattcatgttttcaaagatacagagcaaaatacattgataaagttgcgattaatttataacatttcatcaatataatcataacttttgaagaacatgggagattcattatatagtaattgatgtgattacagagaaaagcagagatatctgacacttggtttagactatgcgatgttgtagacataagcgcatgttatgttatactagtgataatattgaaaaaggtatgcagtcacaaaaccttatcccttgatggcttgggatcccaagttggcttagacccaacttggagatgattgttctagacaacagcaaagcagaggattccatgtccaagaatagaatttctgtataccaccagcacctaacatggtacttggcacaaaatagagagagcctcaaaaaatatcttgactaaatgaaggtcttccttcttggacaaaatgctttgacttacttcatacattaagacatgcacttaatttttgtatagcacttggcaattttcaaaacatctttctatctatctcatttggttcttacaccaatcctttgtatacacacatgcataagcgttcatattttatcaatgagcaaactctgttggatctgagaacccatcttgcaggactctacttttagaatgatggatagaggttgttccctgcccccatcccccaagctgaatctaattgtccctatgttatcccaagtacatttttgtgccagatgtactccactgagttaaccaaggttttttgtttcgtttgtttgtttgtttgtttttgtgtttttctttttaacttttcagatgtctgtcagggttcaccttggcatcaatttgccctgaaacttagctgtgctgggattattctccttgtcttggttgttactgggttgagtgtttcaggtaagtggggcaccatcatctgtttcataatacttactctacttccattacgtatcttagagcatctctgtaggggtgggttgcccctacacacctgtgggtgtttctcgtaaggtgggacgagagatttggaaaagaaaaagacacagagacaaagtatagagaaagaaataaggggacccggggaaccagcgttcagcatatggaggatcccgccagcctctgagttcccttagtatttattgatcatttgtgggtgtttctcgagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagtattgctgcccgcaggtcccacctccagccctaaggcagtttttccctatctcagtagatggagcatacaatcgggttttataccgagacattccattgcccagggacaggcaggagacagatgccttcctcttgtctcaactgaaagaggcattccttcctcttttactaatcctcctcagcacagaacctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttcagattagggagtggtgatgactcttaaggagcatgctgccttcaagcatctgtttaacaaagcacatcttgcaccgcccttaatccattcaactcttgagttgacacagcacatgtttcagagagcaaggggttgggggtaaggttatagattaacagaatctcaaggcagaagaatttttcttagtacataacaaaaaggagtctcctatgtctacttctttctacacagacacagtaacaatctgatctctcttgcttttccccacaatctcaacataatttggctaccccaatcttagtgtaaaatcaatgaataaaaagtcatgaaacaatgtttctaacagtcagtccatatccactttggataccagcctttcatatttgtcttcctaactgccctgagagtcatcacggggtattatatatgtggcccaagaacttttgaaaaaaatcacaattgatgataacaaagaaaagaaaaatttccagttatttatggtttataatgtacttactaaaattccagattgcagtagacaatctctcccttggaacaggcacaattagactcattttgaagatgataaagttcaggtgagactgtaggcaatttaagagcttaagtaatccccttagattgacttacctagtagatacaggcaacctaatgcctgtgtgagtccacctgttttgttttttcttatttgtttctgtatgcttcctgtaggtgagatcttttttttttttttaccacttcgctaatacttttattttctgtccatattcaagcgtgttgagattatctagtttcctaaagtaacaaatataatatatccactccaccacacatttcagcatttaatactcttgtttttccttatgtactagtgacatccttaatacagaaatcatcaatagaaaaatgcagtgtggacattcaacagagcaggaataaaacaacaggtaattgtgtggcttcaatttcctaagaataactgttaatatttggtagatttcatgtgttaccttaggcacaattcataacaatccatatgttaagatattcttatcattctgcttttctggattagaaaattgagacataaaaagattcaacaacttgctgagggtcacataagcaccaagtgatgaggctgggaattatatgtaagtggtctgacttatgagcctaaggttttaaccagcaaggcatgctgcctcatgaggagcctctgctaggatactccactgttgataggaaatatgtgaaatatctgattattttagtgagctgttaagtttggtctgaagttaattgatagaacttaaacatagaatgaattctttactatttattatatttcctcaccatgcagccacattagtcttgttccagtgtgtgttaataaaaaaaggtgactactgttgagtgactatagtggaatatgatctgtgtgcacattctcacagaatggaagttttaagaaaacctgaaagtccttctggaaaattctatccaatagatcacattaagtaggtaaatacatcgtttagcaattggaaattttcttataattttttctccatggtatttcttattaatttagtgaaaataattatttgctatgcattttgtgcatcatttaaagtcagtactttttacatgagttttatattgttgcctgtgcagtgaaacaggcactggtgatgaatttaaggaaactgagaagtagtgggaaatatttcatctgactggctggacttaagttattctgtctctcactgtcttaaaatgtaagatgtggcagtttaaattattctgatggtgttttcctattttaatattttatgattccatttatgctcaagataactggtcactaattcccaattcttggtactagaatgaacagtaggtctcaaaaatctcaactttataacaaattcattgttctcacagtgataatcaaaaactttgagcatttataatgacctgtgtgtgtgtgattggttgtggtgtgtcagggataggttagaaatataacatttatttcttatttctgttttttactttagagagaccgggtctcttaaactgcccaatatattggcagcaactccgagagaaatgcttgttattttctcacactgtcaacccttggaataacagtctagctgattgttccaccaaagaatccagcctgctgcttattcgagataaggatgaattggtaaatcattaaataaaataccttaataaaacttaacactttctttaaaccatattaatatgtctgtgcattagcccaggggttttatgcaatggaagtgatgactttgacttcacaatttgaatgactacgtggatatgtaaacaaataattaaatataaggtgatgaatacaataatagaaataaaaacatagacagaaatatcacaaagaaggaataattaatgctgacgacgagttaggaaagacttcagagatgaggtgatgcttgaactaggttttaggggatcaaaccaggaatagataagcagattcaatatttttctgttccatttatagatacacacacagaacctgatacgtgacaaagcaattctgttttggattggattaaatttttcattatcagaaaagaactggaagtggataaacggctcttttttaaattctaatgagtgagtattagatgagctaactttaatattcaatttatatcaggtttacactgcaaggtagtaacactgaagattgagttttgtagttttaatttggtttaaaaactcaagaagttctgaataggctaagaacatggatgatttcaaagttggttggaaagttctatatatgaaaagatatcagctctttatgagaaaatatatttttatctgcaatggagttttaggggacaggaaatagactaacttatttgaaacgggcacattaaattaaaaatagtgattatctggagaccactggcacacagaatgtcttacgttgtatttttcaaactgtgggaaaatatacattagtaggtaaagagaccaatttagtgggtcacagctggcattaaaagaaaagaaaaaatagtaaatatcagagtgtggaacccagacacccacgttgtgacaaaaattgcagtatatttgaaccactggtgtgaaagacagaggtacttgagacgatgtgatgaaaacatgtctaacccacaaaagagctatttgctgttttctcttcagtgtgacatgcttttgtcttgtgtaagatggtcaaaattaccatcaacgtactatgagggttgatgcgacacaggcaaatttcatgttttagcagaattcatggataattttgcagaaaaaggcagggtgttttcttccctcacaagcgaaaatgtataggccttcaaccacatttctgtaaagaacttttaatgagtttttcaaaagagataatataaacagttatatttaatgagtctgtaaatgatttagtcaaattggcagaatttacatttaaaatgtattttccgtcactcaaaaaacaagaggttaaaatctaaaacataggagaatgttttaagtttgtctacattatactaagataatttattaagtatggaaagtattaaacactgaaaggaatgttggctcaatcagcaaagttttgacattatatgagccacattctaaaatattttataaagtgtaagattttaaaataaagatgatttaaaataagtgttctggactagaataaatttatgaaaagccaaacatacacattatgtttaaaaacatctctcttgatttttatattgctttctgggggttattttcaatattttatttacaaataaatgaaagtaggtttgctattaatttatttttatctttccacacatggtattggtgaattagcatttattaagtatagtttgtgtgtgtgtttcttaatggggtcataatgcaaaatgtttattttattgtggttcacagtaaaaaataaaatttgaaaacattgaaatgtgaacataaatatgtgtaaagtggatggaggaaattcagttgaacttttcattttattctgaggagaaagatgatgctttaagataatagtgatcaggtaaacctggaaggtatcacgttatagtagaaaaagcaccagttagactctgcttttatttgcaaggcaaggaaagaaagggaagaatcataatttttttacaggattattttgggggctacaggagacaatgttcaagagctagccagatgtctcatcaaggaaggcctgtaaaaccactgagggccttttggaaaaggaattgttgacttggccagattggcatttaaaaaaattaccctgataattgaagaaacaattaaaagggtggaagagataaaatatagggaacttttgcaatagcccagttgaaagaagttcttggtttgactagaaggttgggcagtaggaagaaatcagacaagcagccccaagaggctacatgagaaaatggaacaaaggactaaagaaaagctgtgatggagcccagcatgctgccaccacctcatccgtttgagacaaataggagagtcttgaactcacaccgtccttgcaactcaaccccaatacagcctgtccctttgtttgaattatatcatcacctcctacctgcagtgagccacaggactcatgtctgtttgaaactaatattatgtttctgcagacacctgttcacctctgtttggaatgagaatgaaaggaacctctgactacataaccatgaactgagccactttttctcactgcttccaaattctatagaccctgaatatccatcatgcctctagatatttatcatatttactcagcacatatttttgaagtattgccacattttcatatttcatctccatgcctcccctaaatattaggtggctatagcctaaatatttaataaaactgtggctcagtaaagttaggaaacatttttaatgtgacctgttagtagaacaataagaagactgaatccccagtttccaaagtttctttctttttttaatgtaattgtgaagtttcttgttagagggattcttttccaatgaagatgaacttggaagttccagaggtttacattagctctatcttaaaagttcataccattatatttgtgaccgtgtgccttctttgtttaatagtttatcattctactgcttcctgagagtcctaggaaataatggctaagtgagaatagctctgagaaaatcataaatgctaagacagacttttcttttgctccacagcttagaaattagaggtgatgctaaagaaaacagctgtatttccatctcacagacatctgtgtattctgagtactgtagtacagaaatcagatggatctgccaaaaagaactaacacctgtgagaaataaagtgtatcctgactcttgactatgaatcccatctcaatttatttgcttcccattactgatctctgtacttgtagctgcacatactattggtactacctaatagtgccacatttagtggcacaaagtgaacaattctgagaattgtacaactgttatgaatcttacagaagttcatgtttatcatattcattctattaaatgaggaaacagagacatagagaaaaacgtgcatcgttttaaagaaacagtgatattctatggtgaaggagtgaaggatgtccccgaatatgccagattggtatatgattgttttgtgtttaaaacagtggagaaattgtagattcagaaagggagagctgacctgtctcttcccgcagcggcaagccgtgaagattcctctgggagggctatccgagtcatacgagggcaagaaaatagctcttatcgccagagacctggaattggatgctgcaatgaacctgaataaagatacttaataaacacctatctttcacctattttacagccccccgcaaccaatatatctcctagtgactcctctagaaaatttattgcccctagccagcttttcttcatcctgtcatttcttttcaaatttatcattcttggtctaaaaagcataaaagcatcttgcttaggccacttctatggatttcactctcttgcgagttcctcatgtacatgcaaaacgaataaaatgtgtatacttttattttgttcatctgcccggtgccagtttagtttctagatccaatagaagagcccgctacgagctaacaaggggctttggaggtgatctgtggctccccttcaatggaaagaaccccagacctgctgaagagaattagattctaatcctgacgtgtatgtgtggacttcattgatcccttccatgtaatggctcatctccaggaaaattttagtaaataattgctaaatccctgtgcatccatcatagtctatcattttttaaaccagtacacaattgagttgtggcagaacattgattaaagttcattcttttaactctgacaccagaatcccataattaaaggagtttgggaagggaccttaactcttcttgccattccatcattcttcccattttaattttaatattacatcattttcttccatattgtcttctacccacggctcacacacacaagctatagaaaatatgtaattaaatctttagttattctgatggaaaataagttataccttttaactgtgaagttaaagttaaaaaacagaagtatttattatcataaatctcttgaatgtccacctttcttaaaaatatgccaaattatgcatggaaatcaaataaatgaaaatggtgaatgtacctgataagaagacttatcataataaaattctgaaaaatagacatctgcttaccctaataattcatcaccaaattgaattatataaattcaagtgcatatgacatggctaaaataatggctcaattcctatatcccatacatgaggagttataatacttgttaaaacaataacttttgaagagatcaaaaatcaaagcaaaattcattttgtgccaattacttagaaaatagattacttagggaaacattttaggcaaatgtgtcattacaaaataatacacaacgaaagtgaggtttggaagtatttgatactttcggggaaggacacgtaatgacaccagtagagtagaaatctgatgaaaattgtcccatgatggaaaacgcacattcccacctttttggaatgatgtcgatagcagtcttctaaagtgattcaggataaggctatatccacccagttagtccagaattcactccaaacattgaccttttcctccttctgtacttgttagatctgaaatcaagcagccttaaagcacacatccgaaagaaaattttgcagaaaacttaaccccgagaagttaggttatctgtcaccgtaatgtgctattgcaaaatcagataattaaataaatttactatgtat

SEQ ID NO: 805 - DNA, 135687 bp, Human
  misc_feature (1)...(135687): n = A,T,C or G
gcttacaaaatggcaccttgttgctgcatcctcagcaagggtcagtgctgtgtcttcacatagtggaaagaatagaaggggccaactgtctcctttgggcctttttttaaaaaggcactaatgcattcacaaaggcagagccctaatggtctaatcaccacttaaaggcacctcctcttaatactgttgaattagggattaagtttcaacatgaattttggagggaatacaaacattgaaatgattatacgtgtttatttaatcaagtatccaacaaaagcaaataattcaagccccaaattcactgcatctttagtagataagcagagttttaaattacgattgatctcctgttaggaggaatgcatggatttccacaagaaaaaactgtactgaggagaaactttccacagtaatgtgccacttttcagtcaacgacagaccacatatatgagtcccataagataatactatatttttactgtaccttttctatgtttagatatgtttagacacacaaatatcattgcattacaattgcctacagtattcagtacagtaatatgctgtatagatttgtggtctaggagcaatagcctaagtgtgtagtaggctgagccatctattttgtgttagtacactgtgatgttcagagaaggatgaaattgcctaaggatacatttctcagaatgtatcctgttgttcggtgacgcatgactgtattccatgagcactataatcactatcatagtaacacattaggagagaattctcatttctaaatccaatataatttatcacccattagttcatactctactgctttgattgcttttctttggttgtggctacctgcatacagcagtaaagtttcagaaaaactgaagtcgcaaaaggtcaattactcaatgaaggaaagataaaccattgcattgggggactagaagatacttttaaaagttctcagattatcaatttaatgatgtgtttctatgtagtgaataatgccttaaattcttgccaagagtatttagaaggaagttgtcagaagtatatcagctaactcattttttttttatatcactgctaatggtgtcattcacacattgtgcaacccataattccagatttaattctaccaaaaaatataggtcattgcaaaatgccatattaaaactgccaatgcatgacaggaagatggggatgcagacaaagcaaaggatgacaccaattccttttttaaagaagcaagatagggattggacaaaaaggctgagccatttttaatggatacttttgagggagtgttaattccaatttaattaaaatgatgcattaatttaaaattgggataactggttgccctcgactgcacctgggttgcgccagtgctctcggattaacctaattgtacagaggtgcccttgttttctaacttcatgcacaaagcattggaaattatttgtttgctttttcttttccaagtaaatctttttccagttatgcataagggaagtttgaggcaatggttaaaggcacttaagttataattattgctgttatcattaacattaagcacgggtatggctttgttgcaagttacccacctacacctgcaaatctctcttgctagcacacgccccagctctctccacccgcagtggtccgtggctggaccgctttaagtcactgagcgggctgggctctgaaggaggtcggtcccgctcctcccagacccaagcgtagggctagggaaaagctaggcgggaaggtcattgcactcccaggccccaggaaaagggcccagggtctcatcatctcttactttcgggcaaaacttcccacatcgcgaccttccctccctggggcactctgagaacacacccagtcacctagcgcgctccccagaagtcggcttggcacacagcgcaccccagcggccgcgcggcctccttccagccgccgccacttggcttccggagagctcgccgggcgctgccgccgccgccgccgccgccgccgctcctgggaaccaggggactgaagagcctgcgagagcggaacactgccggaccccgggtgggggggcgcagcagctgcgcctggccccgcccaccacacctgggcgcccgtagaaccgcgcggggcggggcggggcaggaggctggcctggcgctccggccgctttgtcgaaagccggcccgactggagcaggacgaagggggagggtctcgaggccgagtcctgttcttctgagggacggaccccagctggggtggaaaagcagtaccagagagcctccgaggcgcgcggtgccaaccatggagcgggccggccccagcttcgggcagcagcgacagcagcagcagccccagcagcagaagcagcagcagagggatcaggactcggtcgaagcatggctggacgatcactgggactttaccttctcatactttgttagaaaagccaccaggtaagaagaggacccacggaagacccggggctgatttctctcccctgttgaattgtgcccttcgttcacccctgttcccaggccctttgcttttgaagtaggtcctcggtcctgttacgaggtagaaacctcaactctaagcgagcacagtcgaaaaactcaagtgtcggatttgatacaacttgctcacaaagttcaaatacaaaaatgtacttgccgacctcccaccctcacccccgcccctcttggtattccccgggaacatgattattttcatacatccgtgctcacgggccttcccctagcccctctctagccctctggttccccaaaatccaatcagcaaaacccaaacagtttctgagccccttccctgcagctccggaagcaccatttccaagtcggtcttgatggctccgctcctcccccgtcccccctcgccctggccctggctgggcggggaagctggggtgagggacgagtccacgggacagcccaaaggcaacatgacggaaccttgccaaagtgagtgcggtcgccttttccccccttccagtctcctgcttgtcccgcgcgcctcctttcactcgcttttccgccgaaggctgtgccgccaaaagtagagctctgcagaggggtttgcggcgtgcacacaaagggcgcaggggaggcgccgcctggagcggaccccaaggggcagcgcagaccccagaggccagctctttctggtccagagccaagcgccggggcggcccttgcggagggcggggaggagggagcctgtccttttggaggcggctgcgcagcgggcagtcggggcgctcgtgggaaacgctcgcgggagagttggggaggaattgagactgggagcagagggacaagaagagtggagcagagagtgcttggcgggcgggtgccccgaagcctgaggaattgatgcatagtcggggtgcgtggactccaggacgcgcccctttgcagaaagagtccgtgccccgctgccgcctgctctgggcagcggccgtcgggcagcgggtgctggccgtcttggccgggagggtgacacacgcccggcagtgatggtcgaggagcccgcccgggttcgacgcccgggtcccactcgccggcgcgcggccgcggctctgccggtcgctccccgccaggggcggcgcacgcggtggcgagcgggaggcgacgggcggcggcgcggaggccggggccgtgagggagctggttctgagtcgccgacctcacctcacctcacctgcgcgcgttgttgcccctacggagcctcctggagtccaggatcggcggagttcgaaaacgaacttcccacgtttgctatgttgccctttggagacaaaacaaggtacttccttcagcatccccctacgtcccttcccactttttccgggggcgcggcgggtctcgggtgctgggtggtggcgccccggtggcaccagtgggacgatgtatcattgaaaattgactgtataacttttgttgttgttgttattctttgctctcttgcagatgtattaataagggtcttaaattgggccctttttaatcttgttttgttttgttttgttttgtttttttcctaaggaacatccagagttggtgtcaatttagtcactttcagggttttttgacagaggggaaggctccgggattaatcttttctctttaataacccagcccttcttttaaaatcgtcttcccccgctttcaccttcttccttcaaaatcctaaatcttgagcgcccagaggatagccctgaaagggcattttttgcgagtttagcgtgagacactaaggccatggaggtctagaatgatcggttgctgtcgactaacagttttcaggggtcacctgcccctctgaggccatctgcacccactttcctttcactctgcgcattcccagccttctgctctccttgaattacagcgcatagaatgatcagggggccagagaaccaggccgatttttaaaagtatgtattggacctgttctttaggcagattataaacagtttaaagaaaaaaagttattgtttaataaatcagcataaatgtcctttcttcgttccctatttttcttttaaagatgtaaactagggatggcttgttggtcgtttttgactagtcatagataggaacactgcattttcagaacctaccaacactttgaaagtgtagcaacattttaatggaaaataaatggaaagagctgagttacatttcttttcccattactttttctcccaagcagcataggatcaaaatcctatttctcaaatttaccatgctcactgtaaaatttagatcatctgaggctctaaaaaaacttttaaaaaattttcggttagagtttttaaattacagttgatgttggcaacaggctgaacactttctgtgatatatatatgtatgtgtgtatacatattcttaagaggttatgttgagtgtaagttggaaaatgaaagtgtaaaatatttaatagtgcaggtcctcaattttaagagttataataaagtgctgagagttgtcagagtaaagaatataacctaagaatttgtgtgtagccagaggtctttcatgaaacaatattccaatttggttttatatttggtggcattaacaggagacttaaaatgtgaataagaggatggacatttgttgattataaaaatgcaaaccactaaccccagtgtggttcacattttgtggtaaaaacttattgcatacgttttaactttacagctaaggatttttttttttaaaagtaggagctcacattactttgcttttcccctctttttacactttgtaagtgtaaaatgaatattgtatgtgattcaggaaacccatgaaacaaaatagttctgtagatgcatgcggcatgttttaagatttaaaatatatttatattcacccagatcgtccatctgcaccagtaatcaggcttgctgataaaaacaatttctgcattattgttgtcattcgacattcatgcatgattttccatccttttctcagactaaatgatctacactcaatggtagttattgaacatcaaggttctggcattcctaaattctcaaacacctgtgaatttgggttgaccttgaaagcatttatgccattatattacattgtttactatcactgtcttcaagtagagagctacgcatcttattaaaagctataggttgggcctggcacggtggctcatgcctgtaatcccagcactttgggaggccgaggcgggcagatcacgacgtcaggagttcaagaccagcctgactgaccaacatggtgaaaccccgtctctactaaaaatacaaaaattagccaggcatggcgcgcgcctgtaatcccagctactaaggagaatcgcttgaacccgggaggcagaggttgcagtgagccaagattgctccactatactccagcctgggcaacagagtgagactccatctcaaaaaaaaaaaaaaaaagctataacttggagctttttagttatcacaacctgtttatgtccatttgaaggtgtcaattgaatgattcagaacatagtcggttggcataaaaattaatttgaggccaataaatcacatctggaaaactcccaggtcactattgtagacaatttgcagtcctgaaggcctcagctactgtgttaattgagggctttaatgcgtatgccttttacaactgaagctttcctggtgctaatgctgcttaacagctgttgttattcttgacagcatattagaataaagttacctttcattaattactaatcagctctgtgattgtgggtgatgttttaggtcatttaatattgttaaggatgacatgattgactttattgctttgttttgtacaggcaaaagctcgagaatatttggcatatactggaaataagagatattaagtgagggcaagtttttatgacagcttggatcaaagtccagaaacagacgttttacactcccatatagctttctatgatagactttatttgatactgcaaagctgtgctgaattaattgaggttcctggtcctgtgtttggaattccgtccttcattttttttccttgtaattcttctctcacttctaaaagctgtagcatttttattgcacggtatttacaatacaatcagattatgtatataaatattgctatgtatttttttaaattattgtttctataattatataggaatataaactttccacaattttcagacaaatgaattgttaagcatattttgtgaggcagttgttagtgttgatgataataaaaccctctgagcattgacccagtctaactttgatattgtttatagtatttttataatggtaattctggtgcaataatggcctttttttcttatgttgttcataaccagggtccatataaccagctctaagctgcttttagtgtccttgaagcactcttctggattgcattcttcctgcctggagaaatccataggagcccctgaaataatgtttctcattgctcttctatctctagtgttttcaaagtttcaaattcagacccatgttagagcctaaactacatgattcctaaaaatgtggtagaattaatgcaatggcaattagtgtagatggatatcttcaaataaatcgatttgcttagtataacacaaacttaaataggcttgtggtatcattcagtagctttttttcagtctgtcatctgatgatctgtagaaattgtcaatattttcacacgtttatgtcctcagcacctcaagatgaggaaatttttagtattttgattatgctatgcaaccaaatttcctttttaaattattctgcttaaataaatgatttgactctggtctcaagtattatttcttttgaaatatttggaattctgttaaggttgtataggtaaagcttgtagcttcgcccttatctgattatagggagtgtgtcctactttgaggcaccccttcctctagatttgaaaatacaaattaacttagaagttaaacctataattgctgtgtcaagctatatttgttctttgttccaacagccaattgtgggataaaaacctcttcctaggataaaaaaacctttagtaaggactgtaggacaattaaataaatcaatgagttgattgatagtgaagggttgaaaaatgactaatttgtgaatttaggatgcagactagttactgactttgcaggacttcctatgaaattagtttagctgcatagatgtagattcagttggccactattacagctggtgaatgtggcttggaaatatctgttataccaggttctcagggaaaagtgcctgtgagccacatacctaggaataaaaattgaagaaagtctttccatatgagtcattcatttgatatttagctctgtaatcttatttactgactgatattctcgttttaaattacttttttttttttttgcaatgtaagtgcttaattcattttctctgagtggtaggaatttatatttgttgccaaccaaatgtttaaggtaggtaaagcaaactgagtgttaagtttataagaatcattttgataaaaattctaaaaatattttaaagctttttttttctttctttctttttttttttttcgagacggagtattgctctgttacccaggctggagtgcagtggcgcaatctcggctcattgcaagccgagtttacgccattctcctgcctcagactcccgagtagctgggaccacaggtgcccaccaccacacccagctaattttttatatttttagtagagacggggtttcaccatgttagccaggatggtctcgatctcctgacctcgtggtccacccacctcggcctctcaaagtgctgggattacaggcgtgagccaccgcacccggcctttaaagcttttaaagatatattttctctggtttttagtttgcaatgaaaatgcttttaaatgtcttatgtaccattgttagattttttaatcttcaggagaggggagacttttcccttgattctgaattataaagtaagattaactttttgcaaattttcttctctgaataattgtattttacctaaaatcgggagagaaaggatcaccatttgatatcatgttcatagtgataattataaaaaataagaattatcttctctacttttagttgaatacctatactgaaaatatacaaagagagaagaccctgacattctgagctgatgaaataattaaaacacacacacaggatcactgaaatttagagttagtagggatcatataatctcatttttcttttctttttttttttttgagatggagtctcgctctgtcgcccaggctggagtgcagtggcgtgatctcggctcaccacaagctccgcttcccgggttcaggccattctcttgcctcagcctcccgagtagctgggactacaggcgcccaccaccatgcctggctaatgttttgtatttttttttattggagatggagtttcaccttgttggccaggatggtcttgatctcctgacttggtgatccccccgcctcggcctcccaaagtgctgggattacaggcgtgagccaccgcgcccggccaatctcatttttcaaacttaagtaatgtactcctattaaagaaagacattctttttgatttacaatatattagaaagcttttggttgcaagtgacagaaactcaacttgaacccatagagaattgatgcacataattttaattgcttgcgggattgggttagctgtgaatttagctaatcaaataatgttgccaaaattctgtctgtctctgtgtctatctaactatctatctgtctatctatctatgtatctacctatctctatttatcttttcatctatctactctgtttacctgcccttccttgcatctatttatctgtccatgtatccatttgttcatgtattcatctatccatgtatcttttggccctgtgctgtgttggctttattttcttgcatgctttcttcatgtgctgagagtttctacttgttaactgtatgtgggtcttaaacttctgatattagagaggtgccttcttatccatatcagtcttccccagattaccctggtctcacctgggtcacatcccaactctgaaccaatcattgtattcgggagagtagggttgtttgactgttttgttggggcacgtagcccataaggtgatatatcattggggagggtacattcccaaaagaaagtgatgtgggcagacccagaagttctagatgtctaccataactagtgttgacttccttttattttaatgttagtgaagtgtggaattcttagaagtagaataaataaaagcagatataatttaatcatagttacaacatttatgcaactgtaatgccaaaatacattctcagttaattacgaacaaaatgataaaaccacagccaaatgcagatttacagcattcattaaaacactcttgcaaagtagatatggttctaactatctgaaaaacagtatggtaagtcagctggcctttgctacaatttggcctataatgatttcacttctcccactgggtctctctgaacaatcatgaaacttattcctctagcacagcataccagctttcattttttacttgctatgaaggcatatatgcatattaaatttacgtcttttattttctcattaacacaaatataaaccttagaactaaaattgcagggcagtagttggtaataagatggtcttcccagtaactgaaagcaatttctttcactttcttttgttttgattatgattattgtgaaaatataaaattagaacattttatagaacaaagtaaagatcttcaaaacatacttgttttgaattctgtgggctctcaaacctcagataaatgccattgtagtccagtctctcccatatctaaactgcaaagccaactgatttacatgtttagtgcatagatttgagttattgttttctttcagaagtggtaggttttcctttaagcaacttcttttataccatgtgttgtgaatgtacagaaaattacaaaatattttgtcccttccaattctcagtcaaatttgaagttaaaatcatatgaagcaattctgcattttaagcttctcagatgttttcatagctggagcaaacttagaaatactaaataactttgggcagactcttcatttccttaccatgccagacccaagcgaactactcactgtaacatcagagtagaggttattggaggatatcacttagaggtgtccaaaatctcccgttttgtttaataatagtctgttaatctcttaatcatctaaaccattgcttctcaaaagaagatgttggcatttggtggtgacacttttttgttgttagaggctgtctagtgcatagcaggacatttaacatccctgaactccagacactaaatgccagggccacccccatccatgtgatggaaaatctattcccacacatttccaaatgcccctcaagggttggcaccactacttgattaggagccactgttgtgaaccctttgaaattgatttctgtttatggtgaagggccctagataggacagccttaggcttcaaccccagacctacttttctaagaggaagactttaggtgcattatttactctctctgtaaaatggagataatgtcatttacctcatagtgttcattagaaaattaaaggaaataatgcatgtttccttatctttttagtggtaattttcagtagtttaccattttaccttgagcatcatcagtgccttaaatgtaatcacaaactttgataggcatttccttatcctggtagatgggaattaagttctgacagcatagtgatttcatagactttaaatgtcattttcattttttagatgaattttattaatggttcgaacagaagtttttgtgggattgtgtaaggtactggaaagggaactggaatgggagcccagacccccagattttgtttccagctttgctattagctaactttgtgactggctcaagttaatgaacctcaaactttaagacgggaggtgaaagagggtgaagactcaaggcggagagattcataagtgagcttaaaaatctctttcagctgtaagagttcttttttctcaccaggagagccgagtatcagtttctcagattgaatagtttcattcttttaagtatttttccaaatttgagtagtggatccaggtcaaattatgcaaacaacgtaactgaaactgtataaaataaggatccaagagcaggaaaagtagccaacataattttttatgtgagttattttgtgttttccctaattttagcagatttccatataagttatcaatcatactttccagtcagaaaatttagtatactctttgcaatgctggtattagtgattaattcacatgactaatgaaaaaggcattgaaaagagaaaagaggatggcattttagtagctgacttataaacacaaaaatacaccctgcaaatctcccccaaaagttactgctcaatggacttgctatatggacatttttgaggtccaaggattggtatcaccctacttttaggatttacccaagtaagtacccatggataagaactaaaacagccaatttaatccataaattacctatagcagagtgttaaagcgttgttttatcagatattaaaactgtgctccagtttagaattatgaagtattgctatggtgttcatcataggtaattattgtattttttttacatttgttgtcaaacagttttaacttttatattttgggaaaaaatagtccccaaatctataacttatttttgacaaaaaaaaagtctctaagtagtactgaaaaaaacaaattatattcttgcatttatttttttcagttaaatgtttatcacctaatcttaatatgaaattcagaaaattttgttatatgtaagtgtagatattagtctgaggagtccattttttaaattgtaatttgaaaaaatacatgaaaacagccctctctcttttattttaatatgaaatacctctgtagagaagttattgtttttaaattaggggcttaggaagaagcaagagccaacatctacttattctgctgtataaatccattaaataatttttctttatttaaaaaaaccaaaaacttaatcagtttaaaaaatatactccacttaatattcagttaacttaaaaacaataactatcatgaatgaaacactgtgtatctgactccagcatcatttcctttacttttatcatgatctccattttacaaagagagtaaataatgtacctaaggtcatattcttagaaagaggtgattctggggttaaagcctaagtctgtctcatctagggcccttaatcactgtgctatactgaaagtcagtgtcaatattaatgcaagcaaagcaaaggctcatagatttaatgtcatgaggtttctaactcaggaagaggttaacattttcttctacggcctctttctgtggaagcacattacttaatgatgtgcctaaagactgcccaagtgagtttagtttccatatataatttcagagtataaaaattgggaaatctcaaatgacattttaaaatagagtggttgaaaatttcggtactaggccattataattatctttttagcattagaacacaaataccctagtacagtatattttcaaaggatttttatcctttgatacattattttaggccagagtgcaaaacgtattaaactagttgctctacgagtaggtttcacctagttatacttttaactcgtgagggttattatgtttatatcaaaagtttactttgccttgtcaatttttcttctcttttccttacttttctagaagccaagaaatattctataaaccttataaaatattttaattaattttccatttcaagacatctggaatattgaatatgtattttaaagcctttctgtctttttcaagattcattttgtaatgtgagtgagcagttccactttggtagaaagtaaagttattgccacagggagacccttcggacacagacacgtgtgtgcgtgtgtgtgtgtgtgtccctttagctaattatatttgaaatgcagttccagggcttgcatccctgcatcctgtcaacaagttttgtagtcctatttaatacttctagatagagggcatttggaagaagccgtgacttgtgtagattagtggaaaatttctaaaaacccaaaacataaggtgtagttttctattttgtgataggtttataacaatcttgagtggaagcgataaattggaaaggggggaaggttttgattcttcccagattatatgccatacagttacatttcatttttttcaatgaatattattaatcaatttataaactttttagagactatgagatgaagtgtacccaatatgcaatacaaatctatttaaatatccataaaaatgtattacaatactaacttggcactatttaatttaatcattaacttaattgagtccatcattttaagagtgccacacttttcatttagttacaaaatatgagcacatagtatgtgtaaaatgaaatagcattgtatttttgccgtgtgtaattttgataaaataaactctttgttaaaactattgtaaaagttgataaccattcaccttctaagcttcctaacctccagaattcctttttttttttatcattcacgaatgaatttgttcatccctttgtattactaaagacacaaaatgtctgtcaactttcgccttttcctgcagcagctgctggaaccagggtagtgcacatgctcattagttttgctgggtgctctactcacacaataacatcatcctcttgacaggtgcggtgctgttagcttcatgaaatcaaaatgtgttaaacattatgcttaatgacactgatttttatattaaatcattattttataagcagtttgagctgcaagagtcttctgtaaagtagaatatctggataataaacttctgatttgattcattgtgtaaagagtttcgagagtaagatttgagtcacatttatgacaagagctcaaaaggttttaggcaacttccatttggttttatgtcctaccatctaattaatatgaattttggggttctttgcttgctccgtatggaaaaggatatcttcgtgagccttaagtatcatctgtggaatatgcaagtttgaaacaacaggttatatcgacattagtgttatctgaaaggaataacttccaacggtgattttggggtgcccaccagggtttcttcgtatctcaggatgtgttgtaaaagtttaaaagcaaaactaaattcactcttgttaaaagggtatgtaatacaactcatttatgggtaagaattttttgtgtaataaaatatgtaggaaataagtgattggaggataataaaagattttggtgagaagagaggaagatatggatgtgatgtaaaactcaggctcttatcattgactataaattattggcttcaatgttcattgcattttccatggctgtggctttctttgaagtgtggagggcctgttgtctttcattaatagctttgtaaaagttaactgaaagacttcaagagggcagctaggctttcttctgattgcttccaggtttgcagggcagttagcaaagatacacttatacatgaaagtggagagtccagattattagtacttgtggtaaaagctacagatgcttcaatggaatttgtttctgttttgttgtttttgctcagatggctatgatgtaatttaaactgttctcttttttttttcttttttttttttgaacttagtaggagtctgtcaagaatgccattctgaagtatttgctttggccaaggacttttgagtgttcatggtgcatgttgctggcctatatcccaacccagttagggcccctcaacctgtgggcttgtatcaccaaaaacaacctttttactctcatcctttttctgattctcttggctgacctttttgaggaaataacagccattgctccttaacccagccctttgtcttcattggaatgagtactaagggtgtaagagatagcaaattcttagatatgttgaagagatcttgaaatgcttccatgtgcattttctaatttgactcacacatcaaccctgtgcagtgagtgaaggagccagaagacttttcccctatttaaaaatgaggaagttgaagggcaaaaagaagttaagttgacagacccaaggaccacttcttgtcctattcatactgcaaactgtggtggggagtcttaatagcctgttaatacagcagcccatttttaccactgaagatctcaaactccagtgaaaatgaactccagagaagttgtaattgttttagcatcagatccatgtagtgttgtagctggaactagaattatcacctgattgttagtctaatattcctgactttatactctgctgaagacagtcagcaccttacacttcataaaaggccagaactggtgctatttttcttgttttatcagggataaaatggaaactcaggggaagaaaattgcttagtgctagtcacacatcctattagtaacaaatgctgagattagaacccaggactcatggctgaaagtgcagcctctcaatgctttgtaatcccaagaatttttgtcaattagtaaatctcccttttataagtagtttgcagtttgttttgtccctatgcaatacattatgtgggatggttttagagcaaaatgaatgaacttgatttaaggagatattttatgctctagttttattgcaagttatgaatccaagtgctttcaaaaggttcaattatcatacacaggattactttgtggtagtcctttgtgcgctctcaatgataaaatgagcgatttgatagcctggaacttactagtatgctgcatagaacctgccttctctttgttgcctatccgccaacaatttcagttaggaaaagctatgtagaatgactggagtggccagatcaaatacaggacagccagttcatcttgaatttcagatactacttatactgaaaacttattcattatttatctgaaactcatttttagcaggttgtcttttttatttgctaaatctagcaactctggggatgactttttctcgaacacatttattatacttcttttcagtacattgctttagacttataaaatgtgacctgttttcagagaaacatagatatgttggaatttagttagattttttttttatggacactatccttaagaatctttgttccctgagtccttagaaatagtgtttttaccttaagaaaacagtgtgtggtccttttatgacctggaggtaaaggatttcatttgaacatgtgtcgtaagtcatctttctctatgccttctctgcttgaatttgatttttacttctagattcagctagatgttacggagtgccttcttcatggcaagcactgatgctctgggaacttttatattcttaatagggtatagtacctggaataggaaacctggatttgattcctggtgttgccaccaaatagtagaatgggtgtggttcagacatttaattagcttcatattttagaaagtaggaccattaatgcctgcctcaccaggtttaaataaaattatggtttttttttcagtagcactaatgtgaatatttttcaaaaccccctagaattaataaagggaaaggaaaatagaggtcctatcctagaccatcgaagtgattacccagtcagaactactactgaggtttctggatttccatccgttgctttctacttttatattggacatgttcacaatcatcttttccgttacttatttgtgtacatttacctaacttcatatgccagaaacatccaatatgtatataacttctgaacacaatataaacttttaagtttgaaaggaaagatcatgataatttttctggagttgctcattattctgtccctggtgcccaatatagtaccttgtggaaatctctgtcttatgggaataattcgttccagaaaaaaaaagacaattaaagttaattctatcaaaatagaaaaaagttcatgagaaggttttggttggagctttatcttgaaaaatagaaccacagattatgaaaataagtttatatttgagctattaataataaaattgagattgtaatgacactctgctaattcttaggatgaaactctgctaactctgttaaataaattgtaacagagtgtagccataaacaattatcttcagttcatgtttggcttttgcagcagggtcataaagataattttctccctaaactagttttttgaattaatatttgaaggcttcatcagctttgcccaaggggctttcttaattcagaatataattatttgactaatattctctttgtgagtatctgctatgtcattatccttattgattgtttcttcaattgttaactggtctttaattgggcataactcttaattgtcagtggctttgtgtaatagtagaaggattctccaacatcactttagtctatgtctagaaaatctatattgtcttagtccatgctggctgctataacaaatagcttagactggataatttataaacacaaatttgttgctcacagtttcagatgctgggaagtccaagatcaaggcaccagcagattctggtggaggcttcttcctcatagatgtcaacttttatgtgtcctcacagaagggcaaaaggagttaacaagctcccataggccccttataagggccctctaataggttgttcttccattgatttaaagaaatacccaaggctgggtaatttataaagaaaagaggtttaattggcttatggttctgcaggctttacaggaagcatggtgttggcatctgcccagcttctggggaggcctcaggaagctttcagtcatatggaaagtgaagtggaaacctgcatatcatatggtgagaaagttatagcaagagcaggagcaagaatgagaacaaggacgggatggtgggaggtaccatgtacttttaaacaaacaacttttaaacaaggccatgaactcactcatcatgaaggggatggtgtgaagccattcatgagggatctgcccccataatccaattacctctcactaagccccaccttcaacactggggattacatttcaacatgagattttgaggggacatccaaactacatcaggcactaatcctatttatgagggcagaaccctcccaaaggccccacctcctaatactatcaccttcggggttagggttcaagagaagaattttgtagggacatacattttagaccatagcatatgtcttatataagaattttaatttcaatttgcaggtgatttgtatttgcatacagactgaagtattttttaaaaatcagtggagtatagatattagtcttaagggcaaaggcccacttcatttggccatatagattgtgcactgcagaactccaaggaatgctcaaagggaaagatgtgtgagaaatgatttaattttatttgtggttggttcatcagtgattttgatgttatgataacatgttttcctctgcaagtatgtaattacagggactcagataatcaataatgtagtcatgagaactctctttccctaccactggtggttaatacggattgttgattgactgactgaatatgctacatctgcttttcctatgtcatttaatattgagttaatgtctctaagaaaatatccgtaagcaacatttatgagacaaatagagtaatcacaaacacataatgtagaacttttaggcactggctctgcttaagacatatgctgcaccaggcactgcaagtatacaagcataaattagtcacggtcagttgtgagacttacacatccaaggggtgatgaacagtaatcgctaaaacacaatgttgattttctgtaataaacacaccagcatttagatattcaaaagactgttgtaccttttgatgcttcaggaggcttcatttatttattcatttacttcaagaaatattttgaggacctactactgtatgtggtaagcattaatctaagtacaggagatgcagcagtgaacacgtagcactaatgaaatatctagtcagaggggatagatgatataacaacagattgataaacaagaaaaatagcagatagtgagaatttaaattatgtaggataagaacatgatgtgtcaggaccactttaggtggagcagtcagagatgacttgtttgagcaggggatgtggaagtggatcagccatgtgccaatgaggggagagcatcccagacagggcagttagtgcttggtgtgcttcaggagcgccaaggatgctggcatgggcgagaggaacctatttgtaggggattacaagagctcaggttttattctcagttcaatgaaaagccaagtagggtagctaagatgttgacatactttgctgaaaatttactgtggctgctgtgtggagaatgggattgcaagggggtaagtataggatcagagagattaattaggggactatggcaacaatccaactgagagatagtggggtttggaccagggtggtagtaatggagatagaaataagcagattgggatataggattttggaagtcaggttgacagaacttgactgcgcaactgaatgtgagagttgaaggaaacagaaatttagagtaattcctacgtgtttggtttgagtaactgtggaggtgatggtactccatatgtgggaaaactggcaggaagtaagatgaggcaaggtgagatgggtagggtcttaggaattctgttttcaccattttaagtggtctagatatccacgtggagttgtcaagtaggcagtttaatttaaaattcaaaaggagatctccatttcccgttgagaagataagaaataagttggggctaagttttgggtttgtggctgaaattgttaaaatgtctatttttatatgatttaacagtttagtaacatgtccatatttaaaatcacatcagatatgttaacttagacatattgcttttttcctgtcttatcttttccaaacagttttatttgaaagcttcctatgcactgttggcagcttcacatgcatttttagcatcagtgtctttggcactattagtgcaattctgggggctacataagcaaatcccagagtgtgtcaccttcacttctaaggttttcagatactgaattattttaattaatgtatgttgtcttcaccggaaattttgtcctaagtcacagcatgcatctatgaaacattaggacaattatatgtttttaaaaatctgtgtaggtatatgcttgtgatttgtacagtacacttacctaccacattgcttttgtgcttcttcaaatttgtaatacctctttattagaaagtcagtcaattcataaggccagtgatgttgttttcctttaaattactcattggatatttttaaatttattttttaattgacaagaattttatgtatttaaggtgtacagcatgatgctttgatgtatgtatacattgtggaatggctaagtcaaggtagtttacatatgcattgcctcatacttatcgttttttgtggtgagaacccttaaaatctctttcagcaatttttaaatatacaatacattattattaactatagtcaccatatttacaatggatctcttgaacttatttctcctaaactttttggagacttttataactgtattcaactcttgaaattataaggggggtaatatttttatcttttcattttgaccgattacattctagatggggtatcatttcagagtaatgtatatttaacaaataatacatcattgttcaaaatgaaataattaggggaacatcccataaatgaaagacttagtaaagactcagaaataagacagtgtgttcttttcaaactcttttacatcttctgttttcacttaattaattcatatcatacatatcagtacatataattatgttttaatgtctgcctagtgttctcttgtataagtgtgccatgatgtatttagtcagccttctattggtgatattagtttgcttcttatctgctgtagcaaacgtacttactatatacagtaaatacccttgtatttcctttgtcacatgtgtaaaatctctggaacaaaggatacatacatttaaaatttgttagatattgcctatttttttttatttttttttttgagacggagtctcgaactgtagcccaggctggagtgcaatggcgcgatctcagctcactccaagctcagcctcctgggttcaggccattctcctgcctcagcctcccaagtagctgggactacaggcgcccgccaccaagcccggctaattttttttgtatttttagtagagacgggtttcaccatgtagccaggatggtctcgatttcctgacctcatgatccgcccgcctcggcctcccaaagtgctgggattacaggcgtgagccaccgcgcctggcctaagtaatatcaattgttactacaaccaaaaactttggagagtgactacatccctatactatctccaaaatagtacattgtcaaacttgtttatcctggacttttgtttggtataaacagtcaattatgtcattgtagatttgagattacattgctttttgtataggcaaattatttgaaatatcctcagttatagcaactttttatcttttgaaggtaagtttgagttttctaaagcgtcatgtcttatcagaagatagagaattaagttagctgttaccataggtttttttgtttttgttttatttgttcattttgggaggaggagttagtgagaaacaaggtctaatttttagataaaattagtatttttatttggattataaattgtttcagaagtttgtttcaaaagaagagttccaaaaatgtctagagtaatgacaccattaactggtgtaagactacagcgttctaaggggaattatttgaattgaacaacatgctttggattgtgtatgatctggtatgtttgttttaaaaagtcacctactgtgatggctttagctcaaatgagtttctttcatagtagggtacattaaaaacataaatgccttcagttttcttggactgcagttttaaacttagataaagcctactttaaaatagtcatagataatctagaaaaatagatcttttttaccattattaaacaaacattattgggataatatttacagaagtctgatttttctatacaagattaaattatttgtttctttcattaatccttctaaacttatctacttttgcaatatagatataactatctaaaataggcatagtagcaagccaaatttagacaaatatttgttttagttttcaaatatttaacttcagaacaagttatgtgttttaaacatcaaattaatgtgcatatttatattttcctaaaactattggcaaatttagtgtcttttactttttaatataagctaattttgagagaagcagactttatgcttggtatgctgcaatcagatatataaagttatgtatatagaagtcagcctttattaagatgttcattaaagcaattgtcctctattgttttccaaaataaaattgtcttttttttttgagagagtctcactttgtcacccaggctgaagtgcagtggtgcagtggtgtcatcatacctcactacagcctcgaactcctgggctcaagcaaccctcctgcctcagtctccccagtagttaggatcataggcacatgctatcatgcccagctaattttttaatttttcctagagacagggtctcactaggtttcccaggttggtctccaactcctggcctcatgcagtcctcccacctcagcctcccaaggtggtggaattacaggtgtgaaccactgtgcctggccaaaatcatatgtcttaagtaaaccatcttgtttttattttctataacatatcaaattattatctcatcagtttaccatgagaagatgtttaggagctctcaggcatagcacccttcctcttcaagtatctaatgtgtctgcacgttctgttctgcagagaaatggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggtaaacaggggagcatgagagcaggaccagtgctggggaggggactatggctggggcgggtactatggctggggcattggatagcaatcatgaatggtggggatatttgaaactgagatgtaataatttgcatacttatttaaaactggaatgtatgctaagaattttcccatctttaaatgccagagtttctttcctggtggttcagttgaggatatgagccttaaggaaatctcatcttgtttttctccttaatgataatttaatatagctcatctcatggttatattctcccatctttttatctgatcactatacatatccccatctatgttatccccacatgaacctcttaggattttactgagattctaaaatgataggtgcaaaaacaaaaaaaaactcatagtctcttttcattcattcattcaattaatcatattcattcaaagtcccattgataccaaagtctggttttctttctttctatcctctctttcattttttaaacagataaacttacagatgtcttcaaaaaaatggaaatttttgctctaaaagttttcaatggaaagatttgttatttcttctacttttgctatacctatgcacaagtctttaattaagggcttaaaggttacactgtaagattcttcaaatttcccatttaaaataatcctttttattaatggaattttagttttaaaaccaagcatcttaactgaatggcactttatatgtttatgaggtatcttacagcatcttgatagaacaattgttctagctttctactgtgtggtacactataaagattcagtggtaattctggcttagttcatttaattcagagagtcatagctgttttattgtgttcctggtgccttatagtgcctggcacatagggcttagtaaatattggttgaattaaaataatagtacatgcaatagataaatagcatagagagcaggtcattaacagatgccaagaaaaatgtgataagcttcagagaagcaggataggacatctagtgggaaagatagagaaaatttctttttttttttgagatggagtctcactttgctatccaggctggagtgcagtaacgcgatctcgactcactgcaacctttgcctcccagattcaagtgattctcctgcctcagcctcccgagtagctgggattacaggtacccgccaccacatctggctaatttttgtatttttagtagagacggagtttcaccatgttggccaggctggtcttgaactcctgacctcagatgatcctcctgtctcagcctcccaaagtgctgggattacaggcatgagccaccatgcctggccagaggaagatttctttgagggagcaatgtctggtacagatcccggaaaatttgaataaattgaataaattgagatttgtgcatggtgagatccagaggtaaagagaagttagaagagataggcaagtaggaccatgtaagtgtgtggataagaatctggacatgaaggagctgtgggagcacagccaggaaattagaggtcttgaatgccaggctgaggaatatatatttggtttagaaacatgaggagtaactgaagatgttttgaaaggggaaccagtatgatttaaattgtgctttggaaggattaattttacagtagtcataaaatgaattagaggggaaaatgctacaagttgggaggatagaagattatcttaatagtctaagtaagtatgaggaagtaaggaccttaacaaggaccttggccttaaagatcaaaaggagggaatggatttcggatgaagaagtattaggttggtgcaaaagtaattgtcattacttttaatggcaaaaactgcgattacttttgcaccaacctaatagaatctgctgaacttggcagctaacaggagatgcaagtgaagggaaaagaggagttgaagatgacccaggttttgaagctgggtaaatgaataatggtactactagtgagtaataccgagggccgggatttggggtgtgatacttcatctaggttaagtcctgaaatgttttttcagaatccattctatataagcaatgtgttcaattttgattctcttggaaaaatttactggtcttcatagagtatctctatgacctctttgagctctgtaataacttcacactgtagcagattccaagaggggtattaaggacacagctgaaggattgctgccaagtttgcagaatccccttcctgtcttaagtgacagctgggtatccacttttcaatggcactatggtcccaagagtacagtaggatcataaatattctctagctttgttgagaaagtctttatttgtcttcatggtcctaagtgtctccagccctgagaattcttcacttatatgtgttttatttaatctgcctaccatcttcaaagttttgacaatgtattttctgttttgcatttgataatgatttaattcttgtactattgtttaaaacagctagtgtccttgatttgcactgctcccagggtgatgcctcttagcctgtggatttgtcatgttgctacttcacatttggtacccttgatctgtatttatagtagccttgcaggagttatttcatgtcccaagaatttcattagaacttgtgggggttgatctgtgatctaatttacattgtgatctaatttatattgatattagcagtggaagtcagttggctaatggataattcattactaagcaccatccataatttgaataattaaaatactatgttttttgaaagtagtcaggatatgaaaatatattctaatgttttctgagtcctagctctttaaacatgcatctgtaaaaatgacactgtatggcagtatttcttaagcttatttgatcgtagaccactttaaaggatgtaatgtcactgtgggaaaccaagagaggtgtctgtgaaacagaataatactcagattgatgctgagaattttttttaaagtctcataaagttaattataacaaatgacctatatttagttcacttttaaaactttgtaacagaaaatgatataaactgatataaatttgaaaaattctatagttttattactgataagaaaacatattcgtatattcaaaatacaagacaggatccactactcagaccagtgattctcatgtagacccataaataccaatgaaaagattagttggtaaatgctacctgtacattgatgttcagtcacacacggtctcatgcatcagcccaccatcatgcaactaccttcaatgtgccacaccatgtatgtatgtatgtatgtatgtatgtatgtatttattttaagccagagtctcactgtgttgctcaggttggagtcctggattagctgatccactcacttcaactgcacgagaagtggctatggtcctgagtaggtgggaccacaggtgcatgccactgcagccggcttggcacggcatttatgaataacaagaagatattaacacatttattaataagatattaacacttatactaagaagctattaatagtaagatatataatcagaactactatataaatgtgcttggtattttccttttataggaaaaccagataacatccaataactacacaggattgccctgaaccccattccatgtcctgaggaagtcttaaaccttcccatgattcatatgtcttaaggatttacattgtcaaaacatctctccttctcccaagtcaattagagtgcaaaactcagactcatgtcctgtttctactccaggacagacactccatgtgaaccatgatttctagagagaaaacttagagggtcttagggaagggtcaaattgccacttatgtggccttgaccatgtagctattattccttccttccccacttcatctttccctttcatttttatttctccagagaaacaaattttcaccttctttcaccatgcagtttcttactttctatttcaactatttatcaatatatttttctaaagaaatacgaattgtttcaactgaatttcagatgattatttccagatgaattttagaagaaaaagaaaacccctagcaattgttgtaatttagacaaatctcctaatagaagtgtaactgtgcccctgggaacacagtttgggaactgctgtgtctatgcttgttcaatgtttcaggcattgtcttaaaaattccactctgtggaagaaaaccagccttataatttgtcaagtcatctgtgttgtttcctttttaaaattttctgttatttttattttgatataattttaaactcacagaaaagttgcaagaccagtataagaaactgccatacaccctttacccagattctccagttatttttttgccccatttgctttatcgtttcctctttttcactctataatgcatataaggaatatatgcttattatttctgaaagatttaataagctaaagatatgtttttactaaatagttcagtgtatattttctaataagaatattctcttgcccagccataataaaattatcaaaatcaggaaattttatattgatagaatactattatctaatctgatacaagactattaacagtccatagtcaaaatttcatcagttgtcccatcctattaataagctttagagttattttcccccaatccaagatagtattcaggatcccatattgcacatagttgtaatgtctgtttagtctcccctccatctgaaacagtttctcagcatttctttatctttttaaatttagacattgttaaagggtacaggcctgttattttgtagaatgtccttcacaaatagattcaagctaggcccttttagctggaataccatatatgttaatgctgacaccttaactaagcaacgactatttaattttccagttctttgacactgcaacccagttcaacccaattcagttctgattcttaacctcatggagttagcactgaccctacatgttaagggctcaatcccacaagcctgccccgacttcagacgtcagctgcaagtgggatccctaggctaccacacttcttccaggctgactaccaattcaaggattctagtgacccccgcttaggttcagtaattagatagaatgacccacggaactcaagaaagcactacacttatgattacagttttattaaaaaggttacatacaactcaggagcagccaaatggaagagatgcataagacaaggtatgggaggtggcggggggtggggtggtgtgcagagcttctatgccttctccagaatgccagcatcccagcacatcaatatgttcaccaccctggaagcttccctagacctcatttttcccagctttttattgaggttttattatgtaggtatgattgattacattattggccattggtgagtggattcaatctccagccagtctcccctctccagaggttgggggtgggactggaagttctaaacctctaatcacaaggttgggttttctggttcccacccctaatcctgaagccttctagggctcacctcattagtgtgaattcgggtatggttgaaaagggcttgttgcaaatatggaaatacactagtatcactcaagaaatcccatggcctttaggaggtctgtgtcaggaactgggaacaaagatcagaaacatgtttaattgtaccacacaccttcgtagtgtatcttataaggaggcatatttatgtgatgtaagtattgatgatgttaaatttgataacttttttaaagtgatatctaccaggtttctccaatagtttttcccattgtaattaataagtatcatatgggcagatactttgagactgtgtaaatactgtgttcatcaacaacctattgaccagctttagcatccactgattttctaactccatcatacctcttatatttattagctgaaattctaatgtaagagagagttttgccttctccttcattcatgcattcacatcaattatggactcgtgtaatattttatttagtcaattatgttctcttattatctttatgctgatgttcaaattataacaaatttgctgagtcctttttgttatgtccttattaattttggggcatttttttcactttctggctaatcagaatgtttgaggcctatcttacactttccgtgccctagccctagaatcattcttttttcccaaggagccctggtttcttttagtgaggggaatggtattaagaaaccaagattaaggcactagatgtgcttattgttgctggtatattagcagacagagctaggaaaataacatataaatatacatacgcatctatattgtatttatttctgtatctatctacttattataataaaaacaactgaattcatactgatacttccaatttcatccaacaactaaagatgcattatttttctttttttcctctattgggtgtttcattctccaaaaatgaaagactaggcttccttactctttttatatatatatatactcatgtgctcaagccacatttctagctctttctagattttaatatctttctctttagactacagaatttcctttcgcacttcttatagtacatacagtgctgacaaatactctcagttttagtttatctgaaaatgcctttattttgcctatattcttgaaggatattttcactggatagatgaaccactatcagttgatagtagttttctttcaatattttaaaaaagagttttctcatttttttcttgtcttcatttttcttgggagaggtcagccatcctttgtatcattttcaacttatatgtttcaccctacatatcattttcacaccatgtgtgtaagcttaaggttttcatcaatttgggaaatttttctttataagtctttaaatatttttcagcttcattatctttgggactccaaatatatgtatgtgtgtgtgtgtgtgtgtgtgtgtgtgtgtgtgtgtgtgtatacacacttgatagtatcctaaaagacactgaaactttgttaatgttttatggtttgttttctctttcaatccttctgaatggatactttctgttgatttatcttcagagtcactgactcttcagctgttttcggtgggctgttaaatgtattaatgaacttggtgttttacacactatacttttcagttctagaattttcatttgactattttaatagttttttctttccttgcagagattcctatctctgcaaagaagttattactatatttttctttaaatccctacattaatttttaatagctgctttaaagtccttatctgtgaagtccaacatgtgaatcatcttggggtcattttttattgactactttttctctttactatgggtttcattttcctgtttctttacatatgtggtgattttgtattgtctgctggtcatagtctgtttcactacatttggattatatcctcttcctttaaaaaagggatgagatttgttcgggcaggcagtaaaattactggcagattcttttgatcctgtcaggcttggtcttattatttgtcagagtggatcttttgaatttagtcttagggagtacccccaactatatggtatagtccttactcctaaggagtggtcttttcctgcctcaatgcctgcgctgctgaatgaattctctactctggctgggctggaactccattgtctccaaacacttcactaattggtgtcacattcagtttttagccttcagcaggtaatttttgctagtcctttaggttttttgccctatacatgcccaaagtgactagaaactcagtatcttttggtcactgcttcctaaccatcttccttccaaccccccagcacagcccctgtgctttatactttccaaccacttcagaagtttggagctccattcaattctgtttcaaagcgttgctctcattgggtagcacctgccttctctaaagcaggaaaacgccctcaggcagaaagccagaatgttgaatggcaattacttatgttgtctttttctttgctctgcccatggctttgttgtcttgtattttgtctagtcttatagatgtcttcagcaggaaggaattctggtacctgatactttgttatggcaagtggacatccaaggcttgtgttctttcatactgtcatgttcttgtaaacaaacagtgaaaggaataatcacaatgattgtagtgttccatttttttctttgatgtttactggacctagaggggttagaactcctttatgtatattgtctttgcactgagtacattgttaaaggagaactccttgagatgtcaggagtttggaacttcacctcaaatgaaatttgaaggatgtatttattcccaccctcttcactggagagtgaaattcagaactgctgttgattttaaactaacagtagacacaaaaaatatgtgaaagtcctactaaatttaatctgtcaaactctactgctttgattaggtagttgggttaagtcttctttataaattgtctcataattcaaatgtttattaacaaagtaacactgaggatgtatttttattcatgttttacttattggtttgtaaaataattcactatatatcaataatttttcacttctttaattcatcaacattatcttgtctgctttctttagacaatatctaaagataaaataagaattttattaggaagattcagctaaagtttttctctgcatctcaattcatataactttgagcatgtttgcagaaaaagcaaaaatgtagtagtgtttataatataaaatatttatattgatttttcaccattttataccttttcttttgaaattatctttaagctaagttgggccctctcagttgaaaattggcctcatttctgaccccaattgatggaatctagtgtaatcacttcattcacagctttactgtgactaatttattttttatttttttaaaaagaaatgaccttcaaagctcatcaaaagatgagcttttccagtgtggatattccatattctctgaagggaattccaactgcgtagtttttggagcagtgatgctattattagattaagcatgtaactccccaaggctatcgctttgaagggaacagcactcattcagatgtttatgtcctggaatgcttgattccattccactctaacctcatgttgttgtagctattgatttcctctactttggttttccctttactgacaagatttgctttaaactatatggtaaggtaaaaatgataacatttgataaccgtggtattatttgttaatgaattccttcattgatttaacgcatgcttttgattgagttcctgtgctaggaatacagtaatgaacaaaaaaagaaaaaaaaaaaaaccctcacagagtttacagcctaatttgagatcttcccaatctaaagtgtaatggaaaattaaactttacctttgtttctttaattcatacttagaaatttaacacctcagaagtcctttatgattattgggtgtgtataatgtgccttgtaaaaggggaaattcaaaagattaaaggattgtttacaatctgactcaatgagattgtgtatatatgtgtataatttaaactcttaggaatacttgagatagaagtacagaatactgaagaactgtaaaagagcccttacaagggaagtaaagtcatttattgaaaaggttgttctggaggcacaatagaatcaggttgtgagatgatattacagaggtggagagatgccactttttcctgaatttaagtacagctatctaaagtggttaatattttgaattttctttatttctgaacatttgttcgagtctgtatttttttctcttaaacactagctgcttataaaaaagctcagcaacttcaatttatctttgtcaaatataatatgtacttacatgatgatgcctttcacaacaataaaattgttactcagagtaacaaggtaagtccaaggttagatttctctaatctaataaatcagaaaaatcaaatcaatctttgaacaggtcagtcattaaattgaatttctttttccatactaggatcctcggttcaatgcagaagttgaccaaattacaggctacaagacacaaagcattctttgtatgccaattaagaatcatagggaagaggtaagccaattttccattttataaaaggtcattggaaatatttttctttttgaaaaatattttgtatttactttgcatatatatgaaataatgctttagtgacaaattagctataaagttcttaaatgttctgcttgattttttttctatttagatttttagttacagggcctaattctgataattgctttactatgcccatttacttagaaataaattttatgcatgtcatattctacctcccctcttcctgaaggcgttattctatcttaagatatgtaattatggttgtgattaggatcaattcattgcatattatgttttaggagtatgagtagtattcataaatgctcatccaactacagtggtcattaacggatttcattcaaattgaggttttgaaaaaaatggaaatcatagctaattctaattatgtaaatttcaatttgaaattttaacaggcaaatgaaaatatgttagtttatatttcacctaactagaagatttggattctgttatcactgaattccctcttcattttacacttatttggaaaaaagagttaataaattatcagttaaactgaatatttcaattgagcattctcaatcctgactgtgtattacaaccaactggagaagtctaaaagattaccaattgtattaattggggttctccacagaaacagaatcaataggatatatgaggatatatgaggggatttatttatggaaattagctcatgcaattatggagaccaagaggtcccacagtctgccatcttcaagctggagaacaggaaaacctgtggtgtaattcagtctgaggctgaaggcctgagaaatgggagatttgctggtgtgagtcctagaatccaaggatctgagtatttgaagttctgttgtctcagaggagggagaagatggatgtcccagcttccgaagagagagcaatatatgctcttcctctgcctttttgttctgtttgggcccttagtggattggatgatgcccacctacattggtgagggagaatctttttcactcagtctactgattcaaatgctaatttcttctgggaacaccctcacagacacacgcggaaatgttttaccagttatctgggtatagcatttaaaaattctaatgccgaggtttcaccttaaatcagaatctcagggattgggacccaggtattagtatttgttaaagctcccaaatgactgcagtgtgtggccaaggttgagaaccactgccaatcatattagaagtacttgatgcttctacttgatttatattcaaattctgacatttattctccttcctccatctagtgtgttaccaaaccccattgatttttttcattagaatgtttctgatttcaatatttttttctttttattcgtgctacctgcatgcaccatgattcagattttgaagtaatgcctaaggtttttaaatgttcttgtaaggtgtttctatccttgcagtcaatttccctttagtccattctacatatcactgcctggaaatttgcctaaaacacagctttctaaatcagtgcttctaaaactgtgttgtgcataggaatcacctggggattttgttaaaatgcagattctgaattcagtaggtctgggtagaacctgagattcttttctaacaagtaccaagttgatgattacctgggtctgctgatcacaatttgattaacaaggccctaagtcagttacttctcagtagtcattctcagtgccttagagttgccacatggtttcttaaaaagtgtagttccagcagtagtaactaaaaatgcctgcagcaatgacgtaatatgagattaattaattagtttaattaactaagtatgtgaatgaatacataaaattgaaaaggccatacatggactgatcattattgtgttattaatatggttgccaggtatatcaaatttttaaagaaatgtgtcccatgcattatttgggacatcattatactaagaaattatttgttgtttatctgaactcaaatccaactcaaatttcatctggcaggcctagttataaaccacagactaagattccgtgcacttaggaagacaatgttcagcttttagttattaaggatattttaaaatcgtggcccccaaaacagctttgtaccggcaaagggattcagcctgaattatgccctgattaagcttctctttctagatagtgtgaacaatttctccaacagtcaggattgggggaactgatgagaatgcaacagaatcactaggaagaagtgagtaggatggccctttctacagaaagtatcctcaggatatacattcttccatattatgactgccggtgaggatgatttaaattaaataaaaaattaaaaaaacacagctatattgagatataattcgcgtactgacatgatttgtctgtgtccccacccaaaatctcaccttaaattataatccccataatccctacgtatcaagggcgggaccaggtggaggtaattggatcatgtgggcgttttcccccatgctgttcgtgatagtgagtgagtctcatgagatctgatggttttataagcatctggcatttcccctacttgtactcacaccatcctgccgcccaaggtgtctgcttctcctttgccttctgccatgattgtaagtttcctggggactccccagcaatgaggaactgtgtgtcaattaaatctctttcctttataaattacccagtctcaggtatttcttcagaacagtgtgagaacagattaatacacatataatataatttacccagcttaagtgtacaatttgatgaatttgagatatgtatattcgatcatgtaaccaccactgcaatcaagatatagaacatttctgtcacttcaaatgttcccctgtaccccttcatagttgatctcctcctcccttaacccacagctcctgacaagcactgatctgctttttgtcactattgttttgctttttctagaatgtcatttaaatggaatcatacagtatgtggtcttttgtatgtagcttctttcacttagcctaatgggtgtgagattcagccctactgttggatgtatcagtagtttgtacctttttattgctgagtgatttattccatggtatggatatactacaatttgtttatgcattcatcagttgataaacatttcagttatttccagtttgtgtctattacaaaacaaagctgctgtcagtgtgtttgcatacagacctttgtgtggacttatgctttcacatcttttgggtaaatacataggagggcagttgctaagtcatatggtaggtatttatttaatttgataagaaacttccaaactcttccaaagtagctgtaccatatttcattcttatcagcagtgtatgagagttccccttacatcacatccttggcaacacatagtgtatcagtctttttaattctaggcattctactgagagatgatttaaatttcattacatgaatatgtaaccccactcttagccaaggacctgctgccttcttacagatctgattgaagtgggtttggccacagatccccaaatagcccgaagctctctcctttagacttctgctgggttcctgagctttctcatgtctctctctgtgctctcacatcctctcctgctggtgtctgttttaccttgtggtgacttaatatgagccttggactcttacactaagcatttcatgagatgaaaaaatcttcagtagcttcactggggactaaatacagattgagtatacctaatttgaaaatccaaaatgctccaaaatgtgaaactttttgagtgctaacatgaccctcaaaagaaatgctcattgaagcattttggatttttctgttagggatgctcaactgataataatgcaaatattccaaaatccaaaaataatctaaaacttgaaacatttctaagtcccgagcatttcggataagggatgttcaatctgtaactttattcaagagagggcttccagaacacagctttttttttttttttttttttttttttttttaaacagagtctcgctctgtcacccaggctggagtgcagtggtgcgatctcggctcactgcagcctccgcctcccgggtttgcgccattctcctgcctcagcctcctgagtacctggaactacaggcgcccgccaccacgcccggctaatttctttttgtatttttagtagagacagggtttcaccgtgttagccaggatagctacgatctcctgaccttgtgatccgcccacctcagcctcccaaaatgctgggattacaggcatgagccaccacgcccggcttttttttttttttttttttttttgagacagagtctcactctgtcaccaggctggagtgcagtgtggtatgatctcggcccactgcaacctctgcctcccgggttcaagcaattctcctgcctcagcctcctgagtagctgggactacaggcgtgcgccaccacacccagctaatttttgtatttttagtagagatgggatttccccatgttagccaggatggtctcgatctcttgacctcgtgatccgcctgcctcagcctcccaaagtgctgggattacaggcgtgagccactgcgcccggcccagaacacagctttttaaacatcttgctgaccctccccattctccttccttctcatcttgctccctttcctcccaggttcacactgccaagttcaaaattatttctcctgagaattaacgttttcagagaaaagaatgaagagagacagaacagacacactatcaagcgtggctgttataatataaaaagtaatttggctggccaaaaaataaacccaggccactaacaaggtgcaatatttgacttccagaattatctttaaatttatatctgtataaacaaactcagagtagtgtttgctttttatgtacacataactactctttgtcgtgaaaattttaaaccaaaatggaaagttgcagggaggctttggggactaattattaagattgcttgctctgggcttgaatcccatctttaccacttagttgctggctgacaaaccaggatggaactggttaatccctttgatcttcagtttcctcatctgcaaaatgagggcaataaaaggatctgccttaaagggttattgggaagattaaatgcattcatgtgagtgaagggtttaacgtagttcctggcacactggaagtgcatcagctactattctttaaaaggagatgtagaactaatagagctttaaagagagacaaggaataagagctgcatgaagaggtcattagccacataataatcagctaactgggaccaaagccagtactcagctaactgggatcccaacacagcccctgacatagtctattgattaccctctaagaaactttaaacttaagagaaacatgtttttctctatttttcctcataaataaggcaaaatgaatttggtgttttctctttttctaagtccacccttatcgagtaagccaatacccattctgactaattaccaaggaacctaaaaagaactgtgattattgaatcattaaatattgattgtttacaaaatatcctggtacctttcagtgacactggtttttaaagacattggtaccaactctggaaagctgttttaatggagtagttgactgctgaatactaaagtctgaattataacataggccggaaaatgcaggaagatttttaagattcactgaaatatctaagctctttatttgcctcttattcttgtaaagtatttcaactaattaaaaatgtttgggagttcttttcattaatgttataaccataactgttatagatacagcagtgctttttttacaagtaaggatcatagatattactaaacatctgtgatggtaatttttgaaaaaaatcatagaggttaagtttttgcaatcttcccctctccctactcccttctagagaatggagttaatgggcaaagtggaaaaagaaactggagaagtgttagaaggctaaaataatttattttggaaggtcaaagagctactggctggagaaaatgaataaagacagaaagaaaaaagtgatcaagggagagaagagagccagtccagagtgtctatgagggagtagtttgaggagtatggggtaggagtttggaaataactgccttgtatgtaggagacagtaaacatgtgtgatatttattaagcaaatcttgtgaaaactgtgctaatgatctggcaagtattagttcatttaatcttcatgacaaccataagaggtaacccattatcttattcctacctaacaaaaaaggaaactgagacatgaaacatatagggaacttgctcaaagtcacataactaaaaactggcaaagctgagattcaaacccaggcattcggactgtaggggtcataatagagagaagagcatttcttaaaagtctgctatggatgatggctgcactctgcttccctcctgattggtgttttcttgagactctgcagtaagcacttaaattattgttgattttgttggagtggaaggtacactgatgtgtttaatgtggctacatgcagaagcaggacttgaggtggcaacaaggagatctgcctgtattctgctggcccttcaatgttagtgtttaaaccgctctgcagacagactttttaagatgaaaaatgagatgacagagaaaaagagagagatcatagtcacatcctctgtattgccttaagaggaatttataagaaaatttttaccagagataaaagagttacaggagcatgtttcatactaatctgagccaatctgctccagagaagaaccatgactacaaatgaagcataatgaaaaaaaaagttacaggtatgtgaatttttacggctgctattaaatttatttcaaagttaattctggatttttcagacctgggcacttagaccagtttttatctttgtcatttgtattaattatttctataaccagacagaattctttttttgtttagtaaagaattacagagaagctcagatctttccccctagctcagatgacctgtttgtgaaatactgccctcccctgaagtattgcttgttctgacatagtgaagatgagtgttcttttttatttatagtggcttcactgatataaccaaccctaaatattaactcttactcagagccctatttgtcactctgggcctactgatttttttttttctctagattatttggggaggagaggataaggggtagaaagcaggactttatgaaataatgcaaatttcttatttctctgaaatttctctgaattctctgaattctctgaaatttctctgaattcctcaagaattttctctgaaaatttcttactgatatgaactagagattatatccaataatgtctttcaggctaggctgaaccaccattgttgaatgtcaactccagttattaagtagaaattcagtttggaatcagagctctttcctccttctctctttttatcttatcatcttgattttattttatcatacttagtgatatacttgcaattctttgatgcaaatatggcagttaaaatcaaggatttaggataaattcattacaacgtggtaaaagatcattttagctaatatcttagcattttagcgtatatcttccttttaaaaactaaaaagattcaaaaagtatcagctaatttttatgagatttatactttggcgaatccaagtgattaacacctaccgaaactcataaattgaggcattcatgaaatcagatatgtaattccaactacaaaatacaaaaataaatgttttttagaatttaagttttatgattgtgtctgctcatttaaaaatattttcatttatttctcctaaattatcttgttttgacaagtaactgctgaatcactgcactttgtagattcttttttttttttttttaatgaagcaaagaagatacttgcttttaaatttttttcaatttggagaggtaggctaggcgcggtggctcacgcctgtaatccaagcactttgggaggctaaggggggtggatcactcgaggccaggagttcaagatcagcctggccaacatggtgaaacctgtctctacgaaaaatacaaaaattagccgggtgtgtggcatgcgcctgcaatcccagctgctcgggaggctcacacaggagagtcgcttgaacctggctgggagacagaggcttcagtgagctgagatcgtgccagtgcactccagcctgggtgacagagtgagtaggctccgtctcaaaaaaaaaaaaaaaaaagaaaaaattggagaggtagctcttgtacaccaaaaattaaatatctatataaggtgacaagataaatgttaaatgagtccaatattcaacacacaagttcgaaggaaagactgaactagggaagctagagaaatccctggggagagatgaaagtgccctgctgtgtttatctcacagcctcaagagaggaaccacataaatgctcctgatgacaaatacttgatctccatggagtgtggaggccaaggagtccttgtctatgatctctcacactcacagtactgactgccgctttcttaaatttggcaagtaaacttggaggaaataaatgttacagttttattcataatccttcaattttcagtcaaaatagatgaaaatataactgcaaaaataagcagagtttaatagcagactaccagttgatctagatctattttagtgttaaagaattggctagttacatgtttttgaaaacttagaaattggccaggcatggtggctcacacctgtaatcccagcacttggggaagtcgaggcaggtggatcatgaggtcaggagatcgagaccatcctggctaacaaggtgaaaccccgtctctactaaaaatacaaaaaaattagccgggcgcggtagcgggcgcctgtagtcccagctactcgggaggctgaggcaggagaatggcgtgaacccgggaagcggagcttgcagtgagccgagattgtgccactgcagtccgcagtccggcctgggcgacagagcgagactccgtctcaaaaaaaaaaaaaaatacaaaaaaattagccgggtgtggtggcatgcacctgtaatcccagctactcaggaggctgaggcaggggaattgcgtgaaccagggaggtggaggttgcagtgagccgagatcttgccactgcatgccagcctgaaaaaaaaaaaaaaaaaggaaaagttacaaattgttcactgcatttattccccacagtattctttcttgtagttttgttttagaaacaaaagtgctgcgcagagtttctgtttgttctggacttgaggttgtgatagtgacaatcctttctttttccttctgcacactgccctttaaataacaaagtatatattatgaagatgttaactgctttcctaaaagaagaatgtttcttaagagcagcagatgaaaaacactgtgctaatatgtgaaatccccaagtctacattactgatcaagaagaaaaagaaagtgaataaaaacttgaaactgaagattaaattaatgtggtaggctttgtgtacccaaatggtatcctatttttaatgataagaaaatttggttcatactgagtgctatattttattcaataggaagcttatcttcattggtaatttcaagataaccattccagcactttttggaatgcattacatttttaatttaatagatgatttataaatttaattttgagaagttttacatagtccctgaataatgggtattaggggtctggaaccagagaagtataaaacatttctttgtataatatctaacccgacatcatataattgcaccctggggtgaattttgactataaaataattttcatgttttcatgtattcttgaagagttaaggtgattgttaatgaaattgctgctctcaatagatatgtacaaacatctatactcatccattaatgtctaagattccataggtaaagtgctttatcaagtgttaaataccctgtattccttgttgttaaatgcttatctaaaaatctccatttgcttctcttctaccatagaatggaaattaatagtctatgctaaatctccacttgcttttgatcatagaatggaaattaatagtccaggctgaatgtaaatcaaagagcaagagatgaggatcttacaaaaatttttaaatttttttgcatcagtttatagtaatgaaatggagtgaaaatgacctggatttagaagtctagatctatttgattattacaaattatttgataatcatgagtactatgccgtattggttatctcttgcaacataacaaattacactaagtgattctgaacaaacatttattatctcatagtttttgtggttcaggaattctggagtggcttagcaagcttggttccttctggctcaggtatctcacgcggtcaggatgtgggcaggggctgcatgacttatgcttgatcatccattttcaagaggttcttgggagaaatgcttcattcctcaccatgtgggctcttcataagttgctcagtgtccttacatcatggcagctgacttctccagagtgagcaatttgagaaaaaatgagcaaggaggaagcagtagtgctctatataacctcgtctccaaagttgtccatcactacgactttcccggcgttctgttctttagcagtgaggctttaggttctacacccaactcaagaggaagggaattaggctccagctcttgaaaggagtagtatcagagaatttgtggagacactttaacctaccagacatagtactaatgtactttcattatttattatatagaacatatatatccatatttatttttctctttccttaaaactagccagaggataaaagaggaactctgctcattaattaaaatgatctcttaaaatcattttgagttctcacctttcatgtactaaaaaatgttgtgaactaccagaggagaagcgatatagactgggtttacacaaaggtttatacaaaaattggtgttcaaggttgtcttaaatcagagggaaaagaggaagtagagcatgaaaaagggaacactaaggaaaaaagagaagatgtttgcctctttgtatggtggcaaactattgaggtattaaaagacttttttttttttttttgagacagagtttcactcttgtcgcccaggctggagtgcagtggcatgatctcagctcactgcaacccccacctcccgggttcaagcgattctcctgcctcagcctcccgaatagctggaattacaggtgcccaccaccacacctggctaattttttgtatttttagtagagatggggtttcactgtgttggccaggcaggtctcaaactcctgaccttgtgatccgcccacctcggcctcccaaattgctgggattacaggcgtgagccaccgcacccggccaagacttttaaaatattatgccacaaatactaacagttctacataagatctctgtttgcacgtaatataagtactcactacttaatattcacagggaatgctcattggtctgtctctattatatctttctgcaccatcgttttctgcctctgttgacagactgagagcagagggaatatgtctattactttgctacactgtttgagcatccactagaaggagggaagtgcctggaaatgaggtcagacaggtagacagaggcaagatcaagcagagccttctaatgtcatgcaaaggaggtactgaattttttttaatgccaggaaatatttcctattgtttaaaaatctgggtggctacagcagtaagtttgaaccattttcttcacttctaacccagagccacataatttgacacttgatatattttgataattaacttccatatttgttcataagcagagagagtactttgtttagaggcaggaaagctgctaaagaggtttttgtggatttgttacacttctgtttagtaggtttagtgattgatttgatggaggaatgagggagagggaagaatctgaaatactttctagctttgtaggtaggttataaagggggagagttgtcatatttcctaaaataagtcattggtttgtggggaacaaaacagttagctctttttcttttgcatgtattgttttacagactaatcctttctcttctcccctgaaatctctacattgcctccccatccccgctttcagatgatggccttgcttactgtttcagtgaaagccaacacaattagaagaatatttccacaagagaacttcccctacttctttctcctgctccagcatctgagtccatatactctggttacccttttacttcttgggatgaactgtctgaaccagcaagggccagcctcccatttgtgcgccagatctcatctcagtttgcctagtcaaagaaattagctcagcagttctctcctctatgtccagaatcattaaagttttccctgctatcaaatctgctcatcagcatacaaacatgctgctatttctcccatctgcttttgaaaacaaaagcagaacactcattggaccacacatctgctttaccacctcatttctctgatcatcaccagaacaaaactctttgaaagagttatacaggccatgtttgccatttccatttccttccattctctcttgaacatacttcaccaaagctttcaccttcttcatgttcccctgtctctctccttctcctttggcctccctattccctgagagacaacagtattataattaagccagttgataaccctatagtgttctctaagtgttcaagtgttcactttaaatcaaaagctagaaatgaataagcttagtgaggaaggcatgttgaaagccaagataggccaaaaactaggattcttgggccagttagccaagttgtggacacaaaggaaaagttattgaaggagactgtaagtgccactccaatgaatacatgagtgctaagaaagtcaaatagccttattgctgatacaaagtttgaatggtctggatagatcaagccagtcacaacattctcttaagccaaagcccaatccagagtgagaccctaacttctttaatactgtgaaggctgagagaggtaaggaagcttcagaagaaaagttagaagctagcagaggttgtctcgtgaggtttacggaaagaagccatctgcataacacaaaagtgcaaggtgaagaagcaagtactgatggagaagctttagcaagttatccagatctagtgaagatcattgatgaaggtggctatgctaaacaacagattgtcaatgtagactaaacagactactattagaagaagatgccatttcagactttcatagccagagaggagaagtcaatgtctggcttcaaagcatcaaaggataggccgactctgatgttatgggctaatgcagctggtgaatttaagcagaagccagtgctcacttaccattctaaaaatcctagggcccttaagaattatgctaattcaactcagcctgtcctctgcaaatggaacaacaaagcctagatgacagcacctttgtttacagcatgatttactgaatattttaagcctactattgagacctagtgctcagggaaaatgatttctttcaaaatattactgctctgtgacagtacacctagtcacccaggagctcagatggagatgcacaaggaaatcaatgtcgttttcatgcctgctgatacaacatccattctgcagcccattggatcaaggactgatttctgctttcaagtcttattgtttaagaaattcatttcgtaaggccatagctgacataaatagagattcctctggtggctctgggaagagtaaattgaaaaccctctggaaaggactcaacattctacatcccattaggaacatttgtgatttatgggaggaggtcaaattatcaacatgaacaggaatttggaagaagttgattccagccttcatggatgactttgaagggtttgagacatcactgttggaagtaactgcagatcttgtggaaataccaagagaattagaattagaaatatagccagaagatgtaactgaattgccgcaatctcatgataaaacttggacagatgaactgttgcttcttatagatgagcaaagaaagtggtttcttgagatggactctatccctgctgtaaatgctgtgaatattgttgaaagacagcaaaggatttagaatattacataaacttagttgataaagcagtggcacgccttgaaaagattgactccaattttgaaagaagttctactgtgggtaaaatgctatcaaacagcatcacatgctacagaggaatctatcatgaaaggaagagtcaatccgtggtggcaacttcattgttgtcttatgctaagaaatttccacaacagccccgtccgtcagcaaccaccaccctgatcattcggcagccatcaacatcaaagttaagacccttcaccagcaaaaagtttatagctagctaaagactaaggtgattgttaccatttttcagcaataaagtattttttaattatggtatgtacattgttttttagacatagtgctattgcacacttaagaaattacagtatagtctaaaaataacttttatatcctctgggaaaccaaaatatctgtgtaactcgctttattgccattgtctgaaaccaaacccacaatatctctgaggcatgcctacaaatacttcattgtatattaactggcacagctatggagaagaggtcatgtctttttttgctggtgacacctacaactaggagtttcgctagtgagacagatgtctgcatctgtgctttcatgcatgattagcttctcaggcacatcttccatttggagggaaaatattttgagatgaaattatgttttggctatgagaacataataaactatgttctccatatgaaggacttagaatgtaaagaaattatgtatgtacatatatatacacgcacacacacatgtttttcttgaatatcttatgttaaattatatggatatctagctttcagtggctacatatgtggttagctagaccagtagaggcaacagcagtgatccagacacttagttcagctctagtaaagaaggcattctctcaacccctttgataccaactttaatttttaaattctattcagcctatttagtgttttgatgcacaaaacttgctttttaccatttttgctgtgttacttcttttatgtttgtagtaggtgcccattatgggcacaccactctatactgtaattatcaggaagctttattggcaggacattttacaaggctatagagacatggactcataataagtacaggcaatgatggaacaagcttgatcctgatttaacagactccaaatccaaaaacaccgtccggggtaagcctatgctttgcaggccaacacctggcgtcaggcaggataccacccttaaaataaatcttcattattaaatagatccagggctctgaagtcgtttttggcaatgtattgtgtaaaggtgaacataaacagtggtggaattattctgatatgaaatacaacttgtataacctatgttgatatacaaaattttttattgacattttgggcttactctcacttaagcagagaggcagagtgggaaagaaagaggtctgactttgtagcaaaagtgacttggtcttgtgctggcttaggagcagtgattccttgagcaagtttcttctctccatgctttaggcgactggtttgtaaagtttcagcataaagtgcaaacacacagggtggttttgaattcctagtgagatgaggaatgtgacagtgcctactgcagagctctcacctcttgggggtcagaaaatgtccatttcctccttatgagaatgttgcaaagccagacaaatggaggaatggaaagttaaacaacaacagtaaacactgaatgtaccctgccatgggaaagacagcaggctgttttctgctatgtaacctttgtgtctctggcagtttttaaagggcttatttggagactttgctcgcaatggctatgcgctgttctgtctctggacagaatctctgtatctcaagggacagaaagatctaataagcaggcaaaaagtccctttagttctaggtttaagagctttacctcattacttaaaagctagtgtggcagagagtttagtatttggcaggagggggattttttttttaattgttcaaagggatgaggataaacactaggatcaataattatgccaagcattccctcgtggggaagaaccccagtctcaggttgactctagtcccacaggatgttcctggggcaggacagctactgacccccagaggctggatttgccctggccccgtctggggagcgacgtcctccctaatagcacagaacaaatgatcaggacttcagcctgcttcaacattacccagacagctgggaacttggcacatgggcctccactttcacataccttcagcaattacatattcatttgcttttaaaatgttttaaaattcacgtacagtgaaactcacagatcttttttttttttattatactttaagttttagggtacatgtgcacaacatgcaggttagttacatatgtatacatgtgccatgttggtgtgctgcacccagtaactcatcatttaacattaggtatatctccaaatgctatccctccccactccccccaccccacaacaggccccagagtgtgatgttccccttcctgtgtccatgtgttctcattgttcaattcccacctatgagtgagaacatgcagtgtttggtttttttgtccttgtgatagtttgctgagaatgatggtttccagctttatccatgtccctacaaaggacatgaactcatcattttgtatggctgcatagtattccatggtgtatatgtgccacattttcttaatccagtctatcattgttggacatttgggttggttccaagtctttgcttttgtgaatagtgccgcaataaacatatgtgtgcatgtgtctttacagcagcatgatttataatcctttgggtatatacccagtaatgggattgctgggtcaaatggtatttctagttctagattcctgaggaatcgccacactgacttccacaatgattgaactagtttacagtcccaccaacagtgtaaaagtgttcctatttctccacatcctctccagcacctgttgtttcctgactttttaatgattgccattctaactggtgtgagatggtatctcattgtgtttttgatttgcatttttctgatggccagtgatgatgagcattttttcatgtgtcttttggctgcataaatgtcttcttttgagaagtgtctgttcatatccttcacccactttttgatggggttgtttgtttttttcttgtaaatttgtttgagttcattgtagattctggatattagccctttgtcagataagtagattgcaaaaattgtctcccattttgtaggttgcctgttcactctgatagtagtttcttttgctgtgcagaagctctttagtttaattagatcccatttgtcaattttggcttttgttgtcattgcttttggtgttttagacatgaagtccttgcccatgcctatgtcctgaatggtattgcctaggttttcttctagggtttttatggttttaggtctaacatgtaagtctttaatctatcttgaattaatttttgtataaggtgtaaggaagggatccagtttcagctttctacatatggctagccagttttcccagcaccatttattaaataggggatcatttccccattgcttgtttttgtcaggtttgtcaaagatcagatggttgtagatatgcagcattacttctgagggctctgttctgttccgttggtctatatctctattttggtaccagtaccatgctgttttggttactgtagccttgtagtatagtttgaagtcaggtagcgtgatgcctccagctttgttcttttggcttaggattgacttcgcaatgcaggctcttttttggttccatatgaactctaaagtagttttttccaattctgtgaagaaagtcattggtagcttgatggggatggcattgaatctgtaaattaccttgggcagtatggccattttcatgatactgattcttcctagccatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtatgagaatgcttgtgatttttgcccatcgattttgtgtcctgagactttgctgaagttgcctatcagcttaaggagatttttggctgagacgatggggttttctagatacataatcatgccatctgcaaacagggacaatttgacttcctcttttcctaactgaataccctttatttccttctcctgcctgattgccctggccagaacttccaacactgtgttgaataggagtggtgagagagggcatccctgtcttgtgccagttttcaaagggaatgctttcagtttttgcccattcagtatgatattggctgtgggtttgtcatagatagctcttattattttgagatacgtcccatcaatacctaatttattgagagtttttagcatgaagggttgttgaaatttgtcaaaggcgttttctgcatctattgagataatcatatggtttttgtcattggttctgtttatatgctggattatgtttattgatttgcatatgttgaaccagccttgcatcccagggatgaagcccacttgttcatggtggataagctttttgatgtgctgctggatttggtttgccagtattttattgaggatttttgcatcaatgttcatcaaggatattggtgtaaaattctctttttttgtggtgtctctgccaggctttggtatcaggatgatgctggcctcataaaatgagttagggaggattccctctttttctgttgtttggaatggtttcagaaggaatggtaccagctcctccttgtacctctggtagaatttggctgtgaatccatctggtcctggatttttttggttggtaaactattaattattgctcaatttcagagcctattattggtctattcagagattcaacttcttcctggtttagtcgtgggagggggtatgtttcgaggaatttatccatttcttctagattttctagtttatttgcgtagaggtgtttatagtagtctctgatggtagttttatttctctgggatcagtggtgatttcccctttatcattttttattgcatgtatttgattcttctctcttttcttctttattagtcttgctagcagtctatcaattttgttgatcttttcaaaaaaccagctcctggattcattgattttttgacgggttttttgtgtctctgtttccttcagttctgctctgattttagttatttcttgccttctgctagcttttgaatgtgtttgctcttgcttctcttgttcttttaattgtggtgttagggtgtcaattttagatctttcctgcttcctcttgtgggcatttagtgccataaatttccctctacacactgctttgaatgtgtcccagagattctggtatgttgtgtctttgttctcgttggtttcaaagaacatctttatttctgccttcatttcgttatgtactcagtagtcattcaggagccgattgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggaataagtgtggtgtggtgctcagaagagtgtatattctgttgatttggggtggagagttctgtagatgtctattaggtccacctggtgcagagctgagttcaagtcctggatatccttgttaactttctgtctcattcatctgtctaatgttgacagtagggtgttaaagtctcccattattaatgtgtgggagtctaagtctctttgtaggtctctaagggcttgctttatgaatctgggtgctcctgtattgggtacatatatttaggatagttagctcttcttgttgaattgatccctttaccattatgtaatggccttctttgtctcttttgatctttgttggtttaaaatctgttttatcagagactacgattgcaacccctgcctttttttgttttccatttgcttggtagattttcctgcatccctttattttgagcctatgtatgtctctgcacttgagatgggtttcttgaatacagcacactgatgggtcttgactctttatccaatttgccagtctgtgtcttttaattggagcatttagcccatttacatttaaggctaatattgttatgtgtgaatttgatactgtcattataatgttagctggttattttactcgttagttgatgcagtttcttcctagccttgatggtctttacagtttggcatgtttttgcagtggctggtaccggttgttcctttccatatttagtgcttccttcaggaggtcttgtagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttcaggcttgtagagtttctgctgagagatcagctgttagtctgatgggcttccctttgtgggtaacccaacctttctctctggctgtccttaacattttttccttcattttaacttcggtgaatctgacaattatgtgtcttggagttgctcttctcgaggagtatctttgtggcgttctctgtatttcctgaatttgaatgttggcctgccttgctagattggggaagttctcctgtataatatcctgcagagtgttttccaacttggttctattctccctgtcactttcaggtacaccagtcagacatagatttggtcttttcacatagtcccatatttcttggaggctttgttcgtttctttttattcttttttctctaaacgtctcttctcacttcatttcattcatttgatcttccatcactgataccctttcttccagttgatcgaatcggctactgaggcttgtgcattcatcacgtagttctcgtgccttggttttcagctccatccggtcctttaaggacttctctgcattggttattctagttagccattcatcagatcttaatgaacaatttgatgagttttgaaaaatgtacatatatctgtataactaattccctaatcagtcctcaccacccatgggcaacactgttctgatatctataaccacaaattagttttgctttttcttgaagaatctacttatttttgatactgcattattattcacttttccttgatacataggattttttttaatgttgcataagtggttcttggctgtgaaaacttgttacgagacttataatctaagtccaagaaaccagcttttagcagccactttggattgtctttgtttcttagagttataattttgaaattgttccattccctttgatgaaaatgtgcattaagaagataagcatccttatgagatctaaagactaagcgttagtatgtactggatcttggtctccatgattccttgagtataaaagaggagtccataagagcctatattttggccaggcgcggtggcccacacctgtaatcccagcactttgggaggccgaggcgggcagatcgcaaggtcaggagtttgagactagcctaaccaacatggtgaaacccgtctctactaaaaatacaaaaattagccggggcgtggtggcgggcacatgtaatcccagctactcaggaggctgaggcaggagaattgcttgaacccgggagccagaggttgcagtgagccgagagcgcatcattacactccagcctgggcgacagagtgagactctgtctcaaaaaaaaaaaaaaaaaaaaaagcctatattttgtactagggctgatttcactttttcctgtggggagtagtagaaagaattgtagctcttgggatcaagtctggagagtgtctgggtctgcatattcttgaactagttatgtaagttttctgaacatcagattgctctgtgataaaatgggaatgaaaattaaagaattatgtcaaggattaaatgaatgaacagttacaaagtgcctgttacatggcaagcccacccttctcctttttttaatggcaagctttttagcatttgaatttttctggttttagcgaggaggagatttcttaactgtattagaaacaatggcattgatcatgttatttctgatgccagttatcttcagggcactgctttcttatatcttgcaattccttagaagcttctctccaacctacttggctgcccattcgtagccacgaaggctgtgagagtaaactaaaagcatcattctcctctgtttatccttgtctcatcccccaaccatggaatatctgtaaacattctcttgagataaatcataggtataaaggtgcctgtatatacagaaggataaaatcaatcttaccagtcacttaaagaaatatctaactttgattctaaaattcattaagaagagcccaccccaaaaccataactaaaatggtcaaaattggctaatgtacacataggcaatacagaagaggataccagcttagccaataacaataaaaaagatgttcattctctccagtaatcaggaaaatacaaattaaagcaacaatgagatgcaattttatgcccatcagattgacaaacattgaaaaagtctgataacaccagatgctgataaggatgtgaggttaatggagactcttaggccttgctagtaaaggtataaatttctgtaatctttttgaagatttagccagagaagttgctgcacatgtgcacaagaagaaaatcaaagatgtttcttaaagattgtagtagcaaaaagttgcaaacaacccaaacatccattctttggagatcaaatgaatacagtttgatatggaatgcaatattgtatataaaatgaatgaaccagatttatatgaattgatcttaaaaaacaacattgaatataattgcaagttgcaaaatgattcctatatattatttcatttaagaaacctttttgaaagataaaagtactatgttttgtgtatagatttatgtatttttaacagtataatgaagaaggttgactatggtaggaggaacaggggggagaagaaagactggaaagaggaagtccaatttaattttatcttaatttaatagtattaataaaggaaacatcaccaaatattaacatttagtaattctgtatcagtagttgtcaatgcgtcttttgtgcctggaccagcagcatttgtaatcatctgagaacttttagaaatacaggccccagtctagatctacaaaatctgaaatttggggggtagacccacgaaactgtgttttaacaagtctcacactaacactgttttagatggcaaaggcatggatgtttactgtctcattctttgtgattttctatactttttaaattaaaaattaaataatctcaagcttttctttcttctctcttccagtgtcgccttaggctataagtttcaactccataattaatggcttattaagaaaataaagtttttactgccacacaaagttctcagatatggatgggtttcttaatattaagcaaaggctagagccaaaaatgggaagacataattaattattatttgaatatgcattgttcagttagtacattaccctaaaaaattttattctttctggcatttttcccattatcatcaacaacacatactattcaacttttgagtacatgtaaaataatgcaaagtgttgataatagcataaaatataaatcaagtacttagaaagcaatctaattgcagggctaggatgtgagtaaagaaaattaggttaaaaaggaataccctgcctcgtatagggcgtatacaactgccacatggagtttcagaggggtaggtctgaagggaagattttttggagatttggcctcagtagagaggtgatatttcaaggaattatgtgaacacaggacattgcggtattctaacccaaagacccatgtaagtgatatagttaagttgagagtgtggaatgttaggtagagtctttaatttttattctgtagatgggtgaaaccattaaaattcttgagaaatgagatgatctgtgtatgcacaacagtgccccaagaatataaatttggctaaattgtcaaagatggactgaaggcaggaagatgattaggaatgagatgtcaagttcttcaaagacagtgaggatttacatagtgaaacagaagagataaaatgaggtgaggagaagaagaaaaagaatgcaagaatataagaatcataattgaatggaatgtattggtttcttaatgctgctgtaaaaaaactaccagaaatttagtgacttaaaatagcacacatgtattatttgaagctttggacttcagagtctaaaataattcccagtgggctaaaatcagggcatctacagggctgtgtttctgtgtggagtctctagaaacagacctgttctcttggcccttctagcctccataggctgcctgtacccctttgctcatggccccttcctctgtcttcaaaatctgcagaacagcatcatcaaatgtttccttgactctgcctctcctgcattccacttttccttacaaggaccttgtgattacattgggcccacctagataattcaggataatctccccatctccagatctttaactttatcacatgtcaaaaaccccgtttgtcatttaagggtcacatattcgtaggttccagagattaggacaaggacatctttgggggccattatttgcctaccacatggaatattaccataacttgatgattccttaggattcagaagagaagtcagaaagcctggatcggttatgtcaactctctcactctcagttttctcatctgtaaagcaggtggggagaggatgtgggggtgggattcccaagcctaacactgattagaatgtcagctctctgaggacagggattttcatctgttttgttcactactggtacataaaggcacttagtagttagctgttgaataaagtatttatggcagaatgaataaatgagtcaaagaaaagtttgaaaagagcactagggaaaattctcccctaactcctctatatattgttaagttctagttttcttagtaaagtttgtatttggctcagattagactgtctagagtcctgtcattgcagtggagatcttctgaggctgagagagagggatagctatgatttgtagtctgtcctttcctcctttgcttttagtttccatgctgagcatcccctgaaccggggatggggaaatgtattgggattgatgtatgacctcagtaaatgtctggggcagctgcttattgaagaagaaattgctcactgtggcaatgatcagttgccctgaaacaaccagctgtcacattccatactgctcgcccagtgagagtcaagtcttggcctttgcattcctaaaagaacactcgaccctgtgaggacataacatccatttgtgctgtgcatagtgccagtaaaatagaaaacagaaaggcttttttgcgcttttacagaaatagcgtggagtgcccgtatctgagagtacagttagccagcaggtaggcaaaagtgaatggacattctgatatggaagctaatgcttttaggggtgctgcctctcacatggagtctgagatatacttagagtaaaagctgtcattaaaaatggacatttcaaagcctatagttaacagttacttgatttaaagacaatgatctaatttgtttaaagaagcaatggatgacagcagaaagaaggactgaatttatttgaacatgagggcagaggatgccagttttgctcaggatccttaaagtcagaattaaactgttaatttgtcttttattgtgtatgcaaccctggatgaacactatgccttttcttctattttttgtctgtttttatcagtgtcatttttcaaatgtcatccttctggggatggaggcacatatacatgttagatatacagttgtctcttagtatacaaagagggattgatttgaggactccactccatcccctcataccaaagtctgtggatgcccaagtcccttatataaaatggcataatatttgcataaaacctatgcacatcctctcatacactgtaaatcacctctggattacttttttttgttacacttgtaggacatttgttcttagggagtcacaagttttgtgccccttgtcacagtgacctcagatgcctgttccatgtgttataaacagaggagccattcttcagccccctgctctgagcacacccctagattacttatactacctaatataatgtgagtgctctgtacgtaattgtcctactatatttattttatgttatttttattgctgtgggtttaaaatttttttgtcaaacattttctatcacagttggatacaaaggaccaactatattttcctggtctaatagtctcttgacagaacttgttttttttttaatatttctttatttattggtacaaatttacagggtatatgtgaaactttgttacatgtatataatgcatagtgatcaaatgagggtatttctggtgtctattacccctaatacaatacatttttgttaagtatagtcaccctcctatactataaaacatttaatttatttcttctatcttactgtatgtttgtaatcccagcactttgggaggccagagcaggaggattgcttgagtgcagggcatagtgagaccagcctgggcatagtgagacctcatctctacaaaaaaatttttaaaatttaaccaggcatggtagtacatgccttccaagtagtcccagctgcttggaagctgaggttggagaatagcctcagcctcgaagatcaagcctgcagtgagctgtgattgtgccactgtactccagcctgggcaacagagcaagaccctgtctcaaaaagaaaaaaaaaaaaaagactgaaaggaatcatcatctcactgtaaatttatgttgatatgatgatggactaaaatgttaatatagtttgattagtgatcatttaataagcagctgattttttgtcttcttatatttttgagtgagcaggagctttctctttattttcttgcttagtacattgcttcatacagttccaggtacagatagcatatcaatgtatactttttgtactgcatatttatcagaaactttgcataatactttctatatctgtttgaaactcatctttcttaaaacacagatttaaagtttatgtctttactttgtaaaactatttattagagaaaaaaaatttaaatgtcatttctgagactccttctcttttacccacattaagtgccccttcagtgctcctagcaatccatggccactgtatcatgaaactgatcccaccatcctactacgctataagtctatgtttatgtatcactcattcttgattctgagctcgttcagagtaatcacttccccagttttttattactttttggtacgtaataggcacttcactatttgttgagtggatgaatgaatacctgagcatttaaaataaccaaattatactactctatattagaccccaatgaccttcaagtggctcttattatagttcccgtgaacattcgtaactacaatccagacatttttgaccttagaggaattttactagaaatttagtcactgaggttagagcatctagaaatctgccactcttttcaagagctaaagagcatgtaaaaataagagagagttgctctaagggaaatgaaaaggtataggataattgcataattctgcttttaaaaacaattaatatccctttaccatatgggcaaaaaaaaaagagagagagagagaaaaatgttaagaagactagaaaactacataagacaagaaggtatttccccttccttgttctgctatcctagaggagaattttatatctttttcttaaagctaagatactataatgagctgagaaaacaaagtgaaccatccacatagaactaaagatacatatttctgaagtatagccagttagaggataatagcttattccactgatactaaatagcagaagaaaggaaagagtagaattaataagtaataaagaggagagaagagtaagttgaaggtctttataggactaaggtaataactcaaaatgaaggtggaactaaaaggtaagtaacttccaaatgccttctgatctatttgaaataagcctcagcatgttaattcctgttttgatttttcagtaccctctttcccaaaaataagtctgttgaaggtaaaataattttcaagggcagaaatttcaaaagaagttggactgcatccctacattaagaattatttttgccctaatgatcctcctgcattctttccatgattggccactaggtcctgtttcatttttagtaaaagagcatttagccgttttggaatattatatttaaaacccatataaaatgttcatattcttatatactttattggaactgtaatcaaaatgtgttgtttatatttaaaaactatggaaaatatatacttaaaatgtgattgctaaaataatttcattcaaaatgcagggtgaaatcacaggatcaaacatagtttgggccctaataaattaaaaacattcgaattcttattaggatgaaagaatgtggtaaatgatgtaaagcttgctcaaatgctgatgaggggttttgcttttgttttgtagactagtgttattttaaagcacatgcaggatatcttctataaatacattttggtgaatttttacaagtaatttcagtcaataaaaaaattgtcgcttttctctccttataccaggttgttggtgtagcccaggccatcaacaagaaatcaggaaacggtgggacatttactgaaaaagatgaaaaggtaccaaaacttgtgtcagacatgagccaatttaggaagatgctttctctttatagtatatacacctctaggtttagctgttgctgaaattgttggtcacacaaaaaaattagagttaaaaatgatctgaaatgttcaagtgtatcttaggctaaataaagcgatgatttcacatctgagtacttgtgttattcagtcagcagaaacccccaaattccctccttgctgtgctgccaagcctgcactgggcatgttggggccacacagagggtgacttatggtattttaactatatcatttacctttcatcactgctatagagatccaaccttgagtaaaaccccataaaaacactgctccaagttcagcacttttggttgactaaaaattggaattgcctcctggcgtagcaaatttctgaatgttttataagccttgcgcacagacagtggggcgccaaggtatgaattcaggctggatgatgtaaatttagcttcagagagagcaacagccagcattattttattatacttctcgttcaactctgaaggagtaccttccacacgcctcattgacatgctttccatttaaggacaaaagcccgtaaacctgtcgataaattcattctatgagtaggttttattatttttcctattgaataagtaattatgtgtatatcatagcctactgaattattcctattcaaagcccattgctgtttatgttgttcccctgaaaattactaggagcttttgaatttggaagacgttcaaacaagacagttatttttatctctatgctataggctaggttggcacctgtgttgctccccttgttataattgcttcagaacatagcaaatactttttaaatcgagtaatagacatctaggctcctgttctgttcatggcacttgagaatatttggtgtgaaaacatggttcctggattggctttgaattccattattatgtctataatccattaatataactccctcttgaattgatttgaatttttaaggctctatcacattgtggataagatatgctgtctaaatatttatttcaatcaataattaatactattaattattattaattataataatattaattaataataattaatagtcaatcaataattaatataattagaaacacattaccctagtatagtttaatgaggatgatagatccatgttaaaaatgacatatttaatgtttgcaactttatataatatttaactttatgcttttattgtgaatattcttttaacaagtatgtaagctgttgtttgctgcagtaatgagttacaagctatttatataataatttcagcatagatccaagtcttaatatcatggagaggctaaaccaaattttgcatggaataaattgtaacttcaagtggtataaagagataaagtctttatcttagttcctctcctttttctccttattgatttatacctaatttataccttaggagactattccaatacctttagctaagacttagtttatatcatcctaattttatgtagaacaaacatctattcttttggctttctaactgtaaatatttgaggatctgtatttcaggcaatgtaactagactgttttatgtaccgtttttatttgtctattatctgttttttaggactttgctgcttatttggcattttgtggtattgttcttcataatgctcagctctatgagacttcactgctggagaacaagagaaatcaggtcagtctgattactaaagaaagtgcatagaaatactttttaaaaattgttacatttttatccaagtaatgtatgcagatgattaaaaatttagatagtacagattcagtttctcaatactttattttttctagtagtcatttgtatttcctattttccatgcttagttgtttatcttattagacaatgttcattaacttgggagatgagaatttatttgacttacaccacacgttacttgccattactcttatcctactggaatcattctgtcactgttttaagtcactgtatgggttgcacttgtgttgttaaataatggttttagttcttgctctgtcaactgtagatattactcttgatttcatactttgtaagacaggtgtcttagcatcccctgttctctttatctctttttcccaactaccgctccttagccctgctttttccatctggactttttcttttacaattgcccacattggtaatatatactgttctacaaccatgatgaacttttcctgggctttgtctaggttaattctaaagttgcaattctaaagaaactatttataagcactataattatgtaaatgttgttcatactacctttgttacagaacttttcatttttcctgatgtttctgaatttttttccttgaactctttgctctagtatagcctcatgttcttgtttcctcctctccccaaactccattatattaggcatcctgttgagttccccttctgcttctgtttgcagaggtccaaactgaggttctccaacctttcttcttccaagctacactatttagccctatgcctgctacactagtgtcatcatagaacttttcttcattgctttcttagattccactatcttttggatcccctacttctttctcacttccttattttgttgcagcacattctcaattaactacttaagaaagggcattggtaaagtaaactttctgagtccttgcatgtatgaaaatatgtattgtagcatcctgccactttggctgggtataaaattctaaactgaaaaatcagtttctcagaatttagaagtagtgctttgtcttctaactagcatccatgttgtccttattcttagctcttttgtagctatatttattatctacaatataaatatataacatggcatataatacatattttgtatttttatattattatttatatctatttttgtctatgtgtctataagcttttcagattatttatatttgcttttgtaacttaatttcacagtattttttttcattcatcatgctggtatctgtatgttggttcatctctttggaggtttaagcaaactgtttacttctgtgtaattcttttttcattatttctttgataattcatcttctctaccctctattttctctgtttagaatctgtgttaataagatatgggaccttccattgactttaactgcaatgttctccctgttctattcttgccatcctttcatccagtccccatttttacaaacagatgggatcacaccacttccttcctgcagtgcatcacagtcgaaactgcttcaaaagacatacagtgcttttcaggttctttttctacttaacgctgcaacctcatctcccagttcttctctttatagtctgtgctcttataaaatctaatcaaaactttcagtataccactttctctgaattctattatttttgcctgaaatatttctcttccctatttcacctgaatgattcctgctcatctttcagacctcagctaggatagcgtcacctccactaagtttttggtaatacttatgaggttcagaagaaagagaaatctaccagaaaaaaacacaaaggaaattcttaaaactttgtttactttgacgggtaatatttactgtgctctgtaaaaatattgataatgttgacaaatgttgatctgaaaagtttggaacaacattaacagtgcgttttatgtaccagatagtgttcaaaatactttataaatattatcttaatcctcctaacagccctatgattttaatgtcattaatatccccatgttgaagaaatttgccctcagtctcaaagctagcagtaaaggaagtcaggattaaaaactgattactctggcttcagaggctgtgatcttaacaactatattaactatattaacagtcaataaaggattttgttaataagtggagacgtatttatatttgaatgcagacttgatcataacctgctaggttatataaacaatttataacccatataaataattgtgctttaataattacaatcaattgctaaataatgagctcctaatttttttgtctaggtgctgcttgaccttgctagtttaatttttgaagaacaacaatcattagaagtaattttgaagaaaatagctgccactattatctctttcatgcaagtgcagaaatgcaccattttcatagtggatgaagattgctccgtgagtacagagtatgacttttttatttttagaaagacagaaacttatatttctataagcactacttttaaacctcattttggtcttagaaccctctctcaaacccaaatgtgtatgaatatgtatataaaactaatcagggtatgagctgttctggttgaagacaggtaggggtggagggtggagggtgtcttcatcagcctttttttacctctgttcatgtccccatcccaacctcctgaaaatagttaccatgggaatgtctgtgtgctgcttctaccaatggctacactgtcttcatggagaaatatattgtcattacagtgtgctgacttttcatggtcaggaatactggtgacctagttgctatgaacaggcagaccagactcctcattctggatgggttgggtataaaaatttcttcttactagaaattgtatagaaaccaaaaggcatagccagtaggagtattactaatggtccccataagtcccatatttttaccaacagtggaaaaccactaagctgttctaactggtagatttcagtccattgattttgtaatgtgaagaaacattttcaggtgtctggggtaagatagactgttgtcacagagtgctagttacagccaggccagctgtcttgagtttgccagtagaatcagggcccctggcctaaggcagtttttctttatgcactttctctcccttctcaacctatgaaccactgtttctggaatatttctttttgctgtagttgtttgttttctttttcctttagtccctaagaataggttgttcatttgtggattaataggaaagagagcgtgcactatcacttgtataggtcaattataatctacatatgatatccgaagttatgttttggggcaaagtagaataataaaaggtattcagtacttaatttatattaagaaattttagttgatttagatataaggactatactgtatgacccaacatctcaaccatttgggatgtgtatatgtgtcagatgaatgcattgtttaatacaaaattctgattaatatcaaatgagaactcagtaggctaaaaggtaatcagtattttcatagatactatttcatatttttcaatcagttataaaatccttaatatagaggtgattttaatatagtagccatgccatcattttaaacttcaggtcagaattccttaatgtagtatgtcacttaatctgtaatttttgctctatgacccactttttgcatttaatttttgaaagttatatgtgaagcactcctttttttacacaacttaaatatcactttaattcgcactcaatggatacttctaccagttaacacctgttatggtagtacactgatttggatcagtgctacttggaagtatagcgcaacaatatgcttattaagatattttgcttactttttgactacttaagttgtaggatttagaaaaggaattaggtgactttatattcatttgtattacatttatttgttgtttaaaagtacatcaacaacatgagcaaaggtgaaaatgtaagaaggaaagaaatgtacagatttcttccatccccagattaaactatcattttttttttctgttttcttccaattctgtataaatagagcatgggcataatgtgctgttctgctttttaatgtgatttaaaaaattttttttctttcttattttcgagacagagtattgctgtatcattcaggctggagtgcagtggcacgatctcaccatcgcagctcactgcaaccttggtctcccaggttcaagaaattcttgtgcctcagccttcccagtagttgggatgacagaggcatgcccacaacatccagctaatttttgtatttttagtagagtaggggttttgccatgttggccagtctggtctcaaattcctggcctcaagtgatccacccaccttggcctcccaaagtgttgggattataggcatgaaccaccacacctttaatgtaatttcaaaagtatttctctatgttgttaaaattttcacagttattttaataatcacataaagtattactgaatgaaacatctttttaagaagggattctttacctgggatttaacaacaatcaatgtacttaagcgttaaaagccaaaacttgagaattttcaataagtgtaaaaaattttgaaactaataaatccatcagcacctagaaaaaaacaaatagtcctcatataatcattcttccaagagaaaatcagaaattatatgaacgaaacttttattttaattaaatgggaagcagttttgaggatgtcataaaatgagtacttgggtctattttgtccaagaataagtaaaaatatactacaagtattggggtcttttgtcaattccatagcatgtatgtctgtatctagatagttttcattaccttgtcaaacttatttctcagcctgtgttgtctgtttttaggattctttttctagtgtgtttcacatggagtgtgaggaattagaaaaatcatctgatacattaacaaggtaaaagcacgtattctctacttgtctttatcacatgatataatattggctaaatagttatttcatgaccagtttgatttaagaaatataagctacagattattttattgtctcttgtcttttctcacatttacggtcctaagtcgtcctccatcaagatggagagactattgaccacagtgacttaaagttgttactttgttaagtatttatatttaaatcaaaactcattactagactattattttgacaatgtggtacaaggaagggccttttctcctattaaaggattttaggaattagcaaagggtggggtgtaacttggaggcagatggggaattcatttgactcagaaggtagacctgactttaagccttgactgctgacttgggcatgaagtgagtagtcaagggagataaaccatggattgtctaaccagagagttttctgatgtcctggaatttggggttcacatggtcataattgaattgctgacctttatttccttcttggctttgctgatcatgcattgaagattatatcccgtctccacacctattctgtcctaagctcctgtgccattgcattttctagcagatttgacattgttttagttagtattgaatccttttgaaatgtctgaaaatgtgcacattaatatatattattttaattttatgatgctgtaatatcttttttcctttttggaaagaagattttagaaagtttctaggtaggacatatgtaaatatttgaatattttactttttggcttgcataaataatgagttcctatacataaatagaaatataggcatctctgtttatatatttacctttacctccatgggacaataggaacatcagtatgataatcatattaaaagtccaaaatgatgaattatctacattatcttttaatatttgtgcagcagcatatccctgtgtattatattttaggtattggcttttgatttttttcttataaattcagccaggccctctaatttcttttagcagtagctggacaaatccagtgaattggtgtgatagtgacctctactggtaaatatgcatttaaaaaaacacaaaaatgtcttgctatatatatatttgtttctaaataccacattccctctctgtaggaaaaatggaaaggatctttccacttattgatttaatgattccaagacagtcttagtataaagatattttttataaaggttaaataggtcagtgtgattaccttaaaagagactaatttacatggatcattttaactgatttattaattgactttacaataatgaaaatcatttcaacagtaatagcttatgttaactaaacatttaaagttagcttttttctttttttttttttgagacggagtctcgctctgtcgcccaggctggagtgcagtggcgggatctcggctcactgcaagctccgcctcccgggttcacgccattctcccgcctcagcctcccaagtagctgggactacaggcgcccgccactacgcccggctaattttttgtatttttagtagagacggggtttcactgtttttagctgggatggtaaagttagcttttattatagtgatacagtaaaaggcctctgagattttttttattttaataaaaattaggtaacaggcctaaatttgcagtaactgaatttaaaatggtgtttagtaatgttaacattttgaaaaagggcaaaactaatattgatacttatttttcaccagcaaattctttattttgttcctaaaactgattattggtaggatttaggactccaattctcattattaaaaactttgccaatccaaactttgccatctctcaatttgatgaagtactaggcaatttgatgttagcagtaagcaaatcattcttttcaggaagttatttatcaattaaaaagtatagctcattcgagatttttccaaccaatccactaatgacctcataaattaatatactgaagatggttttgaaatgttaaatgtaaaacaacatattcagggtgaacattacacataattattagaagcatatcataaaagggataaagcatagtaagctcttgggagttgagttgcccaggaatttccaaagggaggctcatttccacatggtgggaagttttagagtttttgtgcttcaattcaagagccacccaattagaaggaaaaaaatgagtataatgttgtgccgtttatgttagctctttaagaagtagatattttagtgctataattccatactaattaactttatgttcattcacaaatgcacatttgtgtcataaaatgataaatacatagaattaatccttttaggtcactttcttggaatatacatattagtttatacttgttattgattatcatattagaaaatataagtgtaattaaataagtaaagactactactttaaaaaattgtggatacagtgtagaagaatgtagaagtcagactgattgtatttaaatgtaagtatttaagttgcaccacatactgggcttactagctgtgagacttcatgtaaattatttaatctctcaaagcctcagtttcttcatctgtagtggtagtaggattgtactaagaatcaaataagataatgtatataaaatgcttcagaaaatttctggcattcagtaagtgttagctattatttccatgtctctttgattttttttttatttgtctttggtttacattacctgcagtgactcccatttaattctaaagcacagaaatttatcttttcaagctccacgtacctaattctctcatcccaacaatgcactcatatacagttcattgatacacattgtacaaaaagccttagatgtgtgagttagtccaggtcttccaagaaacagatgccaagattagattaaatgtgcagaaatttattagagaaaacaccctgtgagaaccagagggaaggagccaggaaagccatcagaccaacacgaaagtctgacccagagttaaggagaggaagaaggaaggaaagttgtacagaagtatcctagacagctgaacagttctaaggaaggtttggcaaggctgctgggaagtcctctagctgaaatttactgtgagaagaatactgggcctcccaggattaggcctactttagtgtccctagtgtgctcagtctttttctctgggatcaaccctggtagaggtgacctcagtgcaaacttgttgatggcttccagagcacagcaacttgagacattggtcagctactctttctacaattggagctctgaggcacattctaaaggacactataatattcccatcagtaaaagaatgagatccatattccttgtattacactttcaaaatctttcactatctgtcctagcctaacattttcagcctgaaatcatcattttattcttgacaatctgtaactatttagtgtttcccagttacacatagaactcttccatgtcagcaatgtgttttatactgtttcgttttgttttgttttttcctgcctggaatactctacctttcattcctgatgtctctcctttaaaaattctgaaccaactgtgaattcatttctctaatgctacctcttccctattccactccatttaggtgctacctgtccatcttctccacacgtgtggtgcttgcattgttacaccgtatcacttaggattaggcttaactgtggatcatgaaaacccaaaataaaaatagcttaaacaagaacacagtattattactctctcctgtaaaagcccagaggtagccagctcaggcttggtgctgtagctgtgctccacaaagaccttggggaccaagacacctttggactttctaccttacatccctaggatatggccctttccttcagggtcaaggatgcagctccagtcattatatccacattttaaacagtaggatgggggactgggaaagaagggacagacagcatgtatcacctgtctcttaggaaggttactagaagccatcacagacatttactcttacatcctgttgtctagaacttagccagatggcaatactaagccactagggtggctgagaaatgtggtctttattctgggtggccatatatgtccagacaaacagaaggggaggagaattattgaaggacaactggcagtctctgcactagactctacccaaatagtccatgtaatttaaacacattattcattctgtttcagtcttctactagattgtaagctcctatgacagttactaacctatgtaagtttgtcgcccatatactgctaagggtgcctctgatggagaaggtattcaatctttatttattgagttcaggaactaaaaatttatcaacatttcttatagagtaagaaacaaacatagtatcatgtaactttaataaatctaatgctcatttttcacttaaagtaaccatcaggaaaacctaaaaatttcaaggagttaaataaggtatcaggtatttgttgatttagaagtagtttttctacttctctttctctatattaactagtgtaagtctgaatttatgaactctgacaaattgcttaaccattttggattttttcctggctcctactcttaaaataatgatgatgataattaaaataatgatgatgaagaataataatagttattgatatgataattatcattttaaaagagattttacaaggatacttacttctccaatatacttcattctcctggtggtcaccttttcatttttcttctttttttcactatagcttcttattttcttctctctaggctgttgctatttataaaatatttgtagttttaaacattgttttattaaactaaaccctgcatttatataaccttttcttgagtgtcactcaaataatatgtatgaagtaggacctcaggagtgtattaggtctgatgtgtatggtaactggcatgccttcacagactctcagcctagtctcaagaaatattcaatttaaagttcatttactattatgtcactcttctgtcatttccttttcattctttttcatgtatacataatactagacaagtggtcagtacttggtttgaccaaattacacttaaagtaaaatgtacaacaaagggaagactgaaatattttgaccaggaaccaggccacagggttcaggaatctttgtggaatcactagcgctgaaggacgccatatgaaaccactgtcccaagaagcagctgggtcaggttgggtgggaaggacagaagatagcaaaacattggaactttggaaacttagaacaagtggacatttttcctgagatgtatgctgttgtcactcagtatccttgggaaattagttccaggaacccctacagataccaaaatctgcagacactaaagtcccttgtataaaatgatgtagtatttgcctataacctatgcacatccactctatattacttataatacctaatacaacgtaaatgctatttaaataattgttatgttgtactattgtttaaatttatgttattttttatttttgttttttttctttggtttattttcagtactgcagttgggtgtatccaaagacgtggacttgtgggtacagagggccaactgtattttattttgaaatgtctactattgttaggttttcctacttctttagtgatattacaattaaaataagcatgttcttatagatagaataaattcccataacctgaccctctttgctgaatttatcatcaccacaagggaacatacggagtttcctgatgaaaaaacatgttccattctgttttccatcccttgcactgacactgtaccccctggcatcagattaatctttcatgttcactctgttaagcaagagactggaacataactggtaaaaatattgtaagttcataaaaatttcttgaggaagataaatttttaattttaaaagtatcttaaagcatctcaaagcagaaaaaaggtgtagagaggaaactgaacaaagggaaagatgctaaggaagacacgacaaaaagacagaaggagaaagaaaatagacttaactagagagaagagctttaaaaattttttctaagctgtttgatttttcccttggtcttaaaatgtgtaagatactgttttattggaatggatagagaaaccaaataatgaggaagtgaaacaagcactagaccttaggcattctataatctgatgggaaaataagatatgaggggacatatgagtttacattaaatgacaccaaaaatcaccatgcccatttgcgatgagaataaggccattcacacttataaaacttgttggaaatttgtgggattttgttttttcaaaacatttaaattatggtaactgacaaagttgtaaatcatcaaacacatttaaagctacattttccaaataagtatatatgccttataatttaaggctggtatttttctcccttaatcatttatttaactgtttgcccatgcttttttttaactgcacagagggaactcatatctgttattttcacagggaacatgatgcaaacaaaatcaattacatgtatgctcagtacgtcaaaaatactatggaaccacttaatatcccagatgtcagtaaggataaaagatttccctggacagtaagtaacccaattttagacttgaagctagaaggctgttttcccatcacatctgtacttacagttattcttgaactgaaggactggctctagaattgactgtttaggaatgatctgtgctttccctcatctgaggaaggagaataaaatagatcataacatctattgagagctgtagctggacatttttctttgtacttttttcacctttttaaatgtctattaataagttaccgtactatttttgaagtaatttagctattacctacataatgtcaatgacattccttagataatattgctagagtttttgccttatttgcaaaaattagtttctgtgtggcttgaactgatgcaattggtaatctgtcatagtgagtagctctgggaaaatggatgtctgtttttcttgacctcaaagctacaaatatctagttctcagacactgaaaaatttgaattatagtattttctctcacctcttcaggaaagcattgcactttgaggcagctgccttgattttgttatttggatgattttgttatttgggtgttatttggagacattgttagaactttagcaatatagcaatagcaacagtggtattattaaaggacaggtttgtaacacggtgcattttaggtggcgtttagattctgcccctctcgttaaattatttggggcatttactacactagtatagtagatactgtacttttacttattttttttaacttatttttatattttacttattattaagctgcttggaaagtttaaagtgaaaaaaattccgatatttttaacaaagtagacattgctttatattgcatttatgtgaacttcattataatttatacattttctgctttccaatgctctctaatataaaagttgaatatatagtgctttcaaatgtgtcatatagtttatatggcatctaatggacaaatcaatctctttaccattttagctgttttgttctttttatttttgtttagactgaaaatacaggaaatgtaaaccagcagtgcattagaagtttgctttgtacacctataaaaaatggaaagaagaataaagttataggtaaaacctttcctttaacctatactctaaacttatttttaaaaatgtattcccagctatacttctttctttcaaatgtaaagaataaaatgttttaaaaaagataaaatttggaatgatagaataattaaaataattgataaataccaacagacatttgttaaatatcttataaactatggtgcacttttataattattatcctatttcagcagaattttttgtttaagaatgattgatgatgtattgaaatttggtagactgtataagagatattaagtagataatgtgtattgttttagagtcttatttcctggatgttgactttttttaagaatgtagtttaggttataggttatatttatttattcatttaatatttattgagcactccactgttcttggcagttgggataaatcaatgaacaaagcagaaattcctgccctcaggagcttatgttcttaacatgattatagaaaaacctctacttcaggaatgatggaagaatgcattctcagaaaaattgaatgatgtttccttttattgacatatttgtttcctggtattgcagttatgtaaaggttaagtaggattttatatgccaatcatccgtggttgatgtagtgaaaaaggtctggactgttaacattctcctaggaacctggaaataaagaaaatatgataactttttaaaggttaaatttagaattaaaaccctaatggagcaacatttagatatataaatataactttaaaagtctgaatacttttccaattgcaagatttgactataattttattgaatgagagttttagtcagaaagaaggggcagagggtatcagtaatgaaaatagaaaaagaaaagacagatattaaaagtgactgtccaagttctgtgcaagagtaaagtaacatttgtccctaacacagagatggatgtagagagttgtatcagtgtgcatcgagtattctgaccatatggtgagccttcactaggtgcaatggatgcatcagattatagccagtaatatctttccaattcccagtccctctgcctagaatgcatccttattgtgaaaggaatacatcagcttagcacaattcaacattctctgactctgatttcccttgttctgattccagtcccaccaatccaacttgtactgattactttcttttccagtgtaggttagctcatgggaagagaatgcattattcatgtcctctcaaatatactggttgccctgacagttgtttcttattgtatgaactggacttgaggcaatgggctggagctgcaggtgcttatacttctgtttctgggacagatctgtttctttttgaacattgatactattttggttttataaatcagtcttgtcaacttagttactgtgactccaccccagcagtcttcagtatgctaatctagtgcctaagctaaaaggttgagggtcagctcctgaccctggtgaattgtgcattaaagccgcttagaaaccagcgtgccaaccccctgctgggctgttgagtcaactcttctacagttctcagagaaaaaagtggaggctaatgaatctgtgagatcttttttaaagattgtcactgatcagatctctaacataagcaataaaagaaaactgccaagggtgccttacaatatgataccaagtaaatgttataaaattttatttcttagggaggtcaaggggaaaactatattataaatgttatgctgtttaaaatgcttttttataagtataaagatttactacaagctgtctttggcctttgaaaatgtgaaattaaattccagaaggaatgcattatttactagtaagttatcataggaaggaaggcagagtggcagcttgccccatcaagtcacatcttcacttttccccagcaacatttctttggaataataactgggaacggggagtggctggaggaagttacgcatcaggcccctttgtcactttatgtgaaggtaaatgagagcgagttagacgacatggaaagagtgctggactgggggtcggactcacagcattgtgttagcgccactcatcttcagccacacttatgggcacattactcacctctgtggagttgaacttaataacttttcagatctgttcaaaattcacattctgtgatcctgtcactgtgtcagacaagtaagaaaaaaataaaaaatgaaacaatcagacttttcttggcatacattttgtatcaccctacttgatgacagagccaaaagtaggcaaatgtagattttggagagaaaaattctttgtaaataaaaagaaaggaaaagaaatgatttctttagtcgggttttgtgtggggtgaagggaggttctcaagtagatcccaaatataagggggaaaatttccagtgttcctgctgctttacaagggtgacaaaactaagaatttgatttctggactatacttatgtacctacagttgtagcatggaaaatgtcatggttgtggataatttgtcttacatgtcatagaccagattccactattatgtaattctaatagagaatccctatagagttacatgcagaaagacagacggacacatgtgttgtttgtaatcttcttccttcttctcattttttccattactgacatttagatggaattatagacattagaccagtatggggcctgctgtcccatcacatttattccctgaggtattgtttcgtatcaaatgttttcttagtgctctggctaatacacagtgtttccactactttgcttccagtacttttaaggaaatatatttctcattgaacgttcatttattttaactaattattttccctgcttattatgctaaatgcctttttccaatattatatttaccagacatttttatgcctattttttccatatcaatttcaggataaattttgcagaaactagtcctattcccattgaaaatttattttaaaaaaagatacttagaacatctccactttaaatagcttactttttcatctccttgttaataaataaaagcataaaaataaaaattacagtgctgtaccacacattgtttgacagagaaatatgagaaagaaatatgtatttgtcaactggttactatcttaatcccttctcatgtacactgtaagaatgttctgttttttacttccacaatgaattttctaagtctcttacactttcaaacttgttctgttagcctgtttgaactggctaaacacctacatcattccgatgctccaaatggcaccttattttagttcctttctatcaataaaatttgggagacctgcatgcctgcagagtttttttgagtaggccttaatgaatttttgaatcattgattgtcactaccacgtcatcttatcttactctgttaatttattttggctttatttaataaattactcgggtggacctttaaataggtgaatacatggagagataagctgctcatctgtgtgttgcagtagaattccaaggcataaataagtattctaatgttatatcgcttaagtttgactactacttcattgtacttttcatattaaattttatcacttggcaatatcactattcatttgtttataattgtacattgtcttccatggtatacattgcttgtattacttaaagtatccaggttttttcccagttagagaattgtaaattatgcttagttataatgagcacaaggaaataagactgtagggtgtaagggcagtaataggtggaagaaaactagaaaaaaatagaattaagatattatagtttagaattatggaagtgaagatctatataataaaaacaatgtaaagattacagatttaataattgactgaagaaagacaaaaataaggaaaactttttagtagcactagaaaacagagaagtagtctttagtggatcagaaacactaaggaattcctggaacctgtgaagtatacgtcatttgtaaagacacattttatacaacatgggcaaaaattgaatagggataacaatatttctatcaaacaaagtagaatttatggtaaaacataatgtaaagaatcacctttcattgagtaaaattaaaactcatagaggaaaatgtaattgctgtgaatgctaataaactaaatagcatcattgacatacaaaaactaaagctgttaaaaatacacggagaaggctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcggtggcgggtgcctgtagtcccagctactcgggaggctgaggcaggagaatggcgtgaacctgggaggcggagcttgcagtgagccaagattgtgccactgcaatccggcctgggctaaagagcgggactccgtctcaaaaaaaaaaaaaaaaaaaaaaatacacggagaaatggacaaagtgatcatcacagtgggcctgaaatatacttgtcagtgttaaattataggaaaaaataaacattagaattgataaaaattaagtggatttaattgacatatatagctttactttcatgtttcagaatttaaaaatataaattattctaaaatatatgtcagaaatcaaatattggtgatatgcaacataaagtcagtcgtttctgaaaagcagaattgttggccactttcatagatcacagtgcattaaaactgttaatatataattaaaagataaattggaaggaaaaaactcacttagaacctgaaacgcattctcctaaatgacaaagaagaaatcaaaagtcataattaaattacagcattttagaaaagtaattgttctattaacataacataaaaactgaaggtacatggtcaaagctatactcagaggaaattatgtagctttaaatattttattattattaagaaataatgaaaaaattttaactaagcattcaaccgtagaaattagaaaaacagcacctttctctttctcactctgttgccttccccaaataagtatatacatgagaagaaagaaagtagaagaaaaaattgaaaaaataaacttatgaaatgagaagaaataagagataatgggcaaacacaataataatagatgaacctccaacggataatgaggatattaagagagaaacacaaatagtaatgagagagggaatgtaagtacagatatcaaagacattttaaaagatacttgatattacagtgtagcaaataggaattaacatttggtgaaatgggaaatttctataaaaattggtaataaccaatactaactcaagaggattttagaattgttcatgggagtaactgagaaagaatttgttatttaaaaaaaaaaaaaaacaactattgcccaaagaaattctaaccaaagcaattagaagggaggcaaggttgaaataagatgagacacagaaaaaaaggaggcaaaataaaataacttacaaattatattagtgttaaatggaaaacccaaaaagaattagctgaaagtacctgtctagtaagagttttataagaagcctaattatcaaattattaaagagaaataattttaatatatgccaagacaaatttgttagaaaacaatggaaaaaaataaaaccatttactacagtaacaaagaataaacttggccagaaatatatgtcatctatatgaggaaagctacaaaattctgagtgacttaaaaatcattaagaagtgaatacatttctgaaatgattaaaatctagtttacgagatatcaagtctcccagattagatttgcatcaattttattatccttgtgagacatgggtgggggtggggaggttgttcctgatcaacatttacaaacattggtaatacttacaactggaggtgtaaaaagaatcatagctgatggttattgccctttcagaaattaaatttagatttaattcagaaattaaaatgatataaaagtaaaataattaaaaatatggtataggtgctaaaagacatgccaagattgatgaaacagaacagaaagtctaaatgtagacccatagtctggcatatataattgtgttactgtatgtaacagagtagggtatatttcattatttttaagtaagatacttttgaatgaaagacaccattttatgtatctccaagaaaataaaatatgatttcaatttactatgtcaagctattgatcataacatgcatactgatttcaaaaatattaaaatgtggaaaaagtatgtaatagttgaaacaaatatgaatttagtatatggtgacaattcagatcatcaaagaatgggtaactcttcagatgttataagactccaatagcagttaggggaaaaattaagtgggattataagattaaatgtaatacatctataaaagtactagggaaaatataggtttatatataatattaaaatgaggaagcctcttttaaaagcaaggcactatagttgaatattgtaaggataattattctggctccttaaaaaattaaatcttttatacagcaaaagcctctccaaattaagatgattgacaaatgaaaagtgcagaaacaaaagtatttgcaagataggtgataaaggttcgttttacattttaataaggcaggatgctaattttggagtccatgttatgtggtagagaggacataagactgcaagcagggtataagcattgaccccctgttctgccaaagagccaggaggaagactgtggttggtaacaacatccgatcccaagaattatggaaaagaaaatataactgtttaattttagaagccatctagtcccttcagcataatttccagaggtgccttcaatgctaaccaactctcagacctactgtgatgaccacattctgagtactttatgaactctataataatattaggtaacactgatagtttgctaacttcactacttcttggttcccccaatacatttttgaatgttgttttattttgtgattgcacttattaatgggtttttgctgaatggttctcttttatttttggttttgcattaaacatttcatttttaaatataaattattctgagtttgtatggtttatgagtaacgtggcatctcaaatttcagttttaaatttcattattgtactccttaatctttcagatcattaaggaagaagttgtgaacactctatctgtaaatgtgcccaggtttttagttttcttaaacagggaaccctgtttgttataagccctctttttctttataactttttgtttttacatgggtatttttgcttgatagaattaaactttccgaagagtgtaaagagatcaatgggattatcatgaatgctatttaaatatggctgctcatttcactttcaaaaagataattaatttatatgcctagatggatgatttgtcttcagtacccatttttgttgctgttgttgttgttgttttccccagagcttaactctgtgcctatagatctatatctataatggtagatcataacatggatatactttagttgttctgctctgagctgtatttgttatagcagaaccttgatatttctacacataacattccatttaaaggacttgcgggcaattccaaaggtataatttaatgactcttaatatattcattcagtgaattttgaccaaggcatagatttgaactgctgtactggagagatacttagctaggtcataagcctcgcagattgcctggtattcacatctcaacccctctgtgttgtacttttcttgctatacgtgtagtaattcttgtgaagtaatttttaaaatcttgtttatgaaaaaggctatcaagtaggagaaaactttagtaaaactgaaaggcaattccattgtgatgtgaggataagggcatgaaatgtgactctcaagaaaataagatttaggagacagaagcctgtataaacagttccatatttatattttggggattcacaaaggttgaaggacataacccttggtttgttttttgctttttgttcttgttttttgccacacacaggatatatacatttaagataatgaacgctgattgccatttagtatatggcttttacttgcagtgtccaaattcattatatcttgtctaaagtttcccttgactatggaataattgataaagtaacttctgcagcactattgcaaatagataagcatgtagatgtctttactgtttaaagtagataaacaaacaaaaagagcaaaaaggagagtccagatcatttatagtatgaaaagtaaagaaagtgaacattgatggtggtaaaggggcttaatgtgcaaccgtcttccagactctatgaaatccttttgtgctccaggaaaaataaaggataatagactattatagtcttcatgggaaactagttacagtcagagctgcaattctacattctttcattaattcggaaaacatttttttagttcctactatatgctaggcgttttgccagctgaagtggagctgaaaaaaataaataaaactctaagcccaagatactgacagtctagaaagagagagagaaataaaatttaccatgatacaccaactggtcatgttaagggaatagaaaaatgcctgcctcacctgtaagttagaggcctcctggaggtcattgggaaggaggtatagggatcaactggtgaggcgggagggaaggcaatggggagcagtgcagacctgtggaaaagcataagcaaaggtgtgggcaagcaagatgcaaccagggcactgatagcaatgatctgacaggtaatatggcagttgagagtggcccttgtggcaggctgagctggggattgaattttagacctacacataccagctaagtggctttgagcaaatgatgtaactttctgagattcagtttcctcatctgtaaaatgagaatagtcacatctacctcacagaataaattgagaagactggagatcatgtgtctaccaaagtatttagcacaatgcctatcccacagtgggcacatggtagaagtttgttattatatactcagagacagaagtgataaggactttaacaacactttgtttacacagaggtaggctgggtcatcaaagtgacctctgtgaggtcactcctcacagagaccactaggctcagaaactcatagaacaaccagttaagatttatcctaatgttgatgtaatcttccatttttattgactacgtgtttaacttttatttctaagtagtcatttttatttgcataattatttgcagaatcaaaagttttctgcaaatttgattctgttggatacagaggtgtagatttgaaatttgagactgcttatgtcagttgcctcctttctgcattctattttgtatgtaaccgtgtgtgtgtgtgtgtgtgtgtgtgtgtgtgtgtgtgtgtgtgtgtgtgtatgtttaacttctggtttctcagtaaggaaaggagatctgtttgacccaaaattctgatgtgcatcaaaatcgttctcttggcaagtgtacaaaaatccaattagcttccaaaggacaaattgtctttggggactcaactgatctaaaattcgtgaccgagtctggaagaaaatagtactctaggattttttgaacgccagcaatgtacattttgaactacatgaaactagttctcatataaattctgtttacttctctagcttatatttgtgggggttaatttgcttatttcgacatactaagcattcctaagagaaaagtgtaagacaatctttgggtgtgtgtgttaaagtccacaaaaactatgataatcaacaataacatttgctcaatttctcggattgttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggtgggtgaagtttagggacctctcacactgtacagccaaaccctcatcttttacctttccctcataatcactcatggtgtgtgtgtgttccgtcattgtgtcctcaccaaaattatgtgatttagatgatgagatccttattgtcctcaactaaagaatgaaagaaactaagactcagaatatttaagaaacttgtcaaatgtcatataaccaaaccacaactcaggatgtttatccctttatgcctttgctttttctgcagaaagcaatattgactttaataatccattgacacagatgactactgccaattatctgtctctttcccattgcctgagcctccccatctttccgtgagaacagttgtggaaaaaaattaaaaataaacaaacaaacaaaaaacagaaaccctaggcactcttaagagaattagaagtgaggaaaagaaaaaataaaatcaacgaaaagcaggaagagttttaactcctggaatcatctgagaaactatttcaaactataaatttatataccctacttctgaaagttctgattcagcaagtcttgggtagaagctgggaatctgtatgactaccaagctcccccaggtgactctgaatgtgcaggtagcgagtgaagaaaccactggctcccagggactgaccgaggaacactctttctcacaaaggaccagccgactccaacagggtcagtcctttctatatatgtttcactaactgccttgaaattattcagttgatgtaacatggagatttcttatctagttgaaattagagaaaatcagtgtttgggatataataacatttccctcaatctctcttaagtacataactaaccttaaagagctagagagacatatattatataaaatataccagatggtaccctttactttctatgctgaatatattatactaataggtttgctacagtattatataaaagactttgaatatataaaccagtggaaatctgtttcaaatatatatgtacacatatacacacaaatatatatttcaaatatagtttcaattaggtgcatatacacatgtacatatgtgtacaaatagctttaaatatacagatacacatatatacatatatctatatatgtgtttattataaaatatataaatataatttttaatctaattttttcagtttcatggtttttcattgaaaaatttaatctaagtcagctatcaattagaagttatttcttttttaaatgttttattatggaaagtttcaagcatatacagaagtagacagaaagcttaataagccctcacatactcatcatccattcagtaattatcaacccatgaccattatcactccatccattcccaccgcactcctctgcacttcccttcccctcccactggcttagtttgaagcaatcccagacattgtattactttgttcagaatctctgaatattttcctgattgagacttatttctatctttgtagctctctttcagttaaatatatggataattaggcttttacctagtataaaaagtttttgatttcaggtcatatgtgtagtcatttctatgatcatagatataactttgaaaaaaatggtcctttctttatgagaccattggacaaaagccaagggcacaaacccctcaggtcttcaaaagacagtgaattattttgacctggaagttgtgatcattctaataacaataaaataatgatgacaataaaagtaactaaatttatcagatgtttcaattgtattctaatgcttacatgtattaacaaagttaatccttatgccccatgtgtaagttatttttatcttttgtgtgtgataaaatttttttaacttagaatgtattgtgtcatttctttattcatgtatccatgttgcactgcacttgttaatattagtctaactcatggacacagtattagcttttcttggggaaccaccactgtagtctcagtagcaacaggttatagccatgacccatcaatttcacacgtgcaggagagagcagctgtgagtttcttgaggtttcctagtgactaatggttcaaatggcaagaaagatgcaatgtagtgcagtatggtaacagttctaaatcataagatagtacaaatatgtatcatttggctttaaatttttaattacttaaaattttaaagactggttcaagaaatactggtttgggttgctgaattactttactcaccatttaaagtttgaaaatgagctaccttttcatcaatgctttttaagcttttggggttttttttgtaaatctgtgttgtctctctcaaaaatgaactttaaaaaaatatgctttcaaagcatgatagatactttaaatacaaccactaccttggtttaaaagaatgtttaaaaaaaatcccattgcagtttgggtaacccttacatgaaatgcttgagaccagaagtgttttgtattttgcattttttttcagatttttggaacatgtgcattatacttaatggttgagcagtccaaatccaaaaatctcaaactcaaaaatgtttcaaaatccaaaattctctgagcagcagcatgacactcaaaaggaaatgctcattagaggattttggatttcagatttttaggtttgggatgctcaacttgtaattagaaatgattgcttttgaaaatggaaattaagttaataagcctgattttttaactctaagtaatggaacgtgtataggttaggaattgaaagctgggtcctaaatctccttgtcctctcactaggtgtgagcttacagccaaatcatgtgactccctgaggctcagtgtccccaactgtcaatggatggctttacaggccagcactactctcttctcacctcttaaattgtaggagtgtaaagggatccttaaatctgcatgactgtgtcccaggcatccagtttttctgtgtgaattctagaatggttacaggcctcatctgagagccacttgtagactactttctttccaaatattaatatcaaaatgtcagattatgcagagattttctctttaattctgtacacaagcagaaatagctaaagtcaatattgtcttaaaaaaaaaaaacaaaataaattttctgccaaagtttgagccaaaagttatttctaggctggcttataaataatgtgtttgttatagcaataatgtcagactggaagttacaagagttttctttaaacatagggagtataactttttgttttccaaaacaagcaatggaatctaaatctgggtttttcactgttgaagaaaacagcaaacaagatttggcattctgaggagtctaattatctctccaagaagacttagcagaattccaagcttgaagttctagtctacatgtggtagttctctcctgtgtaacctggacttcttttcctaccctgtaggttctgtcgtatcatgcttcagcagcagaggaagaaacaagagagctacagtcgttagcggtaattatcctctttctttttaaaaattactaattacagacacctaatttaaccaaatttggtaaatatttagatggatacttataaaaatgtttaattaactctgctttcttgcagggatgcaaagtcactgataatacaaagcaaaaggcattaaataacttatactgactgtgtaatatagtgtatgattctgatatttgttttccagtaattgttataatcattacatctttttggggccaaaattaaatttacttttcttttagttcctggagaaatggggaccatgaggtggttgtttggctagggtaataacaaaacaatttatagtttgttactgatacctactctgtattatcaagaattgagagtgattttaatttctgaccatatggcttataaaatgctgtttgaaattggggtcaaataaggtcagttcctgaattctctttgcattatttagcatacaatgagagaaaagcacatggatatgtaagtagatgtatgttgtaggtcttggtttggaatggcttggttgagattaatgaaaatttgaggcactttaacactttacaacctaggttgtcctcctgtgtttaaatgtatttgcgatgacataggtaagggccatgtgagttgtgacaacagttatgtaaggaatgagaaaagtgtgaacagatcattgagagtctttttctgtcatcctcatcatagtttgccacatgctaaactctttgtgcccttatgtacatcttctcatgtaaactgcacaactgttttctcatgtaaacttcataactatgttatgaaggccgcactgaagcctggagaagcccagtgacttgctcaaggtcactgccatgcagtgaaagaatgaggatacaagttcaccatccagagcttgtgcacagaacactgtgctgagacaggaaagatgatccaaatattttgaccttggcaattcaaagaatgatggtgacattaattcataaaagtggaaatattaagatgaatattaagaatcacatgattcaagcaacacccttcatagctgctcctccactctcttttacacaaaacattataatttttgaatagtctatattcatttcttccaccatttacttttaccttttgcagtttcacttccctgaaactgcaggtttgatttaggacaagataagtttgaggtgctggttgaacaaccaagtgaacatcttcagcaatcagaaaaggcaggactcaagcgatgaggtggtggtgtttagaactagaggtggagatttgggagttaacatcccatggtagtgaaatcataggggtgcatcaattgggagagaatgcagagaggtagagagactgagaacagaactcctgtgaatatagccttagatggaaggaacaggaaaagaaaacagcctaagaaggtagagaagtggtagttaaacaaggaggaagatttaggatagtgcagtggcaccagaaggcaaaataaagtagtttcaaaaagggaggagatctcatcagtggtaggaaggatgagaaatatgaggattgtgaaaaagctgctgtggattcgttgattaagtgattattgagaacgcagtttcagggaagtgaaactgcaaaaggtaaaagtaaatggtggaagaaatgaatatagactattcaaaaattgtaatgttttgtgtaaaacagagtggaggagcagctatgaaggatgttgcccgaatcatgtgaagttttttattgtttggttaggttttgaatgtgtgagctggcattgctcacaagcaagagaggcagaatgttcttaggcaaaggcggaggcacaggagtcagtgtgagaataacaatgcaagacagtgaagagataaggaccttgaagagggctaggcatgaaagagcaacatttcttttgcccaaacaagaggatacagataataataatagctacatttgttgagcacttcctgtataccgagcgtgttttaagttctttgtgtaagtcaactaagtttactgaatccacaacctaaatgatcagtattgttagcattttgtaagagggaatttgtggcttagagagtttctattgtgcttctcaggatctcattaggttgtaaggagggaatggtgccagtactaaatccaggcagtctggatccagagcccacacaagattgcacagcactggagagagagtaagttagacagaacaaagtaaaatgaggacttgtaaacattttcagttaaatccatgagtaagaaactgagtcatttgccagtgaaactgagttaactgccaagaacaattctatgaactttagatactaattgcacctgaaaggttaaggtcctttttgagttaacctcatatggaattgtctatatttattttgtatgttgatgacagtatttgaagtgatgaacagtttttcaattatttacaaagctttacaggtttaaagtattattcacctcaggcttaattggcccatttgtctattcttcctagaaggatgtagttttcgagcaatatgtttggtgatttagaaattgtctacatattgaagttcctgcaggcactgcagggttaagttatttctaaaatgaaggtgagggttacactctatcattatatgtgttgttctaggttaaaaaaaaagctagcaataatttctaaagatgatattcaagtttgtttttcactttgaaaatagtagtctttcagaaaaatctgaaaattattttctcaatgtttataattttagcaagagaaaaatacttttgaataactgaaaattgctatattccagtattgttcaaaaccagctgttgttgcatttagaaaatagatttctggcagctgcattgagaaatttagggttacatagcttgtaggtcaagtaattcacttaaattggttgaaattcagcaactgatttcagttctagttgtctgtcaaccaaataaaaatgcctgtacagccctagctacacaggtgtttgtatcatccagcaatcaccaaaattgctgtcgtttgtctggttatctcaatttaaaacccaaaataaatggaaaagctatcaaatattttcttaatttttattttaacaaatttattcttaagagaattaaatctactaaatatttacgcctgtgtccagaaaaatttctccagttataacaaagtaattagtggataggaaattcagaatctttattttttccacttctgttgcttgagtgttgtatcccattataaatctaaccttctcttggcttaaaattgggtgtagcataaattaggtgttaaactgagcattttgcatatatcttttaatgatccttagttgcaagttgcggagataataataaaaggaccccggctgacctgttatggttattagaaagttaattaattatcagaatataataagtgcttatttattatctgaaaaactaggaagtaaatatttgattcattgattgacagccttttttgccttctgtaggagatcagtcagggtggcgggaaaaactgtggaaagatgcaaaccttcttggaaggctgggaggttttacaaaagcttcggaaaaggatttggctgaaggcagccagattctcttatccggtgcctaaaagcttaggttagatagaaaggggatgaggggtgaccatgttaattacccacaagtgtgttgactcaaggcctctgtcattaaatctgtactaaataaatgcctgcagccccagcttgtcagggctgcagctgctacaactctttctgtgggttacctggtcccctagcctgctctttcattggatatctgggtcagagtgcattttctcatctgttgctctgtcagggtctgtgggtcagtcccggcagccttcctttcttgttagaacagtaaaatatataccagggtttggttttataaaatagcttctcatttttgtcacggaggcagtgctgtttcagttcagtccttatagcttagctgaccatttaggcaggatttcttaggccagaattttcctcatcttgaccttaacctttcagagccaaaaacttcccatgaccctgtcttgatcacacatgtgtgtgattgctgcaggtgacagcagtaaggggcggagccaggtacctgacccaaatctctgatgcctaagtcagtgttatggcactgatcaagttccttatgtcaagatgaccatcatattccttcattttttgaaaactctgtatggatggccagattataaatggaaaaattttgagcagataatttaacaaagaagtattggcccgactatcttgataaccactatcactgaactgtaattacctatggcatccagtaaggcagtggtacccaacctttttggcaccagggactgattttgtggaagacaatttttccaggggttgggttggggggcgggcggaatggagatatagtcagtatgggaatagttttgggatgaaactgtttcacctcagatcatcaggcattagattctcataaggagcatgcaaccgagatccctcacatgtacagttctcatgctcctatgagaatctaatgctgtcactgatctgacaggaggcagagctcaggcagtaattctcactcccactactcaccacctcctgctatgtggcctggttcctaaccagccacggtcgggtaccagtccacaactcagtggttgggaagccccaaggcatcatcttcctcaaacagtcctagaaatcctctgaaacaatactttggactttctgtacaccatcgattgagacattgatttttgtagatgtatgtaacattaactgggctacatgtttttcacattggcaagacctactagattttctgtttgattctttctgccttcatgtgacaagctaatcttgtctgttttgatttgattttactagtgggttacttccagtgataagcttagctccaaaatatgagggcactgttcttgagcttcttctttactaactactgtgtatagttctaaacaccatagttttagtgtcattttttttatttggaactcaataaccaagatggtaatcagatctgtgtatattattcccaattgcaatcataaatttactctaaaagttttcttataaatgtatgcatattatatcagaatcttaacattattacatgctttctatatgattttgaaaaactataagcacattataaaactttctatagtcggtgcctctttcttattgagatttaaagggattcacttatataatgttagaaaaaaaggaaaaatcatataacatgttgatgctgttattaaagaaaatatactagtccagtcccactgtgcctgattcatttctttactgtctgcaagatttactgaatttcatactcattcccgttttaaaagtagttttctttcttatctgtctttggattcacttccctcttcgaaaaagataaattctaaaagccttataaactaattgtgtggtttcttctttaaaaacacccctcttgggcatgcggaaagcggagaaaagagataatggtcttccataaggtgtaatgtggcagctgtcaaggtggctttattcaaagacctggaattaaactgctctccattaagaagtatcctgtgaggtaggagtggtggtcagagccaataagaagggcttaaaacacctggcaggagatgtctccttacagccactgatataacccatcaaatatataataaaaataatttctttaaaaatggattattgagattgaaaccttttttcctgtggaccatttatattgaataaataccaaggagcaatataacaaaatacctttatacaacactgaggctaattggaagaatttgacattttatgaaagaccaagttccatcactgccattcttttcacactactttaataaataactttctgaataaagagccttttcttttcttagcagttggctattaggaattgtttccagtttccgtaatttttattttggctcttaagatttcacgcttcagacctaaggcaagcagaatgcctttgatagcagtatgaccttttttttgtacaaagattacacaattgagcaaattgcgtagccatgtagccacatgtctttattttctgctgaagttaccagagactttgctgtagcctaaatatagacctttctcatgaggcatccactaaaaattagaaacgtaataatttttaaatgatcattatatttactttacccaagtatattattttctacaaacacatgctttatggtcttcaaggagaccatacattttataaatgtattattttctataaagtttcttctctattgaataaacaaaaaggcactctctatacttgtgtaaaagggacacaagtatgtcccttttgttgtgtgaatggccattataatgataaaaagttgaacaaaagaagggctgtcatttgtcttaagtgaggcattgataaagctcaggaaagattctctttaatgaaaaaagtaaaatgtggactcacattctctatcattgtgttgttagggatcacttgggcaagctactaacatacttccttctgttattccacttaaaaaatatgtatttcatttatgtatctatctttcccttcaggctgttagttcttggtgataataataatagctgtcatttagtgattgcttaacatgaacttggtttatgtgttttgtctaatgattgaatcaatgaatgaatcaatgaatggattctggaaaacccagacttttagaaagcctataatctagcatgaaggaaaaagaaacacagatcaagctccttcaatacatttaataagattttgctttcttttcccttaaaatgatgaagaaactagaaataatttgagagttgattaaatatataaaacagcctacaaactggtgatagagccagccatgttgagggacactgagataacattttcattgtcagctttcatatttgtgactgtagcaagatggagagcattgggtactagagagagagagatacctaggttcaaattccaggtgtgtgatctcaggcaaatatgtgacttatttgtgcttcagtttctttctctgcaaaattaggataataaaagaatttacctcacagaatcagagcaaatgtgttcctggtacatttgctccattaagtattagttattgctcatagtggcaataggtgggggagggaacatcaattttcaatatctagtagcaataccattgaaatctttatgttcctatgatgttccaagcctttttgcactagcgattccaataataagcactcaaaaaattatacactcatttttttggccaggcgtggtggctcacacctgtaatctcaacactttgggaggccaaggtggacagatccttgagctcaggagtgtgagaccagcctggccaacatggtgaaaccctgtctctactgaaaatacaaaaattagctagcgtggtggcatgcatctgtagtcgcagctactcaggatgctgaggcaggagaatcacttgaacttgggaggtggaggttgcagtgagccaagattgtgccactgcactccagtctggatgacagagtgagactccgtctcaagaaaaaagaaaaaaaagaaattatacactcatgtttaaattagcttaagttgaattaggtaggtggaaagcttactgggggaaaatatgtcatattttgtaagcacaaaaaaagtgtaaactttttattcataatgtataaccagttctctacttatggggaacaatctggaattcaccattttcagtaacttcctacgaaagcagctaaaaattggaaaactttttggtcactgctttctcatcctgggttttcagtgttgttggaagtgagagaatcaaatcttaatgattattaagacaagctgtaactgatttttaaaaattacagcaatggagtatttgttgtgcagatgaaagaagaaactcaattattaaaatttttcaaaagaaaataaattgaataattgaactttaagagaaaaaggcatgtaccacaacatattggttgtttccgccatagtatagttcattactaatatgaatactgtactatagctctatgccaaattaaatttatatgaaatagttctgcataatatggagaaactgattaggtactagatgatttaaaaacccatttatttattcattcaatatttaacccctattctatgcaggcattatattaggtgctccaaatataacagtgaataaaaagtcatatataagataattatacaatttgtataattacaattaggaaaaagaggtgggactgtaaagtataaaacattgtgaaattacatagaaacatattctagagtgaatggtctaagatacatgtcattatccagatcttttcatatgtctcaatttcatttcttggtgctccactccttcctaatcagtgctttaactttcacataggagatgtggcaagtctgtgatttcaacctacactgtaattcaccaacctgtaggataagactacacttgggttttggctacatcagtactacaagaaataggctgttttaggaaagccataaaacttctctagttttcagaccattatttgagccaaaaatttaaagcccagagcccttcattttctttctttaatctctctgacacagcaagaagcagccaacccacttacagtttctgcccatcacactgtgatatggcagtcaccactgggtccacaaaaaggcatttttttctaaactgttcacttaaaatgactgttaactactatttactaccaataacctatccctaatgcagtggttctcaaagttcagcattcatcagaatcacctggaaggtttttgtaacgcagattgctgagccccactcccagggtttctgattcagtaggtctgtgttgggacccaagaatttgcatttttaacaagttcccagatgctgatgctgctggtccaggaacttaactttgagaactgctgctctaatggaaacggatcccctctgccttcaaactcatcaggtcaaatattcaaacttttgagagtctgttgcctacacatgctttcgttgcaaaatagagcatcaacagggttcaactgcaggtagtaggaactactgtagctattttaagcagaaaagaatttaactaagtactttcaaatcattggaaagggtaggtaagtcatcccaggaataagtcctagaacaaaattgctgttctggctcactatggaaacttctacatacataggccagagtcagaaagctgctagcagaactgcaagctgcaggactgcagtattccctctagagtcacgtccccccaaaataatgagtttcccatgtgtcactacattagtttgaaattcaagtctcactcaagtttgcctcattgccgaaaccaaatctatctggaatccaagttgcaagagagtcaaggaaatgtatttttgttagctgtctagcctcttcggaagatgaagactcactagaaaaaggttgaaacagatgttaatggagccttgctatcacaaggactagtgaatgtttccctgatgcagctgagacataaaaaaagttaaagaattagctacgtgaaaacatgggaatatgcattctaggcagagaagaaacaaagaggcctggaagagagccttctttttctctcttgtgagagagattattaattaaccttaaaaacagatgacaaatacatagacacttcccccatccctgaaaaaaaaaaatgacaatttcagaaaagtcagtttttaaaatttagaacattattgcaataagaagagaggctaccacatattgagtctaaccctccactactttaacccagtagaggctagggtcctccatttaagccaggagctgtgaaatatccctcctcctacctgtgaggaagcaggaccaaagtgatgtgtatggaatcgagcatgaaaaatacaacataatcttaactgccaaggtgcacctgtccatgtaccttaaatgctgagaaaaccagagattgagtttaggccctgtacaggaaagtcactggcaagatctagatgccacttacagtaaggcatttggttccagagtgaggaggcagtaagaggtgcttgagccctgtggatacagagataaatgtattaatatatcagagaatgttaaaccttagagatagtctactccaacttccttcttttacacgttcaaaaaagcaggcagagagattgaacatcttgttcagggtgacaaagtcagtggaacatctggactagcacccccaatagccgacattcctttttatcacttgcttcaccttccttttaagtttctgtttctgatcatcatctcatgctgaaatgtaaatatggtagttgatctagcattttgtcagctgcacatcagtttactatttagctcatcagttagatggtatttagaacaattagttttaaggtcactgcaaaattaaaatatttttataactctcactactgctttaactcaagacattcctgcactcaaagattaactctcgttccactcttagtgacttttcatgtccagagttgaattttttttaatttttaatttttgcaagaatggtgaaaagagggccatggtattagaaaaggatcataaaaagacttatgatataattcctttaaagagtcactagaggcccactagtttattagtttgagtggcagatacaattgaagaactcagaagaatacatataccatcaaattgtttgtcagattgaatctttaacccaatgagctttgtttttttatttttttttgcattccatatttggttaatttgacattaaaaccatagtcctgtaagagcttaaccatatttgaattaaacactaatatctaaactaactgttttgtccaagaattcagagacattgtgctctcatataaataagcaatattgggtggtattaggtggtatcacagttccagtggttttgaattggattacccaaccataaaaatacatatacatatttatatttatagtaccttattgttttacagactctgtaaaatatgttctttctgttaggcttcaaaaccgtaatgcaataataaaatcccctgaagaaaatcaaactcagaaatctaaatttgctaattctaatgaataaaagtcactaaaacaagaaactgtgaaaatctggaactgtatatacatcctatgccagaaataccacatactttattccctgcttagtaaatttatttcctgctattagtaaaatgtacaatattttatcctacaatgtgataagtaaaaataataggtaattatgttttacttaaaatcacctttatcccaagcctttctaagttaaacagaaagttgaattctcttgtgatggtcaaagaagcagagtacaagagcttgaaaggatttctgacttctcatggcttgttaataatagatcccagaattctgaacctgtatatcactgaccacaaggctcttatggaaaatgtttgcatgtccccactgggtcagctcagaatgtttgagttgtagtgtggtgtgaccaaacaatcaaaagaaaagattcttttctcttagtagagagagagattaggaattacagtagataatggaaagaggcacaagctatgctggcttccatcctgtagcttttagaatgttctttgtgaaaggaaagaaagaaaacttcctgctgtaagaataatgatgccctaaggaaaaaacatctgttctcctgtccattgcactgtattttaaggaaagcagctgttatctgctttgagttaaaaggtgggcttttccccacctccacacttcccaaacttgagttaccgctccatctctgatgttggaggctggaataaacaactaagccctttatctaaacattttaaatccttctttcttcccctatttcggcccacacattagcctatggaattgacttaacagaatgcatattttctggtcagttttggtcttgggaaaaaattcttagcttgaatgaagagggtgacattcatggaaagtttaaacaagtctggtatatgtaagtgaaatctgaagtccagaataaaaaggagaatgtgcaagtgccttcagatttgtagggaaatctactttagattgctccataagattttattattttgaccttttgacttcccaaaagcaaagtagtgctatctcagatactcataggaaacttaaggggtttgagaacctggctgaaatttaatttttcttccctctacttcaaaccacgtaaaggcctccgttggtccagttaatagcctgatctagctaaaacagttaacaaagtgctgacagggtaaatggtccaaggtcagaggagtggaggttcctttaaattcccatcccacagggcccagcaaaacatctaggagaggagcctgtgcgctctgctcagtctgagggagccagggctccttggtccaaatgaatgttttttaataggcacccaggtgattcttatgatcaggcttgtgtgaggcaagtatggtgggaggcaggttctgctagtctgggcacaggatagtcttcctggactggaggcctggcatcctcattccttaactagctgggctgccactggcaagaaaattaacctctttgtgcttaagttcctgtacttgaaaaatggagctagagtgtccacttcataaggctgtcctgagaactaaccataaaatgcttagaacattatcattacccttcttaccagatgatttgcagcccagagcactgggatggttccagaatatttactcaataaattataaatttcttttgagtgaataagactggggaggtataaaggagccagatcactagaggagttcttagtgttgctcactgttccaggtacagtctaagggtgacaactcccttttctccacttagcctactttgaaccatattaattacccttatgtggctcagttttaaaaatgcagagagtggagttgccactgtacaaaaaggtttctagtgtctttcattaaaaaggaaaaaaaagccacaatatgctatttctctgcagcaaaacaagaaaaccttgcaaatcactgctgctttaattaacagcattttttttttcttctttccttacccaaggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggtaggaatgcagcaacatcctttggaaaagtctatgtgtatgtgtgtgtgtatgtaagagagagaattggttttgaatgcaaatatggaatagggatttttacattttagtgattaatatactgtcacctaatatatacccgagacttttaaagaaaaattatcattatcaaaaagacatttaatgggctcctagcatgtatcaagtatcagggtgaagactaagggagagtgttcctaaaaataggagcaggatgttcaaaggcatgacagcagagattgggggtgagggccaggagtactgttgaggggtaagaatggcaagagaagcaatggaagaaggtgagaagcaaatgatacggaaccttgtaagccgtacagatgaatttggattttaccctgaaaacaatggtgagtcacaggaattttatgcagagaagtagcatgatctcactgcaatggttataacaatagtgtacagggaaggaccgaagcagagtgaactcctttgaaaatgaaggaggaaataaaggggcctgatgggaggccaagcttttagttggaacagggtcacccatatgggtgaagatgaaaactgattttaacctctgttgcttaccttattcacttctcagaaaatagaaaaacttaaatatcttctaatatcagtttggagatactagggaattccgttgtttcataatggctatgtattataatatatagcatcaaagaataagaagcagcagaaaggactatttaaaaaaaagaattcagtaatcttgcctttaaaaattactttttctgatcagttgaatgtctagtctccttgtacagatttcctatctgaaaatttaaatatcttgaaggcctccactatttagcattgtattaattcaggactctgccaggggcacatttcagcgatgagttgtccctgctctcaaaggcttcacagaaatgaaaactaagagtgaatatagcgaagattaatacattgtcatttatggtattattggaggcccaaatctggttcttcctgaatttaaccaaagtttatgttactctttcttaggtgaaaataaagaacaattgtccatagactcttacctaataatactttactcttgttagagtgcgttgattaagggatatcatgccatttaattatttcaacaagttctctagaaaggctgttactgggattactgttatccccattttacaaatgaagaaattgggacagcatggtagagtagaaagatcatggatttttgagtcatacctctgctactggttagctcttttttcgttgggcaattaatcactcatattctcagtttccttttctgttattaggggtaatggtattattctccccatgggagtcttacgagaattatacgtgcatctgtgattatctatttgtatgcatgtgtatgtatgtacttatctataatattctgtttaacaaacaggtgtagagtccatgtcagttatcccattcttaggccaagtttgactggttacatcactcatcaaatttctcaatagtaggtcataaggctctttttttaaagccgtatctattgatgagatgaagatctcatttggagccagaagttctatgtgaatctcacttctgcttcttgctagttacaggactttataaacctatatagtatctcaaatccttttccattcctgagtactcccattcttgaaactaataatgattctgttgaaaggacttggctagagtagaggaatgtgattcttgtacttttaaatgaaattcatataagttgatttatttctctttggcctttagatagcatttgagggttaggtaatgaagataatcactcaaagtttctgtagaaatctttattcttaccagttgttgggtttttatccatgaggaaaatatttcctcttaatgtctgattcatcatcctaccttttctggttgaataactattattctaattctggccaacatcaaacttgaacattgccatcattctggctggccttccttccttagtgcctcttctgttttgtttctttcagatattattgtcagtataattttaggatgatgaaataaaaatgttaatgctagagaggatgttaacatcatgaagctgttgtgactaagaatatttcatattgaaagatcttcatgttctctgcatggcttctaaatctttagttattctcctataatgactgtaaccattgcctcttgctgatctctgaaacagattcttcattctgctcaagccaatctgcatgtgctgtgcttattttcactttttatcttttacatctcattcctccctgaataatgtctgttccactctctaccacaacaaacatttctcttcttcagagcctgacttaagaatatctgtttgtaagagaaccctaggcttgacttcatgctgcttcaattgctatttggcaatgtataaacttgctctcaattttatgtttatttacttatttcctttatatatgcaattttgttatttttcactactgattgagtttcttgaagcaggagctaagctgttttctgtttcttctttttctccggtggcatcttgagttcaccactcaggaaaccttccataattgttagagactgattcaacgtattgaacatgctctgtagagtcatccaaactgcaaataagtactcagtagtcctgtacaaaatactgtcttacaaattttaatggtgtccagcatatccactgagaacttaccagatatgaccataattttcttgtatgctgttgagaacatcctggtaacagaatctaaaactgtacttaaatataggtactaactactttgtccattgggttatccaattctattaggtccgtcttaataaaaggaaaatagagtagtccattaggaattatgtttcatagagtcattttggtcattgtttcacaatatatggtattatatatttaattatatctgtacatttatgattagtaaaaagatatatccaaagtttaaatttctgggttttcctgttttttttcttgctgctttaattaatcaccagtaattttctgcaacatattttctaaacatatcaaagagagtttatagatcttacttaaaagtctctcagtaagattagtctcccagtaagattcatccatcaccttcctgacagactctattcagatatgaaaaaatggtgtaagaagctgcagtatgcttggggtgaacacattcaatcttaggcacacagaaatcctccgcttggaatatggcaactcagtgggtaaaaaggttaggagacattagtgttctttgttatcagaatttcctgtaaactgagcaatagaacaggaataaaatgacctgaaaagggaggatatggaagcattgatttcccaccaagttctttataagcagtttctaccgacaatgaagaaaccttgtttttggcctacttctgtagctaatcgtattgtgttgaatattgtcaaagcaacattcttttccctggtactttttccatttcccagggcaatgttctttgtgtttgaagcaactccagtgatacatgtagggagaatcacatatttattttacaaatccccaaaagtatagtaaatcactcagatttgaagagaggcagattctgatgctaacacagaccatgtttagggcccatgagtctctggggattttatttaatacaccacttagaagttgaattaaacccaactcttgagacttgctgaagtctatcctgcccccggccatcttttaaagtgttttttatatggaccccagggctttatttggcacattttttttttaattacttctttgtaaccaggcagtaactacctgaataagtataatttaaaaggacaaagagctaatgacggcattgtcttgtagctccaatttgtcctcggacatgtgctatataccttgttactagtccacccccagggccttgcactaaataccttcacggatatacaacatgagagcatgggaagaacttgggagtggccgcttttatggctctcaaatggtgaattcatacctatgtgaacctttggactctcctagttggtgacacatggaaatggcacatggacacatggaccttttattaaaaaaaaaaaaaacctacccagtgccctaccctgccaaaaatacccttcttagggatgtcttgtgttttatatcaatttaattagcatggtacttaacatggtaggctgtggagtcaaattgctcaagttagaattttggccccatccctaactaacaatatgaccttcagcaagttacctctctgagtgtcagttttcttgtctgtaagatgatccaaatcggagtatcaggctaaatgtgaatgctttgtagtgtctggaacatagtaaatgtgtgaagatgttggcaattattgttactacttatgttttattccctaaaggttctttgcagatggattttaagtgttaagaagaattatcggaagaatgttgcctatcataattggagacatgcctttaatacagctcagtgcatgtttgctgctctaaaagcaggcaaaattcaggtactttttagagccattcatatatctaatacattttgttgcttagtagtaaaatttatagcatattctttcaatttcactttaaggtgcacaatgatttaaaataatatttgctgccacttacataataagttatatttcgttaattaaagaggactaatctggcaaaactacttcgttgctaattttcttccatatatgatatatatggcatattagaaaaccttcaaaataacttcatgttgcacgtaaatagtctttgggcaaataaatatttccttctgaggaaaacactgccttattaagaaaaagtaagaaaaagtatcacatttctcttgttcacattcaacctgctccatagtagaattcctcaaaaaccacctagttcctgaacttgcttcattgataagttaggggtctgtatcgcattttctctggagcactcagtaaattttgtaagtactgtttcatagaaagggttttggtttcatatacattgaccagagactgtttaaaaggaagatcaatgcagaaaacgttcaagtaattcgttcctttccaggccaaattttatccatatctctgtccttagattctaacttcagtgggaatcgactagttattctaggtaagtgattccaggcatccatcatataactgtttttaattcagagcttccctgcctttttctttttgtaaataaattcttaaaatgttattctctgtctctactttcatagggtgcacattttaactggctaaatctaaaagaagtgattgttattaaagaagtgaggtgcaattaaatacaatagtagtattttcctaccttagcaaacacgtgtaggttgagtatcccttatccgaaatgggacaagaagtgttttggacttcagatttttttcagactttggaatatttgcattatacttactggttgaatatacctaatctgaagatccaaaatattccaatgagtatttcctttgagacttattggtgctccaagagcttcagatttggaagcattttggatttcagattagggatactcaaccagtgtaagaaatcatgtaaacttattttggggtagggaaggtcacaaggattatcaacactgaaaactgtcctagttctctgtgaggaataacaaaatgatgatttttgtgtttgttgtaaaacctatttagagtactgagagttctaggaaaatacagctgatgataattttaacttgtgttttttgcgaatgaaggggaacagtattaatgataatactcatagcagatactaaaaaataacctatatttagcttgagagtatattatgtaactttttaaagccaagttttcatttcaaatcattttctttctattgttttgcttgaattaacattgtctgcattccttaaggacacagcaactgatagcagagagtgaacagaatctgcagggaattaaaagaggaaaaaaacaattatttaaagtttattatgattatttcacataataattaagaattagcaatacttactataggtggacagattattaatttattgaggcatttcagcttttcctgttgataagtgacatttgtggtgatcccattctgaatgacaaaggacaactaattccctgaagaataggattctagggttagtcctttgtgactatagagaagtatgtatgtaaagcactgaggggaaaaaaaagattactgaaaagaggtaatataatgtccttcaccacattatatttgttctctctttcctccaatgtctttggtcatgcagaacaagctgactgacctggagatacttgcattgctgattgctgcactaagccacgatttggatcaccgtggtgtgaataactcttacatacagcggtaagactttcccagtaaagcaagaaaatgttttcttttaattgtagggctgtctttttttaagttaaagccacagcaaaatttgatggtcaaggtcccataacatactctggttatatttaaaggaaatggaaaaaataatgcaggttaagtattatgtttataatttttcagccctgaagttcaaaacatatttatgttgagaatcttatttcattagataattaccaggagttttactttagtttatatatatccagcttaacagcttccttagaaaactattaagactagtttagaaaaggtaacattttaccctacagtagaaaagataatatttgaaaagtgcttagctcggccctacatacttattaagtgctcagtagaaggaggcttttggtcttagtggaagctacatagcactctgttggaaaactggtcctctgtctaatttctctataccgttatgtcctgatctgtaaaatggagataatagttgtaaaagataatgcacatcaataccaagcagaatgcttggtacctatttaagtcttaaatattagaagcagatgctagagatgtactgtcatcagatgtctgctcattgactgagtttgagagtgagacactatccgttaggacaagtgtcaggctcctttaagagccatacttaagtggcatttgagatgacaaatgagaggataaaggtgacatcacttttcatcaaatgtttgagccactgtgatatttttattttcttacaggaatttagttgaaaggtctacattttaagtgcaagatctcttactactgagcattttttaagtacacaagtgattcaactaatgggcagatctctcaaggaaattccagatgtctgatatctagagggaatttcagaaagctctctaatcacattcttcttatctaaataaatggaaaacttcatgtagaaagaattgtagtgatgtaacaaccatgtcctctgctgacctttgatgggaaaagatagcaagctcttgcctgagtatcagagtctggctgtttcctcttgaaaaatctcatgttttggagaactgactgggtgacatgtcctttgtcccctgtgctttgtcatgtgattgcaatcctgagcctcacacagacacagaataattatgaaaggggacactgatatgaaaagatgtatagtacagagtcaagccacatagtacgcctctccacagtcagcacaaccaaaagatcagaataagcatgtgctacactgaacataatattattagtatgtgtattattagtgtatggattgctctaagatgctatattgccctgctttagagtgaaaaaaaaaacactcaactattttttcctttgtttatttaaaaataattaccccaaaaacatctggagaaacgtcatcttctccaaaaaaaaaaaagaaagaaaaagaaaaagaaaacatcctgggaaaaagtcattgactgcagaatcttgctttcacacacacaccacaaagcagacttcaactttaaaaaaaaaaaaaaagttaaagcagtttcaaagatttttatttcttcctacatccctgtggtttcagtagaggaaaccaagaattttccagggatttttctttttttttctttccttgttggtaaatgagtgatacttaaagtagaattttcttagccaggagacccaggaaactatgagtaccataaatattcccatgtaaagtactatcttctaaaaaggtatactgtgtccagccctcatcagatattcaaactaatatttagagaaaatcaaaaaataaaacaatgcacagagatgaaagtaatttatcaaaaagagaaaaatggtcatgtggtggcaaaattagaaactgagattttcctcattcattcttgaacatcttttcagaaaattaccctgaaattaccttggaagaagatatttctccaatagaaagttgccccttgagtcatcatttgattatttgatgccttctttgattaggaaactaccctcgtagaggagttctacaggtatgccagtggcatatatgagagaagagttcactgctcatgcttacttctcccacttgggtgaatcaagaagagaatgagggctgggcgcggtggctcacgcctgtaatcccagcactttgggaggccgagacaggtggatcacgaggtcaggagttcgagaccaggctggccaatatggtgaaaccccatctctactaaaaatacaaaaaacattagccgggtgtggtggcgggtgcctgtagtcccagctacttggaaggctgaggcaggagaatcacttgaacccaggaggcagaggttgcagtgagctgtgatctcgccactgatgccagcctgggcagcagagcgagactctatctcaaaaaaaaaagaatgatctcagatagatactgaattcttattttaaaaataggcagtaataggaacaaaatagctaaagtgcagacaaccactagagaaaacacaattgtagcatttgggttatgtagagagattacctgcattaggtctgcattcagtataagaagactgttgtagatgcatttatttggttagattcaagtttggtgttgataaataatgcagtgaaattatgttatattctaggcagatagataatgaataattattatactagggcttttgccctttgcaaggcagaaagaaagtgatagaagtataaaatgtgattcttgccattaagaattgtcatagtctcatgaagtaatagtgatcactacaagaaagtatctagtcctgagttatttagtgcatggactgtaagtgttcagcagagaaaactggtcaagacagatgtagtacatctccattgttaatggaggaaatgagacttaaacttggtcttaaaatgtgggtaggatttagaaaggagaaaggataaatatatttcaggagcaccatgaggtaagcatgttcttggaatagtggtgatggctagcttgactagagttagaaggttcacactgattaggaatgaaaaagaagagaatgaacaaatggaaactttttgatgcagggttataaaattaaccagtgcattatagatttgatatgggtgggaaaaaggagccactgcagtgtgtaataaatgcacagttttaggaaggaagtctgaatgtaagctacaaggtgaatgggtagaaattagaaccacagagctcaactagaaagctgttacagcaagtcaagtataagctgaaaaatcacatactggctagagagaggaagagactgaaggagaaaaaaattttttaatttaataatgagcagctagttatatataagcatgaaggaaggagatatgacttctggtccaagaaactggaacagtgatggtgccattgatgaaaatgaaagagctgggaaatatgtatatgtgtgcactgagagagagggttggcaagaatggaagttatgggagttttggtaataagtccagtagaagataataaatagggtggtagttagaagtggtaaaatgatcgaacgaatgtgtttttttcaaggttagagatgcaatacaatcagggggagaaaaatctcctggtagccacagtcacactgtatatttgtcctgggagaacttgttctatcccatgactgtcttctctgctctaatagaggacagaagtgagctgaagtcatggtctggcacagtgggaatagagggtcagcaggatgtgagagacttaaaagggcactacacacagcacaaaatcatgtgtgaagttcaaactgggtaaagtccattttacccatgaatgagatgatctctggtcaggttggagatcttgagagcctggagatctgactatgaataaagtgaaagttcaattcaattagtcctatgtcagtagtaaatactaataatagaagctaaaactttatataggccttatgccatttgaaacgtttttgcactttttatatattagttcatttagtccttataccaccatgcagtggctgtgatggttatggtagttaagagccaacttgagccagatgcctagcttcaaatcttggcttctctctcctcttactctgtgaccttgtgcaagtcattaaacttctctatgtccctgtttccttctttgtataatggaataatgaaaatacctatcttctgggattttcataaggattaaaggggtataaatagatgtaaagtgcttagaacatttcctggcacatgttaaatgctctacaggttttagctattttcacaggggaatgttcttagcaacagataggagttcaagatcttgctttgtcctgtggtgaataaagggagtggcaaaaatactgtgcccagtagaacctagtagctgtggaacaaagaagcggagccctgtccatcattatgtgcaaagagataatcagtagtgtcaaggaggtcagagaattctgaggtcaaaaggtgaaatgaatcatcattatgaatatttatgtcattgaatatgattatagacaatgagaaggcaaaaaaaaaaaaggttgattgggagaagaaagcaatagtgatgatttgaagagaaatgatgaagtaaagaactaaatgggattgaaggttacaaagaggttgttagagaattgagcccagagtaatatatatggctaagaagcagaaccaaggatgttgtttgttcttggtgacataggaagactggggtggcaatatagtttcccacccccatggggctttcattttctatagatttctaaggctttctatttttaaaatattggtctgatttctgcattggacatcctaatactactgtcagagatggaccaacaactgtgcagaacagaggaaaatgcaaagtgagtatgctggtccattagtgctcactgacagcagtgtgagaacaaaattctgtagcagtagtggtttaaatgggtccttctgatgcaaccttaaataaagaagccacatagccttgtgtttgaaagaggaaaatacaacagatagagaatacactggtttccatgaatgtttttatatacaggaaattcgagtcatttgtcactctgttatggattcataaatctgtatttttagaatgtaagtaaaggcaaacacagtttgcattcatctatctcaagccaagaattttctctaatgtgaaacagtcccttctgcgtcgtctaaaaatgtaatgtgtgtttgaagttctaacttgtttgtgttaaataaccacctaattgcatttcgtagtccagcccctaagtgggtcaatgagtggatactgtgtgcctttaaagtactttggtatcctaagacagtgtgatgggttgaagaggatatacttgaatgccagctctaccatttatatcaaccttgagcacattatttttcactgagcctttgattgtctagaaagcaaaaagatggcaactttagagaggtctcagctgaggttaccctggagacacaacctgagatgaaagtcagtgtgcatataggctatttgtgaatatgaccccagggagcaggaatgcagaactgggaaggaagcagggaagaaaggaaaggcagtagagggatgagttatccagatgtccacccatactggtgcttagtcttcccaggcacttttgaggagtcttatgaaataagacccagaactgttgactggcaagacaaaggcagttgtccctaggtctttgtacccccctggtccaaggtggtccacaggccttcactctttgacactttcaggatgaacaagtatgagtgcagagaacattcctctgggcaccagttgtggggtcagaaagctctaaggcagaagtgagaggtattaaagataggctgggacaaaacaccttctaattggtacttgcatgaagtctgttaaagcgtgcatgaaactggacactacatcagtggatgagtaagaggtgggattgagggttttgatgtcgtaaatgggcatgccctgcacaaggttattgtaaaaattaaatataataaactaaaaaaaattaaagcaaactacctgacatgttgtaggctctcattataggccatctccctggatgatctcacctactcgcatgccaggattaccatctgcattgttggtgcattccaaatctatatctccagcccagaactgagttgacatttatatccatttgggtatatttcaggcaccttaaaatgaacagatccaacattcagctagtcaggttcccctgcttcatcccccatctttaatcatcttctcccttttcctgtgtcagtaaatgaggtcagcatcccaaggcagaaagtttaacattcatactttttccctttatctccctcatcccctcatctccctcatcccactcctagtcaggagtcattaccagttcctatctgatctactcttaaacagctctcagatgtctgcttctcttcctttgggctgctaccactctaatccaggctctctctgacttagattactagaagtttcccagtagtctcctaactaactcccatagtctcgatacatacgcaatcctgtttccagtaagttcatcctttttcagaaatatagtcctgttactctgttcattgtcatcccattttctgatgctgagcacagtacctgatccatagtccaactcactaaatatggaaggagcaaagaagacaagaagggcaagaattaatttgggaaaggttaggacaacagtaaatataaacaacactttaaacaataagaatagatgagattatctgtcctattacctttattttcactttactattttctttttccctcagatttctctcactttacccattttttcccccacattacatttcttcagtcttaggtagcttctctatcttcaacaaattaaatgcaaagtaaaataatcattcagatagtaataggaagaaataacaaatcagttgtattatccaacacttgtatatggagctttacaattcacaaacccctttcctataaattttatgaacagaggctttcagaaacttcatctttttcttatgaagaaatagtgaaaactatgcttaatattcacgtgtgaagggtcatgagaaacatgaggtggaggattgtgcttgtcgtgctttaaagctttatttgtgactgtctcagagatataatgaactgagtataatatcctttcctttctcttcactcagccaaagggtctctactgcttcaccaagttcaattagcagaactagcaggatattctgcactaaaatgacctggatcctacatggggaactttccaactcagccgtctccttccttccttccttccaagggagcatgtacactgactatccctctttttcttgcctttcatcaatcatacctcagttaattccatctcagtcagtccttttcttatttgcaggcacacatgaataagctgaccttcagcctgagcattatttcagaggaaaagctaacatgaatttgtttcagattttatatcaattgcagttttgaaattgaaaaatataattggtacaactatttcagagggtttttttccatgtttggaggtattaatttttttgtctttactccttacttctattttaatcagtattaaaaccaatgaaattgttcatactttactctggcaatggtcacattggtatttgaaaacaatttgactctttgtatttgtttcccagagattatctcacacttttctcagtaaaaggagagaaaattgttagttgattaattttgtgaagtagcctcttttgtagttaaacagtaataaaaatgtactgataaatggcatattaaggaaactgatcttttttcctttcttcaacaaaatactttcagaagtgaacatccacttgcccagctttactgccattcaatcatggaacaccatcattttgaccagtgcctgatgattcttaatagtccagtaagtacctaatttattgttgtggaattttaaaagagagctttataaattcagttttatttttagttcttggatttattcccagcatcataaattcttgcacatactttattcctttttgggtaaggaaggcgaagccaaaacatttgagatcctcacagcctcacttctctagacaaccagaactgtctacatgttgcccaataagggaaatttggttattctactctacgtggctattccaaattagaaacaaacaaaatgtgtattttgtggctctcagttaattctgctttttttgtttaatcgaatgaagtggtttctatagctcaagcatttgctttcacaaagcaataccctttcttctttttattgaaacttccagtcactaagagaggattttattaaagaataaagctatttaactacttggtgaaatgaatatttatcaacataagaaagcatatgctatgctatgctaaacatacttatgttaaggaaaacaagattaacataatatgcaccaggatattaacaatgactgtgctggtgtaatgaaattgttaatctttgtttgggggggatggttgttcattatttacattgtcggctgtgtgtatgtattaccttaataataagaaaaaatgaaagttttaactattacattgaacatacacaatgcatgacatataatcttaaagcaattttacaatattgctaagtttactcagttgggctaattctttcctgagccctggaaaaaaattcagggattcccatcacttttctggtcactattttataagtaaaagccctctagttactttaggttccaacatatagtatagagttctcaactcagaaacaaaaatgtgtactcctgggtagcagtccaaattttgaacatgatttaaagtttcaggttttctgttactgcactggtaggcttctcccattccctaccttgtgtttcttctaactccttcctctctccccaacctccatgtggtttcttacctcttcatacttggagaatgggaagggagaataggtaagaaacatcaaaacattcttaacagactggtactgatatgagtgccttgcttttagactttccagacaagagtcagacacaagtctactctagccccacctccacccactaaatgataggagacatacacaggaactccacacccctctctcttacctgaggtagaggggaacacactctcacgcctccctcaacacctcagtgtcggggaggaattaagagttatatagcctgttttggcaacctccttataaaatctgtatatggtctagtacagattgtttttctacaacatgtgactgtttaatgtgaattatatcatgtgtgattgggaggtagaagaatggtatcagtatactatagacgttctatcatttcatacacgacttctctggggtaagaggtgccagaattatagaagttgaattctgaccttcagcaataaaggaaaaagccctccctttggctcgtgcatatacagccctttccattctatcttaggaatattaaaaatgagcacttgcacctgaggctctctccctcgctttggactgctgtagcctcttggtagcttgctcttctttcaatgcccaccttaatagcagagttactgtctcaacaatcaattctatatgcattattgcagggcccctcaaaccagcatttctacttgattgtttttgtccatctttaatgtcctcagaagcagcctccagacctgccagactggcctgtccaagttacttccagaggaaccaattcttggtttagtttgtgctctggttacaaagttgcataggttttgagtggtctttcccaataccattttttcacaaaatccatgttatttttagtgtacggtttttcagaactgaaatttctcaggaatgtatatgtcatgttatagtaggaacatctgtacttttgctatctgtgtgtttccactaaaactttcatttcagtatcccactacaaatttagctccaaagaaagaaaatatgcttttttaaaagcatattttacagtattcctatcaactgacctgttactatataacttattatgtaatatgttgttacttaatatataaggaatctgattatctatatggctggctnnnnnnnnnnnnnnnnnnnnattataagacctatctatatattctatctttgtaagcataattacacaagaaattatatcctcagcttttgagagtaaaaaataaaaatatagcaccaaaagacatttcatcttccacttgaaattgttttatcttaaagtaagtatcagaagggtattttctgaatagttttctgtttagcctagaatctaaaatgatttagtatttaaaaataatggtttatggttgtaattatagattattgtcattaattagatccatgccacaatttcagcatctagttatcctttaatcaatgtgttttggccccagcctaacatacccagaagttctcctgtcttcataacaaatcccttgccttcagatctcattcctaagcgtctgggttttttcttggccctaagatataggaagcacatctgactcaacttacagatgttgttttgattgtattctgagtgcatggtctgtgtattttacttagttcaagattagagaaccactatgctttaaattacagataagaaataaaaaatggttacatagtgaaaactttgaatgatttgcacatggattagctaccttttaaatattccttatagatgtttcaacccacgctttctttcaccactgaccagtaagcaccctttggctcatgccctttacccatctatattaagatgttcctaaggaatatgcactgttatcataactgaccaagttaaaattatataaatttgcaccagaaatgttactggatttatttaaaatgccatagagaagtttaaaaattttaccacttctttcttcatatccattaatatggcttttttttcaaagttttacatgctgttaaattatagcgattagtctgccctacggaaaaggatagctattagattttaagtctggactaaggcttaaggagtataagagttggaaaaacatgcatatgtaggcagatgaagcattatgaagcggtttacatgtatgacagaggggttgggtgggaacatagaggggaaactttatttcatggtatttaagtgtgtcctccacattcattagaatactgggcatgtgtttaagatatgtgaatatatttctagattttgttcttgtcagcagcttctccaggatgttaatactggttttctttttttataaagggcaatcagattctcagtggcctctccattgaagaatataagaccacgttgaaaataatcaagcaagctattttagctacagacctagcactgtacattaagtaagttttaagaaataacctgagaaataggtatttgaagtcttttcattgtttcaaacttttgacatccatattgagaaatttcaaagcagaaatgtcctggcaaaactgcttatcagaatacggagcagtttctgaaagggtagccagaaaagtctactcctttggcttatactgctgaaaattaagaatacctattatttctgatgtttatctaccactgtgtctctgaaactatatacaaatctaatagccatctcaaggtcagtcattccaagccatgttgtccaaagattatatagatcatttgcttttcctcctttcccttgctccccacaacttctgaccatttcatgactcctttataccgtcattcaagcttagttgggcaggaaaaggagttactgccaagcaagtaactcttgtttctttttatttgattttggcaggagaagaatatttatgtagaactttgaagttgttgattctaaaataagagtatacattagagttgtctctgtgattatgcattttcatgattaaactgcctttctaaaagctagaaaatactttcctgcatttgagcaatcataagtttccaactcctagctgagatctttgacgcatgtgtgggaatgaggggagtcagggaatcactctcaggatttccttgtaacatgagtctctctccctctgtaaggaattcacattcatggttgtagttactcttaggagaagtaaaaacacatagaaaaaacacaaaaacatctgccagatatctactgttatacatctagaagtaactgcatgtgcctacttaattggtttttagagcattttgaggttaagacaaaataatatatattaatagtaaacttcagtttattaaaaataattgcagaataaggattatcaaattaccaagaatttgaaaaatacctgtaaccacaatgcctttctaagctttacaggccacatgggtctctcctttgaacccttatgaaacatacttttcattttttataatcatatactatcagttttattacgtaagtttttcttgagtcttgtgtctccaggtagatattaaacactgcgaaaagaaaaatttttgtcttatgccttctcaaaatgcttaacaatactgggcacataaagaggtattcactgtacaccaaatattattatattcactgaataataacaaatattattttattttaaactttacctagtctttgtttacttcagaagcacttcacaactttagatatttttatcccctaccatgaaataaatgataaactgaaacctatagatcttattatgccatgcacttaaaatacctgaaatcattctcagcatcaaatttttaactcatactgtttcatttttcttaaaataacaaatattcaagaattgaaattaccataatttgtgatctatagttaaaaattaggtgaggtttaatgttttatcgaaagcaaatgatagaagggggaaagtgaggtattaaagatttgtaaatgatgattttatagtgggctctaagatgggaaaaaaaatcagaggttttttttcaccaaaatttagtccatgagtctttgtggaccaaagggataagaccctgggtactcattataactaacaatttttttttaaacattgtaggaggcgaggagaattttttgaacttataagaaaaaatcaattcaatttggaagatcctcatcaaaaggagttgtttttgtaagtaggtttactatctttaaagctgaagttttttacccagttaattttctcactattttttcctcactgttagtttttattgcaattatttgttacaatatgatgatcttaaaagcggtcagatttctccagagggttgtacaaagagtaaatttgaatatttacttgaaaagaaatgcatttgcaaatccaagtgaatgaactgttcctttgttctagaaaaacctttaaaatgtggtagagtatcaatatatggctataggtttcccttattcattttcctaattcattgtaatggaagtgctgaaaatggaattataaatgttgtggaagtaagatatagctgcaaaatgtttacttctcttaaagaaaatctgaaaaggtagagcagtgaggtcagggtccagacatggaaggaatactattaagtctctatgattaaaacagtttgatattggtggcagaccagtggaacacagctgaaaatctagaactgcataagacatatagtgtataataaagataacatttccagtgactggaggaaagagagagataagtggataaccaaatggaaaaagacaaaattggatctactctacagacttaaattccaactgaagcatagagttcaatgtagagaattaaatcatacaagcattaaataaaaatatagatggattcttctataacctaggagtgagaaaactttcctaactataattcaacatgcagaaacaataaaggagaaagctgaaaaacatgattaatcattcaaaggcttttcatttagaagttaccatgtgtgttgagtgaattaggatgacctactataatttctgatataagacttttatcagtatgatacctgatgttgtactttaatggttattagtaatcaatgtactttcatcatactgtcgctgagaatggaatactaaggtgacaaaaataataaaagcaggcaagattttacccaaggttaataatttttcagtctgccaatctggagctaaatgaggcagtttgaggacaaattccaaaagttcaaagggaaactgaaacaatgatgctctgttatcaatgtattagttagactttcatataaattgtttctttttctttggtctttataaactgccatttccattgtttagagggttttaacttttttttattagtaactatttactgagggtatataataacacaaaagtaaataggagtttggggtttcttttttccataacagggcaatgctgatgacagcttgtgatctttctgcaattacaaaaccctggcctattcaacaacgggtatgttacttagtgacaataacaataattaaaaagtcaaaataacattctacccagcaatcccactactaggtatctacctaaagaaaaataaatgactatataaaaaagacacttatatgttcatcacagcaccatttattatataatagcaaagtcatggaactaacctaactgtccatcaacagttgattagataaagaaaatgtggtacatatgcaccatggaatactatgcaggcataaaaagaatcaagtcatgtcctttgcagcaacatgattggagctggaggccaattatccttaatgaactaactcagaaacagaaaatcaaacactgcacattctcactcataagtgggagccaaacagtaggtacacacggacataaagatggaaataatagacactggggactccaaaagggggaaaggtgggaaaagaacaaggggtgaagaacaacctactgggtacaatgttcactgtttgggtaatgggtatactagaagcccagtccccaccaatacacaatatacatatataccagacatgcacatataccccctaaatctaaaataaaaaaaatttttttaagtaagtttttactcttaaaggtagcttctgaagtaagtatggaattttttttggaatttttaagtagtattaaaaacagataattggacatacaaaggcttttctttttagaagatgcatttgcacataatatttgtaagatatattaagaaagagagcatctacattagcacagttttcatttcagtgtgaaaggctgagcatacttaatgcaaaaacccaaaatgttccaaaattcaaagcattttgagtactgacatgacacttaaagaaaatgctcattgaaccagcattttaggtttcagatttttggatttggaatataacttatacttctggcttacttgtttcttaaggtcatccctttaatgaccttgaaaattagaagaagcaaaattacttttcttatggttagccttctacgctgtgcctcagctctaaatagacattaacaagtagaacatagagatttctggggcttgtagatgtaggaagtattgatataagatgtcgagaacgttctgaatggagcctgttaccaggaggctagaaaaaaatccttccctctaagtaactgctataatgttttgcagaggcaatacaggctcagaaaaagtgatggatgtccatgcagtgacatatatattgtgtttttgtttttcaagatttcattttgagtccgtaataaatatgctatttaggattgttgacagcctgctgttggtcaagactccgggctgcttagtcagggagcctagtaactcttcctacaggctcatctcatgaaacagacatgccgagaaaacaagatcaaaaactcattctccatgtgccaaagccaacacgccataagcacttaggtgatctttacctaccttcctgcccataataaacaggactatatgcctatttatttctaaccaggtaagagaatagaagagggaagaatgtgtcttcatatatcctttctctcccctgaatcaaacccttgtacatactgttttatggggggaaaataaatgaagaaaacatttttaaataaaattaaaagggaaaaatgttggaagctaccaaagacagagagatgtacctaagtgaaaaagagtataatgtaatagttaagagagcacgctttggacatggactacttgtcttcgggtatcaagctgctgcttatttgctataaaatggagatatacagctcctaacagggccttcattcacggtctctgttttaaagaatgatatgcttttcattgtcaaaactgagtctgttatttatttcagatagcagaacttgtagcaactgaattttttgatcaaggagacagagagagaaaagaactcaacatagaacccactgtaagtatgaaaccttgttggtaggaattattcaaattgttttttttttaattgtagactcctttttatggctctatgggatctttccttaggaccacaatttctcattttattttttaaaacttttttctcattggaagaattatacatgttcattacagaaagcaaaaccaataaaaggcataataaagactcttgggttcatcatattgtatcagtgttctttgtaatttgtttttttccgcttaagtattagaaaccacttttcattttaacaaatattcttatgtattatcatgattacatgaaatcgatgtaaccataatttacctacgtcccttggtgtaatatttgcagtgttcactattacaaacagcactgtgataaacatccatcatagatgtttcactcctactccttggttctcgccatcaaaagaatttaatagagaagctgtggctgacagagaaaggaaggagagataccaaaagaaacatggaggaaagatgaccagatgtcatgccaccaccacagtctccccagttttctcagcattctacttgtttactcctttgttcaaagttctcctcagaagtgtgttcagagcagtgtttcatctatcatagatgtttatcacagtgctgtttgtaatagtgaacactgcaaacattacaccaagggaatagataaaccgccaaacctcattcttcattatcttgttagcataaattcccaaagttgtcgtgttgaagggcaaacagaatttaaaggtctttgatacatactgcctttttacatagagtatggatctcagatacaagtaaagattcctctcagcccacttctgttttttggaatgagtttccttgaaataaaacataagagttttcctctttttttctttttgtattagttgctgtctgaccttcctaggctaacccactgattcacctttctagagccagctttgtgttctttaaataaatgcacacaatggctcatgcctgtgatgccagcactttgggaggccaaggcagtcagatcccttgaggtcaggagttctagaccagcctggccaacatggtgaaaccctgtcgctaataaaaataaaaaatcagccaggcgtggtactgcacacctgactagggaggctgaggcaggagaatagcttaaacttgggaggtggaggttgcagtgagctgagatggtgccactgcactccagcctggacaacagagtgagactccatctcaaaaaataataaagtaataactaactaaataaataaatgcacatctgtgtgtctggtctgtatttgtattttcaggatctaatgaacagggagaagaaaaacaaaatcccaagtatgcaagttgggttcatagatgccatctgcttgcaactgtatgaggtatttatatgaaaactactagacttgctaaacttggactgttgtgaattagaacctaaaattgaagagattaatattaggcgcctatattttgcttctaaatcaagaaataaaattattagcagtatggtttcttttactgatgaacatgtttgtattgaacaaggaacacatactaatatctattgagtgcctactatgtgctaatctccaacaaattgatttggggatgctaagaagaattatgtgccagtgttaccctcaaggagcaatactgtatatactatgcgttagcatattctttttttaagtctaaattttagcctaaataaagaaaagtaatccaactttttctcattgtcataatgtggctttactctagttataaaaattcttctgagattaaaaggaaggaggtagaatattgcaggttcccatttccacgtatctgctggcttggcttttggagggggggtggttattgtaggcaaatagattctccctaaaacatctaatttattagtttagatgtttatgactcaaatgcagaaagaagaagttgtctttgtctttgaaggtttaaacggaaatgttttaagttttaattatttggaaaaagaacatttgtcatggagttatcatagaatgtcaagagcagaaaaaaaacctagaaatattctaatccagatatttcagatttagtaattgaacttgtaaagttcatctcccaacgagacagactatttgccccaaacaggtggttagtgggagaggtgcatctacagtccagttctcactcctactccaggattctcgccatcaaaagaatttaatataaagaactgtggctgacagggaaaggaaggagagataccaaaagaaccatggagaaaaaaaaaaaaaaaaactaggtgtcatgtgccactgtcgtctccctatttttctcagcattctacttgtttactcctttgttcaaagctcttcctcagaagtatgaagtgtgttcagagcattgtttcaaacacttggacatctcattctttccataacagttgctttccttattgattggattaagagtttctccattaaaaatactaatggctcttttgagttttctccatccctgtaaatacagtcaacatagtaatcacctattatagatgttatccttctacatttatatatatatatatacacacacacaaggattcattttatttgaatctgctgttgaaaattctatgtgatactgacaagtatttttaatattattacagaaatagttatgttctcactatagaaaaatcagaggccgggcatggtggcttacacctgtaatcccagcactttgggaggcagaggcaggttgatcacttgagctcaggagttcgaggccagcctggccaacatggtgaaaccccatccctacaaaaaaacagaaaaattattttctattataagcgcgggtgtggtggcacgcgcttgtagtcccagccacttagaagactgaggcagaagaattgcttgaataggggaggagggggttgcagtgagccaagatcacgccactgcactccagcctgggcaatgggagtggaaccctgccctaaaaaaaagaagaaaaagaaaaatcagaattactgagaagcaaaaaggaaaataaaaccagttacaatccattacccagagaaaactacagataacatatcaatgtatatgctttatgacattttcatatacttttcatttaataattcagtaattgccttttgcaatccataatgtcattatatccatattttatgtatcaaatgtgtttctgtgaggtttctttttatttttttattctgcgggaggttttacagtgacaacctattgttgggtatttgtcattttaagtggttcactattaggaagaaatctgaaatgaacattctggtggctaaatatttatggcactataattggtacataataatgccacaccaaattatgaatctttattataatataatcctggataaaagcctatttaagtacattgtatgaaaccattccctagaaaaacgcaaaaactaagcagttccctgatgcagtcacacttaggaagagccaactgtactacatagaaacaaaatgtcttttttcccctaaaagtggattccacacagatctgtctccctagcacagtaatgttattttggaatgtgtgtgtttgctctgtccctcagcatgtactccttatctgtagtgttttagaagaatcatgtgtaaatgatctgtgtatgtgctcacaaagcttgtgaaaatttcaacagtgagtctgcttatgaaatgagtgtgggatgtggccctttgtaacaggcctgtgggagaggacttatttcctggcttctctctagctgtttgctttcttttttctctttaggccctgacccacgtgtcagaggactgtttccctttgctagatggctgcagaaagaacaggcagaaatggcaggcccttgcagaacagcaggagaagatgctgattaatggggaaagcggccaggccaagcggaactgagtggcctatttcatgcagagttgaagtttacagagatggtgtgttctgcaatatgcctagtttcttacacactgtctgtatagtgtctgtatttggtatatactttgccactgctgtatttttatttttgcacaacttttgagagtatagcatgaatgtttttagaggactattacatattttttgtatatttgttttatgctactgaactgaaaggatcaacaacatccactgttagcacattgataaaagcattgtttgtgatatttcgtgtactgcaaagtgtatgcagtattcttgcactgaggtttttttgcttggggattattttaaataattggtttttgtgttttctgaattaccattttttcaagaatgtttggaatctttcctttttcaaaagtaggttaggagcaaattatcatacattctgtgacatttaaagcctttataggatagtgaaaaatgctggctgagtggattttaagagaaataattgtatttgttaacagtgtctttttttaaaaagttaaggcactctgaaacaaatggaaagtcctatgaaactgtattgtaaagaaaacattatttaattgatatgctgttttgtgagagaacaggcaagacagaactttgtcacttcagtgcagtacatttttctgaaagctacccataaaatcactttcatctcacctacctgatgcaaagcaggtgaaaccttaggagatgatccagtcactgacttgattgagggataagtgtgatttagaaatggaatggccttggatgtctatcagtgaagaaaaatgttctgttagaagatctctctaagagtttttttccttctgagcttccttttcaaaataaaagtgacaattgtagcattgacttgaagtgagacatggttatagataagagagtacaaaatgactctttttcctgtcaattgaaatttaaagaaaagttttaattatataaatagcaaagggctattgccaatactagggtcaaaaatgaatttgagggaacagtgggtaagaaactttatgcctgaataacatttagcagtattgtgattgaaaaattgccatattttgatgtataggacaagtcaactgagatccagagaatcctggatgtgaatgctaaacactggcccttaactcacattcaatgtattttcttcccataacatttagtatagttaatattttcttagaatttgagcccatttaagtggattaatattctacatgtgtgcccctaaagacacatttactcaatattggagaagtagataatgaattaagcaactggtctaggaaaggaaaatttgtttcaaatatgcaggaatgtttggatttggggagagtagaaggagagatttgcttgatttgttaacttctacctccaacccacaaaaaagatatttgatctgagtttctatcactaatttggatagaaaatttctaagggacatggtaatccagcattctcaaggacctttcgccaaaatgtgttttccatctatgtcccgattcccctaaattttgcctaaaattcagtatgttccttaagtttttaaaattctgagtgtgtacaaatatcttgacataatgcagttttatttttatcattctggtaaaaaaacaaaaaatagaagcaaaacacattgtattgccattattttgtatttggtaaaggttaatctaggaagttaccaactgtttaatgctatatgtattgtatacttgtattttcaggatattttattttttttgccatacagataaaatttgtaaggttgcccctttgtggcactggtgtgtaaaatacacagactatcactaaaataatagttatatatacatacaggtgtatacttatgcatgcatacataaatccttagtatagaaaaattgcataaagaatagcaatctttaataaacctttttattacattgtgatttagcagttatgctaaaatatgtacttatgctttagtagtttgtttggtcccctctagtatgtgtcactgagaaattttttaaagacatggtagatcgtgtttagaggctttgtatgtgtgtcattttaataagcaagaagatatatttagattagaaatggtttggtctgcctttgaatattgtttattttactttactagttgagacattaaaggaagctgggcaatgcctattttatttctttgttggatattttagttcatacaaagcagagtacttctttagggctggttaattggttcaaataatttttaatttcctttctagtatcttctcaagttggaaaaatatacatacagtcctccttcaccttactctgtatttatattacccataactagcaagaagttcttgttctagattttttgtttgtttagttataacagagtaacataccatttaattacaatttttagccagaaaagtccccactattttactaacttgttaaaagatatctatataattgcctggccttatatttttcagtagattagaccgtgccaatcacaatcctgggtggatttgtgtaagtcacttaacctctgtgtgcctaaacaagttgtgcttttttaaaaggagttatgtttgggcaaagcctttgtcttcaagcagaatgtcacagaaggcagctactttataagccccaatgggccatggagaccactgtcagaaatgggatattagtctagagagaaggtgatctattcccacatgtcatttctaatgttgagtttccatgactgaacaaagagaatatatttattcagcttcacttgcagatcactagtgaatgtgagatttagagctcattgagtatattgcttcaaggtacaaacccaggatgatgatgttgtcaccactgtctcttaattttgaataatagtttcctttaataggagtattagagataagaaagtatatgaaaatatactggaaatattggattcttggagaaaactgttcagtcacagatatattcttgcctagcagtgaagtgcctttattttcagcatagcaaataaatattagacctgttccaatttgatctacaatttttttctgtgtttttcaccagattgtactcctaaaacttaacaggccatcacaagcaattgtcttttgtttacaagattgatttaatatgagaggatacaaaatgtcatcgttatcctctcttatgaacaactgtagtcaaaataaggtggcacaatttaattgttttgtatcagaaatacactgaccca

SEQ ID NO: 806 - DNA, 28592 bp, Human
ggagagccgactgcgagaaggaaggcgacctgggtgggcaggatcccctctgggaagattacagggacagtcggggccatggcggtcagaaggagaagagcaacgagtggcttttaaaggtcggaaccgaaatgccctttacagaggacgccatgaaggagagccttctgaagagggaccatgtggaagatgccccgaggactcggggaggcggagcccgcgggttcagcccccagcgcccgcacggcccctgcctgcgtaggccgcccgcgggagccggaccccgggcgccggttgctgtggcccgcgggggtcgccgggccgcaggcgccgcgctgattggctgcgccgcgggcggaagtgatgctgctgtcactgctcctccggctcccgggaagccgcgagtttccgcagggaggcggcggcagctgcggcggggccggtgagttgggaactaggtgtggggctggacctgggtggtcagggggccccagaagtgggggaagccggcgtctgaggatgagggagctgcacagagggtgcctgaggtcctggcgtgggggaccaaggagatggggccccagggcccagaattcctggataatgtgggtgctaatgaggagaggggcacattgcacggagcgatcgaggccgacggagggagaatcgggaaactgacccggtacccaagctggcttctaggagccgggtgtggaacagcgaggacagtagcttgggagcaggatcttggactccaggctgcccattctcttcttccttgtcaattaagagctgtaaagggaggcctagccgttgggagaggttgagacctgctttcagaaggcatttaaggttcctttcccagaagcctgggggataaaaatgctgctttgccactagtagacagaaggagctcctgcttctctttcttcctgacatctgtggtgggatctactgagtctgaaggagtctgcctagcggggccactgtctggctaacaagggttttgtttgttagtttgtttacttagtagagtatgcagactggggaagacacctaaatatcttgggagaattgaggctcccgggggcagggagggattgagagggaatatgcctggaaacctaagagaaaacgagaggaagaaatgtagtatgaagatttttagaggtaaaggagaggtggcataagttctcctttccaggaagcctttcagtaaaattcccatttttctggaatgctttgaggtagagccgcttgggtgtgtatctgagtactaagccctgccccagggtggacccagtggagagcaaaggcttttaaaggagcccagccaccataggtacacacatgtcctgccaccccatttgtctgtcccccagttctaacttggctctttttttttttttttgagggctcctgagaccaattccctggttctgtcaaacccaggcaattggagtcccagtctggagtctgagtcctcaccttgaagccagcctcctgagctcagtacaggagtagctgcttagtgaggttctctcatcattcgttctctcctggttgcccgcttgtccttggtgcctgttctgttttgtttgcactctctggctttccccgtttcgcccccgccgcctccctcctttcactttccctggtatccttctgggatatacaaatcaagaagttagctaccacctggacttctaggacgttattacctactctttcaagaggcattttggtaactgttttttgctaggcctctggggaacaaaatgaaaagagggtggcacgatagcacaggaagtgggttttttgggtgttatactgatttggcctcaccgtaccagttctgctccagtctatgaccgattttagatctttggaaatgacaattaatgaagtttctttggtccctggtcctggagtttatctaacctcagcttgttgccctgggattggtgggacattatttcttctgttcttggatcccacaggtctgtagcctttgctgagtcaacactactcacagtgaaagtgatgccttttctccatttgcacaacatgagtgtgacgtggttagccagaccaggagctcaacctcatgtagaatccaggtgggcacggggccctgttatggggaattagccttgaggacaactggactgaggagtcagctagggaaagatttatgtcccctctaaatgtaggggtgaaggggttgtctctgctaaagaacagtcacgatgcagccagtagtttgtggaagcgatgtgtgctttgagccctgtgggtggcaacaggggttgctcgcagtgcctgtgagcaactggacctcctgctggattagctggtgtcgtgaggattggctgtcttgctgtgggaggccatccgctggtgttagtgctggcccacactccacctgggggcttatccctgttggtcagggataaatgtgaacaaaaagagaagatcaaatgtttcacaatttaaaaggcatggcttagggacttccagggggaacacatggatggctcagcatctccctctcagattcctgcagttaccagctctttgatctcttccatatcctttttctttgtctgcagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctggtgagtccagtcctgcagtttgcagtttcaggtgggtaggttccagtccagttctttaatgggcttttgactatatcactcttcagtcacctccatcctttgcctgagggaccatttcccggttctgtggtgtttccctaggctctccctcccttctactgtcttctagaggccggtgttctacagtgctcagggcacagatggtgcagccaggctgcctgggctcatggtccagctctgccacttactagcatgtgcatttgggcaagctgcttaaactctgtgcctcagcttctccatctgtaaagtggagattgtaatagtgcctacctcatagagttatggttagggtaagtgaatgtatacatgtgtagcacttagaaccatgcctgacacatggtaaacactatgacataagtgatacgatactaccattggcataagaggtgtatcatctggcccggtgcggtggctcacgcctgtaatcccagcactttgggaggccgagatgggcagatcacgaggtcaggagatcaagaccatcctggctaacacagtgaaaccctgtctctactaaaaatacaaaaaattagccaggcgtggtggcaggcgcctgtagtcgcagctactcggaagcctgaggcaggagaatggcgtgaatccgggaggcggagcttgcagtgagccgagatcctgccactgcactccacactccagcctgggtgacagagcaagactccgtctcaaaaaaaaaaaaaaaaaaagaagtgtatcatccaacccttcaccctagctaccattttatcccgaatcccccatgactgatgacaaactttcctagaatccaaggctgtggcagagctctcacctgctcctccttgactctgttcccacctgacctattggtctgcaatctgtctggctctttggtggaggccaagggtgaaaaggggctgctagctataacttcatctccctctgggctgtgctatgtgtcactgtattcccatcctgtctctcttacagaataaccgacggagcccgggcagggacatcaacgtgacgggtgtgtgggaacgcaatgtgactgggcgaggggtgacggtggtggtagtggatgacggagtggaacacaccatccaggacattgcacccaactatgtgagtggccctggaacgacacccctcactccccacgtcttacctccttcttgatgttgcctcagtcttgtccccttttctagaggtctttgggccaaataaaagagcctgggaggtgggatggggttcatcctcttcttttccctagctagccagtcaaggcacagcaggtggctctaactctaagaacaatcctgctctcagttctagtccttttctgaggagtaaggagtggcccctgcaggcaacttccctcttgttggaaatccgagtgccttcctctctctaaagcgtggcctctagggagccctacctgccttttttccaggtttcccaagccgtggagctgtaggcacattcgcataatgggcaagagaagtttgctgggagctgtggcacttctcagttttgccccagtgtcctttgctcatatcttttagccagtgtggtttgcagatagaaatgggcttattgggtccgggcgcggtggctcacgcctgtaatcccagcactttgggaagccaaggcgggcggatcaggaggtcaggagtttgagaccagcctggccaagatggtgaaaccccgtctctactaaaaatacaaaaattagccaagtgtggtggcgctcacctatagtcccagccactcgggaggctgaggcagaagaatcgcttgaacctgggaggcagttgttgcagtgagctgagattgtggcactgcactccagcctgggcaacagagtgagactccatctcaaaaacagaaacgatgagaaatgagcttatcgccctagcttcgattcccaaactcccatttcctttctgtccctgaaccccaggacctgatcccctctaaccagtgaatgaccacatgtcacctccaaaatatttcagagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtaacttgtgcctccagcctagccttggtaggctgctcctgtgaccacagtcttcatttcctgcacccctccctactctgaaacatctttatcccatagcccagctgacacacatagcatagagcaagggtgagtttataataggtgtctgtaggacatatcagctcattgatttttcagtgcagtggtgtttcaaacatgtttttctatttatagttccataaattacaaagtgccttcttgtcggtttttcctctatgatccgatacgtctatggtggcagcctttgcatttcccagctccccagctccccagctcccagtcccactgatggtcacgggctgctctccatccttttgggggagctgagcagccctattcctccctggaggtggttctgtggttctttcacactcaacgtctgtccatcaaggcaaaaggtgaagggaatgaatggggaagccctcaccataactccttatgtgcttgggaacctacagactgaacagactattcctcttatactccagcagagggcagtagctctccataaatgagaccggaggagccagaaaccctgtccaagtcccttctctgaaagtgccacagcactgcagcctgggcgacagagccagactttgtctctctctatatatatatttttttggtggggggacaagtaatacgtatacatggtgtaaaaatgcaaaatgggctgggcgtgggggctatggggatcacacctgtaatcccagcactttgggaggccaaggcaggcagatcacttgaggtcaggagttcgagaccagcctgaccaatatggtgaaaccccatctctactaaaaatacaaaaattagccgggtgtggtggcatgcgcctgtagtcccagctacttcgaggctgaggcaagacaatcgcttgaacccaggaggtggaggctgcagtgagccgagatcatgccactgcactccagtctgggtgacaagtaagactttatctcaaaaaaaaaaaaaagcaaaatgtacaaagagcatgtagggaaaaataagtctcccacatatggctccccacctcccagttccccggctaggagaccagcattagtgaggagctgctgtggccttcattgcctaggtatccgggtactggatggacctctcacagacagcatggaggcagtggcgttcaacaagcactatcagatcaatgacatctacagctgcaggtgaggcagagctgcagatgagagggcaagagcctggagcacctgggacaaatccgccaacaaaatcccaaccagtgggctgacttaggccggagcaggggtctcctcattgggttcagctaataagtccattgccttcatttctctagattcccagccactgggcactcaaccttaagcccccgtcacccccgtaatcagattgccacatgagaagccctggcctgtgcacatttatttgttttctaaactcctaaggcctctgcaagaaagcgggctttcttctccatccacaggccagctgaatgcccaacaccaatcccccaccccacgccaatgcactgcaccttcagggcatggctgtgctggactggacaagaaggaaatggggttgggggcccacatggcattgatggcacctgttcctcccccgacatacctcccttaaatccatgacatcatccacagggtacacttcccgatagagacagaatagagaactcctcaacctgagaaccaagagcttccacagaagttcatgggcgctctgccttctaccctacgagttgggccaggtgcggtggctcacgcctgtaatcccagcactttgggaggctgaggcatgtggattgcttgaggtcaggagttcaagacctgcctgaccaacatggtgaaaccccatctctactaaaaatacaaaaattagccaggcttggtggtgggcacctgtaatcccagctactccagaggctgaggcaggagaatcgcttgaacctgggaggtggaggtggcagtgagccaaaatcgcgccattgcacttcagcctgggcaacagaggaagacgccgtttcaggagaaaaaaaaaaaaaaaaaaaggtctacatgtctctgatccctagatcaggagatgagtgacctctgtccctctctgccactatgggctatggggacattcacaaggaaaagaagagccttagcacacttctgttttccactttggagaggggatggacctttgaaccctgtgccttttaatcacggaagcctttaagtggaacccttgggaggagttaagagctgcaggtcaaagggcagccagctgagactgggaggcgctgggtgggtagccgcagcctggctctggctgtcccctctaggtatttatttctcaacagctggggaccagatgacgatgggaagacagtggatggcccccatcagcttggaaaggtaactggcctgcacaaagactctgagaaacgggatgccctcttcatacagtcccgggagaactgctgcaagttgacccatcttcccactccacctccacgctcagtctcctttcaggaagagaacacctaacgtcggggcaggaagcctaggggacgtttgttcctagagagggaaatggaacagtgctttgagattgtttccctttcatcttatcctcagctcccatgcctggccccaccctgtcctctgataagcagagggtgtccatcagtcatcattcaactcacagctgccccacatcctgggtcaactcacagctccctcacatgcggggtccatcttccaatctttcccccatgcccagtgccctttgaacttttttccctttgtttctagaaggggtggagagggtgactgatgtggtaggcggaggtctttctgtgggttcctcaactgacaccctgatgttttggctcctcaggctgccttacaacatggggtgattgctggtcgccagggctttgggagcatctttgtggtagccagtggcaacggaggccaacacaacgacaactgcaactacgatggctacgccaactccatctacaccgtcaccataggtagtcacccaatgtttctgtgctcctgtgtgtgtgtcaccgaagggttagggcatcacacgtcttgtcctagcttctgtgtgtgtctaaatgtgtgagcacaataatctctttgggctcagataggactagccctgcttgcagaggaccttgggacttcttagatgtcagcataccctgggaacaccttcaagccatcatctggagatcaccgagctgcctccaccccaccacagctggttaggcctctgctctggcctgtctttctgtgggccaccttctgcctgctggaagcctcccctgactccccacaggcctaaattaagtgccctttgcctgtgctcccagttagcatgtgtttatttacttacctgacttctacctgactctaggctcctcgagactaggactgcggccttttccatatggccctgatgcctggcacgggtgtgacccacagtagatgggtaatgaatgttgaaaacagtaagcatgtgaatgaataagtgggtatgaaggtagaaggctgccagttgtaccccagagcctactgaaagaatggtattgcggcacagaatgccctctgccacttgagactgcctgttcagaagaggatcaggactgctctgagggacgtgggccgctcagatcatgtttcaaactcaggacagccccccaggatggtaactccaagataactgacattagcaagcccctgccacaggaccccctctgcatctcagctctaatctccctcctctgtccctaggagctgtggatgaggagggacgcatgcctttctatgcagaagaatgtgcctccatgctggcagtcaccttcagtggtggggacaagatgcttcggagcattgtgagtgcctcccgggccctccacggcctgcccctttcccacaagacttcacgtctcagacatcacagcgcttctcactgttccctgcttccccgccccaacactcaggctcctcttcccccacagagctggatgtcttaaggcatgccacccttggagtagtagactcggggactctgaatacatcttgggaatgcttttatcttagaaatttggatttaggacgaatatacatatttttagaaactaagtgtcacatggggccaaacatggtggctcactcctgtaatcccagcactttgggaggccaaggcggatggatcacttgaggtcaggagttcaagaccagcctggccaacatggtgaaaccctgtctctactaaaaatacaaaaattagcctggtgtggtggcgggcatctgtaatcccagctacttgggaggctgaggcaggagaatcgcttgaaacaaggaggcggaggttacagtgagccaagattgcaccactgtactccagcctgggtgacagaacaagactccttctcaaaaaaaaaaaagaaactaagtgtcacatggattaaacaactttttcacactcaaggaaatgcacaaacaacttctttgcagtgtcttcctttggtaaaatttgggcttttgctaatttctgtggacttaaaaaaaactcctaattccattgcccttcagctcttaggtaaatactgtgagttctggtcatgtgcatcttcaggaggaaagctagtctggttgtcgtttttatgggatgagtgggaagaggagtgggggaatgtctcatgtcaacaccagagagagctctttctctggagctataattggagccatagcaaatgaaattcgagcagggtcatggagcttctctaacctgtggaacccatttaaagaatttgaagacgatcgcctacacccagctgggcttagcgccatcccagcaggtttaaggcaggcctctagaccatcttcctagagctccctgcctgtccctgttgcccgcaaccatatagtgtgggcataggaggctctaggcaggagctgggctggagccaggtggtatcaaatttctccagtggctgagtcgggagatctctctggggccattgggaattaggctgctttgtcttcctgctgggtcaaatttattttccaaaactaaaattttgttatgccaataaatgacttctggtcaacacaatgttccaaggctctgtgccagttgacccctactaccccctcctcccagccccagggagaagagaaaagggagtggactaaagtagagagggaagagaggctgggctgtgtgcacagagggcacccactgcaggccaggctgggttaggaggaagaacaggaacataccaaactccaccctctagcagaactctagggaacccagctcgccctgcccaggccagggacctaagaaggttctacaacataattgtcactcttgctctgctgtacctggcctttctcattttaactcacctcagcttctcaccctcaccaccctcttccatctgaactgtaatttgcccagaaatgaagagagagtgtgtttagcagagttcccatctttggaatgtccttgctatggaaacttcttgttgccagtttctagtcaatgaccagggcagctgggtagagctgtctttctgagggcagaggctgggggcatatgcttcccaccatttggctccctggggaagcaaagcttctctggacttttcaatgcctgcctgtggctcctgccaccatagacaagttcgtgggcttcacagccacacttcagactatcactgcaaggctgtttccttaacaggaaaaaaaatcaacccgctcccttgcataaaccaggctcccactctcattgagacaaccacttggagagtgcttttcccttttttttctgggagtgcgccatggctgggtgaaaattacatctcttggcagctgctctaacagctgggagggaagcagtgagtacagtggagaaagggcagctcttggcagaagtcgccaccctggtatctgacccagaagagaagtttggaagaaagaaattctccggtgttagcactgacaccatgggccaacgatccaagtgccatagagtggagcagatttaggcagggcccgcctcagctaaaccctctgagtctccaggggtgatgacagccccaaaagagctcgatgccaggcagtcactgcctccccttgccccattctcgctccccacctcagaaccacacagagagaaggggtttcatggcatctggcccagagcagtgaggcagcttgtcctgttgagagctgtagagccgggcaggcgggccttatagacactgagtccatgcagggctcgggggtgggcaaggacacagtcctctcttgctggaacacactccctgtgttcacgccgacatcattccagcccctgtcgcggagctgccaaattggatttccttgaatagtgccgtcagtgttgtcccagctccagctgggcccagtagctcccctggccacttcctctgtctagcttggttgtgggggttgaagggtttggagttgggagttgggatagagaatttaggaatgggagcaagaatattaggagcaaaaatcgggaggcccccccatggtggctcatgcctgttaatcccgacactttgggaggccaaggcaggaagattgcttgaggccaagagttcgagaccagcctgggcaacatagtgagatgctgtctctacaaaaaataagaatattagtgtggtgcagtggtacacgcctgtagtcccagctacatgggaagctgaagcaggaggatcgctggaacccaggagttcgaggctgtggtgagctatgatcttaccactgcactccagcctaggcgacaaggaaaaataagaaaaaagaaaagagttgggaaacccttatctgcactggatgggagccctttcctatctctgcctccttttgccaacaaccacaccctcaaaagtaacttttattatctttgtctctgttctccagatattctgttaggaggccaggagggttagggtttcctttgccctgccctgctattgggtccttctctggtcaaagattcagctctaacaaaggaagggtccacctgtgagacctgttctgaggaccagccctgtacctttcccccataacaactttgaactcagtctctagcttcttttttaaaaaatattctttttttattttttaaagatgggttctcactcagccacctaggctggagtgcagtggcacagtcataactcctgtgctcaagcaatcctcctgcctgggcctcccaggtagccgggactataggtgcacaccactgtccccagcttgaactcagtctctaacctacttccttttcctgtttcacttccaggtgaccactgactgggaccttcagaagggcactggctgcactgagggccacacagggacctcagctgcagcgcctctggcagctggcatgatagccttaatgctgcaggtgcggccctgcctcacgtggcgtgacgtccagcacatcattgtcttcacagccacccgggtgagataccagcaggtagacaagtggcctggcccagcctgctccagagttcgggtatcaggtggccttagattctcaatgtcccaaatgttagatactaagtctctttcagagtccctttcagagttgcatatgtaaagaacaggtgtggggaccccacaaagaccacaggcctaaactcattttatctgcaaaggggagctctggctgtgcctcctggccccttctctagaagcaagccagtggggtggtgacatcatgggctttgaccttttgtcccagcttgccttggggaatccattcccagtagccatagtgggagagcgtggactggatcagccagcagggcaagcagggaaaccagagtcagattgttgagactacactggcaatgcaagagactaaccaggacctctgtcctttcagtatgaggatcgccgtgcagagtgggtcaccaacgaggcaggcttcagccatagccaccagcacggtttcggcctcctcaacgcctggaggctcgtgaatgcagccaaggtgaacaggtgttggcagggcagggtgccctgtgtggagtgaccaagggtcggagctgaatgccccaaactgcctgggatatcataggtgcctagtaaatgttcattcagttcattgatttaacaacttcaaccttcatcccagctgatatccattttacaaatgagaaagcaggctcaatgctatcactgaagtttccaaactactaatagagtaaatgggacctgagtatgtgtgggactcaggatgctctggttcccctcctccaccctggacacagctgtttcctctggttccttagctgggggctgtacggagcattccagcgagcaagcaggagctgagggctgaaggaagatgatgaggagtggaaaaataaagacagctaaaccttcaagatcgtattgacaagggcgtgtgtgtttgtgagaatgtgggtgtgatcattcttgtttgttgatttgccatcccctcctttcctttcatagatctggacatctgtcccttacttagcatcctacgtcagtcccgtgttaaaagaaaacaaggcgattccgcagtccccccgttccctggaggtcctgtggaatggtaagtaatcagcacaaagggggttaatcttaggcctgaggtttggggccgggtgacaaggaagttaaactcgtcctccctgccagattctaccccctttcggagctgagctccagccaaacctgtggagttttctttgaccattttaggacatgttactgcttctgagttggctcccccagctgcttaaacaagacctttctcctgggttcctagtagtgaaaaggagcagcagagcaactgaggaggagggcgggtgggaggcatgggactggggcttggggaggtcaggcgagaccggggtgagagctcagagaagctcctgtgacttccatgctaagatcttgccagagaactctggtcagtcctcgggtgtctggatgaagtaaaggagttaggcatttcttcctttgattctctggcttacctaatagagagagtcagatgtggtctgctggggatggacagagggtttgtagaagtctcctaggctttagtgacccatcctctgcctccgcctccatggtggccagcatgaaccaggattgtctgaaggggttgtatcctctaagccagcgacctggttttatgttgagcgaagaggcggacgccctccctagaggagagtgcagctggatcaggatgcttgtgcagaggatgccctgtctgcacatttaccagcgttttccctacccccagctccttgggggattctttttcctggagtcatttactactttttgcaaaggaagtatgctatgcttagtgcccaaaccaaaactgtcttcactttttctgtcctcctagaaagtgatcaattgagagccatggcaggagaaggaatggccagagaaggttactcagaagggaggatgaggggtggcttccctcaggtgaaggtttcacagagaagaattgagttttctcctcctaaccacatccagcacttgcccaatttccctcaatgtggaatgaaacccctgggccagtcactgcatttcccataaaaggaatgttatcttggaaagggcataaagcgtcagccaagtcagagaagttcagaaacatttccaggaatgcagttcatttggaagcccctggctttgcacttgcgtgtcttagagatagtgtgccttcaactttaccttctatccagggctatttcctgttgcatctgtcaaatgagggcagtgacttaaaagagtaatatggtcttcccagcttcgtcatcctctgcttcctgctgaccaggggacgttgccacggaatgtctaccctaggcattgaggcatctggcaactgcttgcttgtcactaaaaagtaagagaaagaaggacagattgcctgggtggagaagagtgggaggtggcctagtggagaaagcaggattaagagaagggagggaaagatttagggagtttggctaatggagccctttacctgttggaagggcagcaagcaaaagttttaccagagttttccctacccccagctccttgggggattttttgttttgtttcatttttgtttttgtttttttgccttgagtaattttgacatgcagagttattcacaactttttgcaaagtactattttcattggcttttcagagccagtgaagttgccttctcctccaacatgaccacattttcctctgagcagacaaaaacagaacaaataagtttgtgggcttgcttggaggttgaaagaaataagtccagttaaaatgagagttgagccaggtgccctggctcatgcctgtaatcccagcactttgggaactttgggaggcagataacctgaggtcaggagtttgagaccaacctgaccaacatggtgataccccatctccactaaaaatacaaaattagctgggtgtggtggctcatgcctgtagtcccagctacttgggaggctgaggcaggagaacccgggaggcagaggttgcagtgagctgagatcgcaccattgcactccagcctgggcaagaagagggaaactccatctcaaaaaaaaaaaaaaaaaaaaaaattgagagttgagcagctcagtcccaggaagtcaagaaaccccttctacagccaagttatggttgttttccaccaggacctggttgattcagtgtctgggggctggaaagtgaactttttataaagcagagggagctgaacatccctgagatagaagaggaggctaaatacctctaagactctagagtagcattgtcccaaagaattttctgcaatgatggaactgttccatgtccatgctgctcagttcagtggtcactagtcatctgagtctattgaacatttaaaacatgaccagttggccgggcatggtggctcacacctgtaatccctttgggaagctgaggcaggagcattgtttacgctcatgagttcaagaccagcctgaacaacatagtgagaccctatttctacaaaaaataaaattagccaggtgtggtggtgcatgcctcctgggaggctgagacaggaggattccttgagcccaggatgccaaggctgcagtaagccatggttgcactactgcactctccatcctgggtgacagagcgagaccttgtctcaaaaataataataggctaggcgtggtagctcatacccagcctataatcccagcactttgggaggccaagggcaggggcggatcacttgaggtcaggagttcaagaccagcctggccaacagagtgaaacctcgactctactaaaaaaaaaaaaaaaaacgatacaaaaattggctgggcacggtggctcacgcctgtaatcccagcactttgggaggctgaggcgggtggatcacaaggtcaggagatcgagaccatcctggctaacacggtgaaaccccatctctactacaaatacaaaaaaattagccaggcgtggtggtgggtgcctgtagtcccagctactcgggaggctgaggcaggagaatggcgtgaaccagggaggcggagcttgcagtgagccaagatcgtgccactgcactccagcctagacaacagagcgagactccatctcaaaaaaaaaaaaaaagtatatatatatatatatatatatatatatatatatatatatatatacacacacacacacacacacacacacacacaaaaattagccaggcatggtggcacgtgcctgtagtcccagctattcaagaggttgaggcagggaaattgcttgaacctgggaggcagaagttgcagtgagccaagattgtgccattgcactccagcctggatgacagagcaagactccatctcaaataataataataaggctagtatgactaaggagctaaattttaattttgttatacttcattttaatttagatagccatgtgtggctaagggctaccatattgagaagtgctgctaaagagcaagactgatttttctctctccccgctgacaggaggttatgagggagaggggattggggcctcttggggtttttagatctgacgctggtctgaaatctctacctgagggtaggagggagagtggggctctggaggagtgtgttattcacactcagagagtctgtgattggaaggtgcctgaacacccacttgcacctctccttttgttgtcgtttgcagtcttgaggatactggctaagcctctgcctacgcagtgagtcctgttccttctcctctccaggtcttccctctttaaccaacatttccctctctgctgattcttcctttctgccttcaaatgcaagtccctgctacctccaaccaggcaacttttcaaatgaatgaactgaagcaatttctcccctttgtcacacactccctctgccacagaagacttgctttcttactcatagtgcccctttcctgaccggttcaggggctggttcagagttcatcctttttaacattcttgtcactctgaccctattaatgaggtctttgttgcaacgtctctcctcctgtagcttctgtggcggccttcttggctccatagccctcctctgccttctctgcctgaggtacttgtttcatactcctgaactgtgagtgtcttctaaggcttgtttcctgactttttcctcactctacatcatcctccttgacagtacagctatgtttatgaccttagctaccacctctccacaaatgagtcctcgacctaaatctcttattctgatccttcaccagtggaaaggatagaaactagagcatagcttccataagattatgggcaaatagtccaggcacggtggctcacgcctgtaatcacagcactttgggaggccgaggtgggcagatcacgaggtcaggagatcgagaccatcctggccaacatggtgaaaccccgtctctactaaaaatacaaaaaaatcagctgggcatggtggcgggctcctgtagtcccagctactcgggaggctgaggcaggagaattgcttgaacctgggaggtggaggttgcagtgagcagagatcatgccactgcactgcagcctggtgaccgagcaagactccgtctaaaaaaaaaaaaaaaaaaaagaaaaagaaaagaaaagaaaaagattatgggcaaatagaaccctggcgtcttctgggacagagagtgactgttgaaaaaattccaatttaccaaaggccacataataagatgctttttatgtgccaatcactgttcgcagcgttagctcatttaatgcattaactcatttagttctggtagagagagttctagtgtactcatttgcactgccacccaagtccgcatccacaccaagaagtaaatggatgtagcatgccactgcgtacactgcgaacgcagacaagcactccttttgggattcttttccttttgggattctattctgttccataacgtcatttctctcctgtaagccccttctctgccacatcaatgctgtcctctaactatgccataaatattttccatcatctttctgttcctaaatcactgtgtgctgttgatattccaccaatacagtacacttaacatgtacaaaattttagatttcactatcacctctcaaaagctggcttgctttctaagattttcccattcgtgtcagtgccgtcaccgttccctaggcccccaaacttgaaacgcgcgagtgtttcatccctctaatatccctcgcctcttcccaggtcttccccagccctttcccttgcaatttaatctttttgttgttttctgtgaaatatctctcaatcgacttattcattctacaaatattcgaggcctacttcatcccaggcactgtattagttctagagactcggggataagacactattcctgccttcaacgagcttacaacctggtagggaagacagtgaggtttataggcatagtgcagtgttataggcactgcaacagggacaacacaggtgctttgagagcacagcagagagatgtctcctgccactaaggaagaaagggaaggtttctcaaagaaactggtggccaggcacagtggctcatgcctctaatcccagcactttgggaggctggagcaggcagattgcttgagctcatgagttcgagaccagcctcgccaacatggcaaaaccttgtctctacaaaaaaatacagaaattagctgggcatggtggtgcacacttacagttcccagctactagggaggctgaggtgggaagatggcttgagcctgggaggcggaggttgcagtgagctgagatcatgccactgtgctccagtctggcgacaaagcaagactctgtctcaaaaaaaaaaaaaaaaagaaaaggccgggcacggtggctcatgcctgtaatcccagcacgttgggaggccaaggcaggtggatcacaaggtcagaagttcgagaccagcctgaccaacatggtgaaaccccgtctctactaaaaatacaaaaattagctgggtatggtggcacatgcctgtaatcccagctacttgggaggtgggaggctgaggcaagagaatcgctggaacccaggaggcggaggttgcagtgagccgagatcgtgccactgcactccagcctaggcaacagagcaagacttcgtctcaaaaaaaaaaaaaaaaaaagaaaagaaaaaaaactgtgatgtaattattttgtaaatgtggaggggacgacaactggggaaaaggtgtgggcatgatttgttagattctcatctgccataaatgaaagtcaatgcataatgtctcaaattgataagccatgaaatatccataacgcttactgtttagaaacacgaaagtagatcccagaagaaaacaattaaaaacaataaaaaaaaagtttgcttctggggagtagatctcaaaggtggtagggaattttttttttcattataagcactgtagcaccaacttacatttaaattcatgcatactattttaatagaaaaaaatgtcaaggacaattgggaaggtaagaagtagccatcgtgaatctaaacagctttctcaagaattttgacaatacaggaaaagaaataatatctgatacatatgtagccttaacattagctaggtaccattctgaacgctttaggtatattaactgtttaatcctcgtctcaaacctatgaagtaggtactgttactggccccattttacagatgaggaaacagttctcacagctagtaagtggcagagctgggattagaacccaagcttagtggctccagagcccatgctcttaacactggtaggtggcaggaagtgaagaactgagaaagggtttatttgtttttgtttttcatttgtagtaggaaaggtgctagcaaaaaggtctagccaagaagatggataatcaggctgagccattgtttgacttttgccaagtattgctgtgaaaggacaagaaagtgaagggagcttgagaatgtaaacacacatgttggatgagccatggaatctcagccagttaggagaaaggagcttgaggggttgtgggaaaatgagggggtcaagaagagagtggggaaagtggaaggagagaggttgttttcaaagaaatgggacattggctttgaagaggtgacagatggaattatagaaaatgaggctgggtgtggtggctcgtgcctgtaatcccagcactttgggaggccaaggcaggcaggtggatcacctgaggtcaggagttcgagaccagcctggccaacacggtgaaaccccgtctctactaaaactacaaaaattagctgggcgtggtggcatgcgcctgtaatcccagctacttgggaggctgaggcaggagaattgcttgaacccaggaggtagaggtggcagtgagccaagcatctagccgctgcactccagcctgggtgacagagctagactccgtctcaaacaaacaaacacccctgtccttgctcagtcatctataatagctcttagttgcttatttaaaacaaaaatctttaaagcgcatcccaccctaggttacccagcccctactttcagtgcctctctgagctactgtgtctgtaaaatcaaggtattgtactctgccttgcatattggaataatttttttttttgagacaggctctcactctattgcccaggctagagtgcagaggcacagtcatggttcactgcagcctcaacctcctgggctcaagccatcctcccaccctcaacctcctgagtagctgggaccacaggtgcttaccactatatccagctaattttttatttttttgtaaagatgatgtctcccaggctgaagttatcctccaccatgcctggagtgagccaccatgcctggcctgggattaaattatggagagaaagggggcctttaaaaggattgtattcgcgccagggttcaatgtgctctacagcaccgtgtattcctagctacatttcggaggcttagagcgggttgatcataaaggtcacgaagattgagagcatccatgggcaacaataggtggaacacccatctcgttcattgataatacacaaaattaggtggccctggtggcaggcacccgtagtcctagctacttggggatctgaggcaggagaatcgcttgtaccccgaaggcagaggttccactgggcccagattattcccctgcaattcaacctggccacaaagggggactctttttccaaaaaaaaaataaaaaagaatcgttctcattacagcctaatttcttaatagtccccagttgagtcttcctcttcagtagttttttgtttttgtttttgttttaataattgtagatttacaggaggtttcaaagaaatgtacaagagaagtcccgtgcacccttctcccaatcttaatgtttcacacaattaaagtataatatcaaaaccaagaaattgacattggtacaatccatagagcttatttggagttcaccagatacacatgctgtcaatatttgtgtatgcgcgtgtgtagctgtatgcaattgtatcacatgtagccttgcataactaccaccacaaccaagatccagaacaattccattatcacaagactcctttgtgttacccctttctggccacacccatcccctcccctgtccctggcccctggcacccatttatctgttatgtatcactgcaggtacttcaattaacatcacctaaatggaattgtgtgctacgcatcctttttctttttttttttttctttgagacagggtcttgttctgttgcccaggctggagtgtggtagcatgagcatggctcactgcaatctccacctcccaggctcaagcgatcctcccacctcaccctccccggtagtgggaccacaggtgcacaccaccacacctggctatatgcttcttttgagattgcttttttcactcacataatttgcttgaaatttatccaccagcattttttaaaaattaactgtgcatcatcttcagtgagatgtgtgcatttcgtctttgttcatgccttttccactgcctagaatgccctctaccaaccctgtctaccgatctgtattcatttccttcagtgtgtctcactgctgtgtgcctaaacccatctgacttatttctcttcccttatcaattatgtatatttcccataccatatcattttccacttgcaggtaggaggcagggaccacgcccatcttatctttatattcccagcatctagtacagtgcctgaaatggaggaggtacccagtaaataatgttttggatgaatgaatgattgaagttgctctgctggattcttatattgtgtcttgggtatgtgtcgtcttcccaactgcactcgaagctacgttgtaaacttgagagcagcagctccattccatttactagtataggcgaggtcccagttagggttgccgtagatgtttgtatgtggcttcagtgagcgtgtgtctttgtgtacgtgggggtgaagtgaaggcgtgtttgtgggctggtttcccagctgcccagcctgactttctacagtcagcaggatggacctggagatgtcagggctgaagaccctggagcatgtggcagtgacagtctccatcactcacccacggcgcggcagcttggagctgaagctgttctgccccagtggcatgatgtccctcatcggcgccccccgcagcatggactcgtatgtacacccgcccgaggcctgagcaaccttttcagcaagggcctttccagggaaaagaaatggaagaagtggatcctggcactgtcctaaactactgtggcactggctatccctggcggctggaagcctttcgtcacataccttcttcaagcgctaggccctgcacctcacatacatgttctctaatccttctaagaaccccctagattagactttgtaacctccttttacaaatgaggaaactggctgggtgtggtggctcacacctgtaatcccagcactttgggaggtcaaggcaggagaatcacttgaactcaggagttcaagaccagcctgggcaacaaagtgagaccctgtctctacaaaaaatttaaagattagctgagcatggtggtacatgcctgtagtcccagctactcaggagactgaggtgggaggatcacttgaacccaggaagtcaaggctgcagtgagctgtgatcatgccactgcactccagcttggataacagagtgagaccctgtctccaaaaaaaaaaagaaagaaaaagaaaacaagtcatggagctagtaagtgcccaagagaacaagaataaacctagatccgtgggactccaagcctgtgcgcgctccatgcttgctttttccaccacaccacgttaacacaatttcctccttccatgagaccccaggggaaaggggcacctgagaagccctcgtggcaccctcccaggttgtttccacggctactacagtaagaaagtgttgctgggggaaggtcagctctctggcccacgccttccacctgtttctgctgtgttctttcctcagggatcccaacggcttcaatgactggaccttctccactgtgcgatgctggggggagagagcccgagggacctacaggcttgtcatcagggatgtcggtgagtctcgtgccctcacaccaggccctacctttcctgcttgttatctggtccctctgcatctcagagtccccacagaaagtgtcccgtgtgcaatatatagggttgccattggaccaagagagttgatgccaagagtgtgcccatccgtgaaatgggcattgctctctgcaactgttcatttatactacctctcatattccctggaggagtgacccatccatctttcctcaggatagcaacaaaaagtccttgtcgaaaccacatttcaagtccttttacgtataaccatccttcggccagccccggtaggcaggtaagggcaggactcatttcaccattttttttaaactggcccagaggtttgaggtgacttgtggaaggtcaccatatcagtgaaggccacaatatccatgaattgtgaatatctttagtatcagcctatagactggaaattgagctccaccctcccatcctccagtcagttaggtattctctaggccagtggttttcaaagctttctttaatttggtggaaagacatttttttctaatcccagctgaacccccaaaatacgggagagaaaagcaagactctgctttggagtacagcctttcaaccctttccatccctaagggcacccagtgaggcccttctgcagaacctggggtcagtgggacacagtgaggcagctcctggagcagaccatgtggcctgagcccctttgggtggcagggcgggcagggcctctgctgtctggcatggctgacagaggggcgtggctcacgagctgccccttgctgccctaggggatgagtcattccaggtcggcatcctccggcaatggcagctgaccctatatggctctgtgtggagtgcagtagacatcagggacagacaaaggtgggtaaagccgcatgtgtcagagggaaggccagtcacaggggaagggccgcctagggagcccatcgccctctgaaccccagctgtgcttcccagttccagcgtcaagccggtagatggagccccgggctgggaactcacagtctgggcctctcctttttgctgtggggcttccctgtcttcacctgtaaggcaggaaaatgggtgagggcagatggtataggaaccatagtcagtggggcatcctcacctcttttcttctccacaggctgttagagagtgccatgagtggaaaatacctgcacgatgacttcgccctgccctgcccaccggggctgaaaattcctgaggaagatggttacaccatcacccccaacaccctcaaggtactagggccaagactcaagctgcgggtagatgggactgtcctgtctgggggatggagttcttagtgtgtttctcagggtgacctgcggggtgaaggactgggaagacctgggtcccagcagtggtttcatagcattgctcctaccctgctagcctaactcttacaggacaggccttgtcgggggagggggcagagggaacagtttgggtgaaaaaggcagtccctagaaggaaaaagactttctgagctcattgtcctgggctgagaaaggctgtaggcttcgggaaacagtgcctcacgtaggtgcttgcctcggccccagaccctggtgctggtaggctgtttcaccgtcttctggaccgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctcttgacagaaagcagttctgatgcttacatctggaatctgaggcatcctctgactccactcaaagagggtgagggccttcttaagatacaaatggtggaggattgctgccagagaagtctggtcagagccacagggtctgcctccagccaaacgggagcttttggtgagaaggtgttggacaggggattggcgcccccctttggtttggcctccatcctcatctctcttgggccaagccagctgcctaggtcccccaagcatgggggaccccttcccacatataagttgagaaggtgcctgccatagccaggagcgcatctcaatggaaacatcactggggtcacttgggaagaggacttcggggtagaggctgggaggagcccctggacatgcctgtcctgaaagcggctgcctccattatccattcccaagatgcctgatcagaaaccaaccatgaatgaacccctggctccttcaccacccccacgattggtatgatgctgccggcacagctgggatacacacggctcccccaggcctgagctgcttcactagggaatcctgcggcaggactgcagagcagatggcagatgcacatgttggaggagagagccttgggagccactgccactccagtcctgccaccaccctgtcttcctctgcaagtgctcagggaaatggccttcccgccggaggccagctatctgcctgacaggctgtgactcttctctcaaccttggccttctcccctcttctgagctagttggttgaattttttttaatgcttaagatttgtttttctcttttcacagcaacattttcttgaatttttttctgcacagcttttccaaaataaaaaccttccaaacaattctgccactcgcaatctctcctttcctctgtctccccaaagccactgcatgctgctgagtggctcctttttcccttcggtccccaagattcactctcctgttctatggcctgtttcctctgaaagaatctgactgtcctggaatcttggcacatgaagggtccttcagaggacggcagccaggaacacatacaagcccgagatgcctgcctgtcccctgcgcagatctgaaaccataacaaaagtgaccagggcaaatcaaactctgccagccaggcctgagaaaagattgattttttttttttttttttgagttccaaccccaaaaatattccaggacaagatagggggcaggctgggctggttcttcttcaatgggcttttgccgccaaggaggacagtggacttggcccacatccaggctacccccagcccgcttctcccctgcttagcccagggaggagacagtagaggtgatgggggcagccgggagggaggggccaaggcagtgatgctttcgggtaagaagttgggctgaggctgggggcacagggaggagctgcccaggtgcagttaccattgctcagtgacagagcctcaaagcttggccagggctgaaggtaccacacgggtgtgggtgaggcaggctaagcgggatggctgcagccaaggagctgggggagggccgggctcagggctagccctctccgctctaactgatgatctgccgaggtcgtccgtagcctgtcatgccggcctgggaggcccctctgttgctgcccatctgaaggccaatgacatgctttccctcctgcagctggctctctgtgaattccctcttatgctcctgcgctttcctagaagaggaggaaccaggataaagacttggtagaactgtgtgttttccacccgttttctgatccctctgttacgtcctagcccaatcccattgccttcctgttgcactttttttccctaatctagcttgcctcataggctagggagactgagcgcaggagggtggaaagggaggggtcaaggagtattaaggacccattattccccatcccagaccctcactttatcctttcttggctatctgcttcccctaatccttcccgcaagctcctta

SEQ ID NO: 807 - DNA, 10953 bp, Human
atcttcttacagtcaatggaggctggggtccttggtcaccatgggacatctgttctgtcacctgtggaggaggggtacagaaacgtagtcgtctctgcaacaaccccgcaccccagtttggaggcaaggactgcgttggtgatgtaacagaaaaccagatctgcaacaagcaggactgtccaattggtgagccacgcagcccaggatgaaacgacccaggagctttgctcttttactgaatgctgcagtcagcattcgaggagattccagcttggttagtcctgagcgatttgattgctctaagatgcaggtggacaacataatcccaacaagttatcggttccctataccctataatatcttacactgtgttaagtgcccagcatggcagtatggcagcttagaccaaccatttactgtgactgtctctctctccttgtctcagatggatgcctgtccaatccctgctttgccggcgtgaagtgtactagctaccctgatggcagctggaaatgtggtgcttgtccccctggttacagtggaaatggcatccagtgcacagatgttgatgaggtgaggaactgatggggctccgagtttctggatctaggaaagcagctaacctgtgcagtcgcttccttatggcagtgacttctaaacatgatgcacgctcttatttcctccatagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtacagtcaactagacgagtaaaccagaggacaggagagctgtccttgaccaaaataactgggagcgggaggaatgtaatttcatacccttcaccaaaaaaaaaagggcgaggagatgaatgtacggtctagttttagaaacgtgattagaaaatccatggtaaatcctgcaggggaaaaacagtcttccatatttaaaaatgctgctctggaataagttgtgagcagatggacttgtaaacgcctaggtgctgagcaaattcaagaaaaataaacataaagcaaagtttgcttatagcctcagggagaatggggagggacagaggtaacccacactcttccaaatggagcctctgtctactcagagatgacagggatctggattcttgtttccatgatatctgaggattctcaaaagctctgtgtaacagcagcatggtgtaccctcaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggtagagccaggtcctttgtgtgcctccagaaagagggcccatcaccttatcaaaacacaggctaaggaattttaaatacttaaagtttggacatgaaactgaaagattaaatctcccaaagggagaggggcactaattcctattaaaattaaatcacttggtgccaaaaacatgaacagggctagctctttttgggcaactgtgttccatagtcaactcttctgtccaaaaaaaagttcagtactctatccaaataccagcaaagcatgacttgtgttcacaacatctataaagcctagagcatttacacaaattctgtatgtatatcccccaagaaaagttttattttcttgtcttcccataaaaaaaatatgctgttactgagccaaattctgttctttttctatttggaattccaggtacactccctcgtgcatgagctcagcatgaggaaggcaactgaagcagtgatatatatcttctctttcctaggataattgccccaaccttcccaactcagggcaggaagactatgacaaggatggaattggtgatgcctgtgatgatgacgatgacaatgataaaattccagatgacagggtaaaaacagttttctatccctttttcatcttttcagttcagcaacagcctgaaacactttgggattcaaggaaattacatggctatagcaaaaaatataccaaatcaatacacaggataattagaaattattcattgtgttccagtagtttaaggatgtagatgttgccaagagaatttttaaatgagggttttgtttttcatcagaactgtttttctctgtacttgagaaattataatgcataaacaaatgccactttgttccctagattcatttcaaatgtcacatcgaaattacagtaaaattgactttgggcacactatgaactgagatgatgggattatattctacatctcactaacttctaacccacagggatccatttttttaactatgtccttttaacttttgtagtgatcgttttacactgagtgatcaattagcctatccactaggtagaaagtattgctgattttcacagttttagacatattatgcacatggtttgaggcttgagctgttttcaaggacaacattgttaagtgctccatttcttctctttgcaggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtaaggtgctgcctgatcagagggcccgcgggagacagggacatgcacagctttccaaacgtacttctgtctagtcctggctattagtatgcactttggtggaaacatccaaggctggagagcccagctcttatttgtcccttgttctcttcaggtatcctcaatgaacgggacaactgccagtacgtctacaatgtggaccagagagacactgatatggatggggttggagatcagtgtgacaattgccccttggaacacaatccggatcaggtaggtggatggactcctttcagagtctttcagtaaactgttggaatatccctttcatggcctttgaaaaatgagcttaacaaagttcaaacactttcattactgtggctccctggcttctcatagccaactggaatacgttcatgtaaataatttgcctgatgtgagctccttgcacagagtctcacagatctttagcatgaagatctggtaacttcagtcttaccttctgtaagaagggctactggacttgctcagcatcgtctaccattgttaagacaaattatacaaagcagacatctgtgactgacaactgtacaataatattaatcatatgtaatactaagagatggaaaaataaatgtgcataagcaaaataaccattttcatggctaatgatgtaatctagctataagaaaatcatcaaactaaggatacatccaaaaccaaagtaatttatccctgtcataaacattacccagacagtatacaacacagggaccagtggtctgtttccatcttttcaggacttttcagagaagtcgacgtgtcaacagttttacaactgaaaccttctaaggaaattctctgttataaagtatccagaaaatttcatttaacattaagatgtaaacagttaacatttcatttcatctttagtaattaaatatcactctatttgaccttatttagaaagttttatatgtaaaacatttttaaattatcccttctcagatttttatacgaaaacaaagataaaggaaaaaaacttttaaaatgtaattgctactattgctatctttctgcaggagtgtgtaaatagacatgacaccccactggctgtatcaaacaatggagaattttccctgtggtgggggcataagttatctttaacatgaatggtttatactgcaatttaccctccatttacatctctctttcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggtgagtcatgggagccactttctaagacagggactgctggcacagctgtgtagattgaagaaatgaaaccaaggctcaaagcatttgacaggatgaagggaccaaatgccaacttagacaagatagtgacatttctgacaccagtaataataatagcactttagaattttgctgaactcttgcttttttgacctcaggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggtgagtagcgagttcttagatcctaagagactgatgcatacatggggaaaaacaaatataaaacctggcagttgtacctatccctgtgggtgctgaggatgtctaggaacatgatggagaaccttctgaaggctgcaggttttaacctggctctgggctcttcttccaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtaagaagcaaagccctggaacagagagagagcttatgggtgcctgactagcactggggatgctgtgctttgaccaagactctgaccagggagtcttagaaagttcccagcatcaccagctgcagcattgaactctgctttgtaaaaacataatagtgttgaaaagggagcttgaccaagaattgccctgcaaatcctaaggtgccttcagccttttcaaacaaaaaaacctccttccctcctctctgtactgctttatatgtgtgctcagtggcacacaacaaatatgagaggacttggaaaaattccccattgcagccctctaacttagatcagctcagtacctttcaagcattgtttctgatggaatgaaatagaaatctttacctgaaggagctgtgtttcaacctttccttttccttttccttcaggtgcgcaccctgtggcatgaccctcgtcacataggctggaaagatttcaccgcctacagatggcgtctcagccacaggccaaagacgggtttcattaggtacgatcatactgattcactttcacttacagtcacactgagggacaaaaagacaaaaagtattaaatagcattgtcactaaacaagattttttttccctgcagagtggtgatgtatgaagggaagaaaatcatggctgactcaggacccatctatgataaaacctatgctggtggtagactagggttgtttgtcttctctcaagaaatggtgttcttctctgacctgaaatacgaatgtagaggtaagagcaacatcaccatgaatgtacactggacatctctatttcagactaatatcaaggatgacggttatgggggagtccagtgtaaagactgttttggagacagggttatttctattttgcttttgaggacacaaggacaaaaatggaataatgcctaggcactgtggcttatgagttcctgagtccttagctataatattagtttgcttagcaatctctgtgctcctcatacacagtgcaaaggtaagctgcagaaaagctcctatataatttggacttcattaataatactgttctttacaattatatatttatatatcttactgcttattgttttatgcatgccatcacagcacgagttagcattcccaacttttccctgtatacaaagaagggagaggaatgttgctttcatattggcatgttaaattaatgttcactattaaacttagcattttttttcctcattcttttttacttagtcattacttaagctcgctgagtccaacactggctctaccacaaaataagtgcttaatatatatttactgggccaaggccagatacctaaaagatcaatgacagtagagaaagatggttgattttactcaaaaaaatctaaattattaatgtaatttttgagtccaaatttttaaaataagactccctaaactgttaacattgaaagcctttggaaagcataatatatgttctggaaggttcacgctgtgtcggtctcctagcatcaatgtcagctaataaaattaaatgctaatgtgcttgaacaaccttaaaattaggcttttgtcattagaaaagtagagctattcctatgtggttaacttattaactaagatgtctatgcttttatgaattagttttcatttgtatatttatttatatttgtttatttaacagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttaggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttggttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatatttatacttactgtatccatgcttatttgttctctactggctttatgtcatgaagtatatgcgtaaataccattcataaatcaatatagcatatacaaaaataaattacagtaagtcatagcaacattcacagtttgtatgtgattgagaaagactgagttgctcaggcctaggcttagaatttgctgcgtttgtggaataaaagaacaaaatgatacattagcctgccatatcaaaaacatataaaagagaaattatccctaagtcaagggcccccataagaataaaatttcttattaaggtcattagatgtcattgaatccttttcaaagtgcagtatgaaaacaaagggaaaaacactgaagcacacgcaactctcacagcgacattttctgacccacgaatgatgccttgggtgggcaacacgattgcatgttgtggagacacttcggaagtaaatgtggatgagggaggagctgtccttgcaatgttgagccaagcattacagatacctcctcttgaagaaggaataataagtttaatcaaaaaagaagactaaaaaatgtaaaatttggaaggaatccataaatgcgtgtgtgtctaaatacaaattatcatgtgaagaaaaggcccaagtgtaccaataagcagaccttgatttttggatgggctaattatgaatgtggaatactgaccagttaatttccagttttaatgaaaacagatcaaagaagaaattttatgagtaggttaaaggtctggctttgaggtctattaaacactagaaaggactggctgggtgagataaaatcttccttgttgattttcactctcattctataaatactcatctttctgagtagccatgatcacatacaaatgtaaattgccaaatcattttatagtaccaaggtgaagaagcaggaactagaaagtgttgataatagctgtggagttaggaaaactgatgtgaaggaaataattctttgaaatggcaaagaattaaataccatcattcattatcagaagagttcaacgtttgaagtgctgggagataattctaattcattcttggatagtgaagcaaaactgattgaaaataccaagataagacagaaaaagtgactggaaagaggagcttttcttccaggcatgttccagtttcaccctaagactgaccttcaaataatcaggttgtactgaaataaaggacttgttaaaaattaaaattatgtcatcgagatgatagcttttttcctcctccaacagtttattgtcatgtgttgtgggagagctcgagtgaagagcaataaactccaggtcttataagaatgtacatacaataaaggtggtgccagcagtttttttttttctaaagagtcacatgtagaaaagcctccagtattaagctcctgaattcattccttaaataaattggctctctctctcttctataatttctttttctttttatttttgagatgaagtcttgctctgtcgcccaggctggagtgcagtgacacaatctcggctcactgcaacctctgcctccccggttcaagcaattctccctcctgcctcagcctcccaagtagctgggactacaagcgcccgccaccaagcctggctaattctgtatttttagtaaagacggggtttcaccttgttccggacaaacactaagccctaaagggaaatccaaaataaaaacatctatttttaataacactttctatctaaatcagggtgactttttaaaaaaaatccggaagctttgtgttgaattacgttacagacttagttaccagtccttgttagagttaccttcagttgacatgctgtgaatggtcccacctcttttatggcagaattcattacttaaaataactctattttcttcccccttacctaaataacagaaaggctcactatgtcccaaatatcattggcagaagcaaactataaagtcataagccctttgcagtgcaagtctagaaataattt

SEQ ID NO: 808 - DNA, 6392 bp, Human; identical to SEQ ID NO: 637
  misc_feature (1)...(6392): n = A,T,C or G

SEQ ID NO: 809 - DNA, 38611 bp, Human; identical to SEQ ID NO: 649

SEQ ID NO: 810 - DNA, 39553 bp, Human
tcctggccaggcacggtggctcacacctgtaatcccagcactttgggaggccgaggtgggtggatcacgaggtcaggagatcaagaccatcctggctaacacggtgaaaccgcgtccctactaaaaatacaaaaaattagctgggcatggtggcaggtgcctgtagtcccagctacttgggaggctgaggcaggagaatggcgtgaacccgggaggcggagcttgcagtgggccaagattgtgccactgcactcccgcctgggtgacagagcgagactccgtctcaacaacaacaacaacaacaacaaagatcattcctggcatcagtatttcaaatggaagggcagcaggcaggaactctgatgtctcaacaccctagcttttagtgattgccctggagtggcactgtccacttgagtagcccctggccgcatgtggctcttgagcactggaaatgtggttgatccaaactgagatgtgcgattaaaacacatgccaggtttccaagccatagtatgaagaaaaagaatgtaaactatctcattaataaattttttgttgatgggctgggtgcagtggctcacacctgtaatcccagcactttgggaggctgaggtgggaggatcacttgaggccaggagttcaagaccagcctgggcaatatgatgaaaccctgtctctactaaaaatacaaaaagtagccaggcatgggggtgtgcacctgtaatcccagctacttaggaggcggaggcaggagaattgcttgaacctgggaggcggaggctgcagtgagccgagattgcgccaccgcactccagcctgggcgacagagtgagtgagacttcatctcaaaaaataataataaataaattttgtatggatgacatactgaaatattttgagtgtattagaattaaaatatatcattgaaattaatttcacctgtccatttttacttttattagtgtggctattagaaagttttaaattactaggaaagctgtgtcatatttcaattcaacagagctgctctatggtctcctttttccctttgaagatccgccatcctgcaatccctgcttccttttcaccagagcagcttccctgaatcttctcctggaggctctgcagaccttttctttagtttggaagatcacattgcaggaggggacttgggcactggtttctgtgaggagcccggagtggtgaattgcccctgggattcccttaccctggaaactaaccctctctgagggcagaaagctagaaagaagagcggttgagaggaaatgcctgtgcaacccccagctcccttcggggctccctcactgcccacaggctctacccccacctgcctttgcctcaggagatggcttttggtggtggactcaccctcctccgatctcctctgcttcatttttccacttggtgatccatcttttgttctgcggtgtgtcctgttttctggctgcctccattagcttggttttttcctttgggtatccctggagctgtcttaccaggatctccaacttcagtccccattggtctgcaccactggcctgggaaagctccacccaggagagcagacccagctcccagatacctggccccagcccaatctccgtcctctctttgcctggaagagaggaccagaccgtcttcatcaactggacccaccctttaccaagcaaagaaaggaaaggattgccccccagggccagcagatctctggctgtctggtgtttctggtaataagtgcccatgaacttcgaattgatctccagtctcccatggtatggttttggtctacccttagattctgtttaccaaggcagagttcagtttctctgctttcccttccaacatccataccttgttaagttcttgctgaattgagctaactctgcacacctgattaaatcttcagccagggctctggacattataaagcagcctccttgccagatggctgtcatataatatattgctttatttaggtgattgtaagtcaggagactttccttcggtttctgcctttgatggcaagaggtggagattgtggcggcgattacagaaaacatctgggaagacaagttgctgtttttatgggaatcgcaggcttggaagagacagaagcagtgagtaaaacgggcccctcgtggtaggcgggcaaaggtcgggaaaggagggatgaaggaagctgtgcaacaccccttcccagctttctaaagaatggagcatggcattgcaaaatgctgaatcacaaagtgagaagtgacttctttccagttttctctcagccttgtgatgatcttaaagagaaagtctcaattctgtgctactgtgtctttaacatctctcaaatgcttccgagagaaaacaggccccaaccctggagcctttccaggcagcaggactagctggaatacagtaacattgtggtatttctggtgaattaatttttgtgttactttctatgtattgcaaaggatattttttttctgtttctaatggtgacattacattcctttaaaattattagagttttcaaaactcaattgaaagcaaaaggttaagcaaataaaggacaggtgtgactcaattatggcaagaacaacaaaaaagtgactatggtggggacgttgaacatttagaaaacactgtcctaaaagaagaaggtacagagagtagtctgatacctgggagtactagattttaaaattattctcttgccaattttattcattcattcaccatgtgccacaataatttttttaagtctttctttgattttgcagattccagaaataaattggaaattgaagatttaaacaatgttgttttaaaatattctaacttcaaagaatgatgccagaaacttaaaaaggtattattaactgctaatttaaatttaatattgtcagctggtatgctttaaatgaaccgattttctaaagctaaggatcctaaagtgggtcatagaattgactgccatggaaaatagccgggtgtggtggctcacacctgtaatccaagcactttgggaggccgaggtgggcagatcacttgaggtcaggagttcaagaccagcttggccaacgtggtgaaaccctgtctctactaaaaatacaaaaattagctgggcatggtggcacccgcctgtagttctagctactcgggtggctgatgcaggagaattgcttgagctcaggaggcagatgttgcagtgagccgagattgtgccactgcactccagcctgagccacacagtgggactctgtcaaaaaaaaaaaaaaaagaaaaggctggattagtatttaataacttttattggaacaataactaatattttcatacctttaaatttttttggtgaggatctcttgcccttctgttgctgataattttaaattttactctttcctgctctatcatttggattctaaaaagaaagctattgtgtggggtctggcatttgataggttaaaaaaagaaaacatagaagcatgtcaaagagcaggagactcatgtgccacttggtggaaaaaaaattgagaaccactggacctgaatgttaacagatgtggcttgtgaaacatattaatgatgtggatagtgttaaaagatctatgagcttttttttgaactacaaaaaaaccttttttttactctctctctgaaatgcatgagttttcctgcctagacaaacgacaaagtggccaattccaggcctttccacttccaagatcattttacacacgcaagtattcctggacaagaagaggctgaaggatcttctgtgggatttttttaaaaaattattattttttgctgttattgttacaaggaaggtagtgagtgcaattttgggataactcagatgaacccaaatgttttttaatgcccaaataaaatagcctgggtccctgttcctacccagacaagaaactcagcacttgtaccaggttttcaagggtttccagagagatacctctcttgggaatctaatcccaggaactctgtgccggctctccctcttcctcctgcccctctgccctccctctgtcccacttcatgccacatgggctattgcttttccctcctttcccagggtgcttgtgtataacagactttgctgaaggtcaaggacacgggggaagaggttatagcacaacccaaaatgggcaacagtgactgagacatcaccgtccgcaggttccttgcctctggctaccacaggagacttcatgctgctgtctctcttctcaggctattttgtgctgagaccgtctcccaccaaaccccacaggtctttctttctcagttctgggcctgttccctgcttggggaatgcagaaacctccaagccctgttaaccttattatgtaaaataaacacctttccatctctatcccagtataggatcaaagcacacttttgctttatagtaataataaagatgttttgatttaaaaataaaaaagagttggctatctctggtcacctaccctagagatgtaaccctcaagtgcaaacaattaaattatgattttttttctttaatgcatctaagataaaagtttttttagagacagggccttgctctgtcacccaggctggagtgcagtggtgtgatcatcgttcactgcagccttgaactcttgtgctcatgtgatcctcctgccttagcctccccaatagctgggactacaggtgcgccaccatgcctggctaattttttttatttttgtagagatgggtgtctcactatgttgcacaggttggtctcaaactactggccttacttcaagctatctacccatctcagcctcccaaagcgctgggattacagtcatgagccaacttgcctggccagataaaggtcttaagcatggttccttcctgctctaggtagagaaaccccacaaccagtgggaggtggggtgagctctttctgtagcttttgctttgctgatgatgtcattgatctcttcaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtgccccggggacagggacgggcatggcattgtgtggaccccgggagctagaagaggcctctccctgctgatctgagtgaagagcgtgggagtttagtccagcgggcagggctgcattttggggtactaatagcacacaaatgcctgggttagcaggttgcacagtcaggtattttacttctgtgtttgtgtctggagcaaaccctgacatctcagttctcattgctgtgtgtattggttcccagacacttcatttttagatcccctttaaattaggagggaaaaacaacataagcataagagcatccccagcagcgatgttcattcagtgcctctgaaggctggagggctgcttgttgctgggtgagactcggaggggaaccgactcagggtcaggaatgatgacatcccacggtgggtccacagtgaagaatcttccccgctccactgtgggacgccttaacagcccttacttccacttacgctttgcgttatctcctgaaaaataaaatggagaccacaaattccttcttggttagaggaatgacacaactcatttatgacatgaccccgctgggactcagaagagaccaggacggtttctgggggaagcagtagcacactcgtgtgctttgttctcttctcttgatttgttttcccacatttttaacaagaaaaaaagccgtttttaatatatggcctatcgccctcctactgtgtggcccaggtgcctacctcattatgcccaaggggtggttctcacctctccactctcattcctgcacagcagttgtgtcaggttaagagggacaaggagaaggctgggcaccgtggctcacgcctgtaatcccagcactttgggaggccgaggcaggcagatcacctaaggtcaggagtttgagaccagcctggccaacatggggaaaacccgtctctaataaaaacacaaaaattagtcgggcatggtggtgggtgcctgtaatcccagccacttgggaggctgaggaaagagaattccttgaacctgggaggtggaggttgcagtgagccaagattgtgccattgcactccagccctccagcctgggtgacagagcaagactctgtctcaaaaaagaaaaaaaaaaaaaagaggtagagaagtccatggctatttgtctgtcctttttatttttaggctcatggaagcctcctggtttcttagagctgagtggttttatttcttgctcaggaggtcatttcacagattttcgggctccaatatgttgactgtcacagcagctggggggatggcatagctaccggctgtactaagaactcagagccctgccctgagcctgcctgagggtccttatggtaggaggatgcccctcatgccagcccgtgccctcatgcttgtgtcacctccaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccaggtaggagtcagccccagcaagaccgcaggcaccagtgcaagcagggccctggggggtttggtaatggctgggccagccctgagtgccacctcaggaagcaggcccaggtgctattttgattttagaaaggaacagctgaatcctgtctcccaagtgcagcccaggtggctgcgattgaactgcccacacctcgatggtctggtttatagaggggcctttggaagtatgggaatggcctgtgttctgaccccttgctttcttcctattctgacatatgtagacattttaatggttgcacaaattcaaggttgtatttttttttcttttaaaaaaatctttagctggacatggtagcacacacctgtagttccagctactcaggaggctgaggcaagaggactgcttgagccccagagtctaaggctgcagcgagctatgattgtgcccctacactccagcctgggtgacagagtgagaccctgtctctaaaaaaggaaagaaaaaaattaaaaagccttgccaggtttgattctaggcaaagtattctgtcaccgttgagtgccagtccttatttccaaactaatggaagaccccatcagttaactgattagttcaataagtattttttgctgtatccaccacatgccaagaccctacactgtgctggatgtcagggagacagtggtgagcagacacagacagggttcctgccctcagggagcttcaagtcagctggaagagaccaccagtcagcaatctcaaaaatgtgtcaggacagcggcagtccaaggcatgtgagaacatatcattagggccaggatctgctctggggcaggagtcttctttccctgcttttgaactctccactttgagacagctgttggtaacataccagcaccaaggacctaagtcctgccttttaaagaatccaatatgttgttggaaacagaagcacaagacaggtgtgtgcttaggggaaacaaggccagccggcagagtgtcagtgctaggctccagcttccacagcccctgcaggtgcctgccagccactgctagcttctgactctgtctgctccttcctgtctccccttgtttccttcccccatgaaaaaaaaagaaagtattcccatgaggaatcattctttcgaaagacttctctgttggttccgttagccagctactttactagcttttacagtgtaattcactctacaagcagtctcacacaaaagactacatattgtatgattctgtttatatgaaatgtccagaaaaggtaaatctatagacaaagcaaatcagtagttgcctacggcccagggattggctacaaataggctccagaaaactctgggaagatggtagagatgttctagacctggactgtggtgaggtttgcacaactttgtaaacttactaaaaattactgacaaatatataacactccctaacactttgggaggccgaggtgggcagatcgcttgaacccaggaatttgagaccagcctgggcaacatggcgagaccccgtctctacaaaaaaacacaaaaattagttgggcttggtggcatatgcctgtgtcccagctacttgggaggctgaggtgggaggattgcttgagcctgggagtttgagactgcatgattgggtcactgcaccctagcctgagtgacagagcaggaccctatctctaacaacaaaaaagcagtgttggtggaggagggccagcgtggccatctggcctggccctcgagtgcgaggggcttcagtgtttagctgcagttcagtgatgacactgtgcggaggaataagggtggcctgtctcagacactgatcccagctgaagtttgtcaccttctttctggcaaatctgaggtcaagcagagagatcaaagcctggggccctcagggtcaggaatgctggctctgtgacgctccccaggtcctgcatctgaggagtggctgcgctggcctcagggcccaggttgtgaattttgtttatgcactcgcctctcctctttgagacctccctgtttgatgctgtttctgcctctctcctcaccctgctgctgtgccctgccaccccctccctccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcaggtgaggctgccaggcaaggggagcaacaggtgggccgggcgggccaggctcggagggcatcgggaatggcatcatggaccaggatcccccaggactcatgaccatggcccttggaatgtccagaccttttctttcttagcagggcagaggtcaaggtgcaaagcttcgaggcaggtggacctggatcagccacagctgggtgcccttgaacaaagtgcttaactctcagagcctccacgccctcatctggaaaaagaagatgctcataatcctatcaattatggccacagggaccaatgttagttgagaatgggtgaagtgcattacaaatattacctaatggaatgctctttacaaccctgtaacttaggtactgttattgtctctattttggcagataaggaagtagaggcacagagaagttaatagcttgctttaggtcacacagctcagacatagcagtgccagaatgcataaagaaccttccttttaagattaatgtaaggctccgagatagccctcaaaaagtttctggaatatgggagcttttattactgcagagaaagcagaccttgtgccagttggcactggtgactttctgtgatcaacgctagcagcccttcacactgctagagacctcagttaaaatgctgactcgtggttgttttcctgttccatagtttacgggaaacagagcccagtctgttttcttctattagcatttcctatgtaaaataaaccttgtaaatctctacagggggttaaatttgccattacttgactcatgcatttctaaaaagcagtagggatttggaactgactcccagtgcctgtcacaccagtgtcagagtgtaaataattgcatggggacatggggtgcagggggtcgaaggctgccctagcctgggaattggaaaacctggagtctgttctctgtactctcagccagtgactctccctctgtagccccaggcagtctcacactcagtgccaccctctgtccatcttttttttttctcccccaaatggagtcccgctctgttgcccaggctggagtgcagtggcgtgatctcagctcactgcaacctccgcctcctgggttcaagcgattctcttgccccagcctcctgagtagctgggattacaggcacacgccaccatgtccggctaagttttttgtatttttagtaggacggggtttccccatgttggccaggctggtcttgaaatcctgacctcaggtgatccgcccgcctcggccttccaaaatgttggggttacaggcatgagccgccgcacccgacccctctgtccatcttttcaatgggaaactccacaccagtgtggtggccctgcccttcctgctgtccccaggtgaagctttccttcacaccagtgcaagaaaaaacagcttgtaggaaagcagaggatatgggtaaccacgggaagcacactcagttctctggctgcatcagttaggattagttttagctgagagcgaaaaccccaaatgttggtgagttacaagcttatttctctcatgtaaaagtctagaggtaggtagttcaggactggtatggagtctccatgaccctccggagcccaggctctcttctgccttcctgttctgccatcctcactacccggctttcccatcttggcccaagagggctgctcaaactccagccatctagtcgacactctagctatcagtaagaaggaagggcaaagattgagagcatgcctcaatcttttaagaacacttcttggctattactaattatattgctgcttagatttcagaacttaatggtatgggcagaatttaatgagatgggcccagctaaaagatgggggaatctattgctaagaaagtatagatattgggaatgtctagcagcctgtgctgtcttgggctggccatgccatgtacatacacactatttcccagcaccaagctggggactctgagggaaagggtccagagtgtctgacttgatcattttgatgtggcctaaaaatcaagcttttaattgttcagccttttacttgttatcaaggtcagcttgtgggtctaattgggcccaaggcttgtgtttctaagtaaagttttattggaacgcagccatacccatttatttacttactggctgcttcacactacacagttgagtagctgtgacagagaccacatggcccacagagcctaaaatatttgctgtctgacactttacagaatgacatgagcagtctcctttgacagtgggactcacagccttttccagtgacaaatcagggttagcccatgtgtttctggatggggggaagctgttggcattttgggtataacagttcttgtgagacctgtccagcattttgcaggacacctaacatcattggccctgcctgcaagatgacagggcactccctcctccagtcacaaccactaaaagcagcccctgacatttccaaacccatgccctccaccatacgagaaccaggtacagggtctggctgacacataggtcacacgcaaagggtggatgtcagaggtggctggcctcacacgtcctccctgtgtccttcacggtcgtgtgaggagccaggggctgtgctgcagcctcgctcatgggctggtgcaggatgggtctggcggccccacgttggccaggctttgtaaggggctatttggctgattgctgtggccattctccaggggcgtctatacctgagaaaactccagggcctgaaggcttctggatctttgtaagattaatggtccttcataatgagtgcctgccctgactcgtaatttttttgctgttttatttcagactcagcgtaaaccagatcactgacggtggggtaaaggtgctaagcgaagagctgaccaaatacaaaattgtgacctatttggggtatgtctttctccagaacactgggccaactacctagtaataatacagagctgcagggaattcacattcccataggtccctggatgatcggcacggatggcccagggctgggaagagcgctggcccaggagttgagagtcctgggttctctttgtggctcggccagtcatgaagtcttgctgagcctcagcctcctcacctgtaaaactgggatcccagtataggcaagtaggcttacaactggttattgggggatgcaacgagaatataaggggatatatttaataaatgctagaatcctgtttacatattagtctggactattttgggtccataatccctcatccagagcctttggggcaagacccgaatggggattctgagtgcatgctatggcatgacgtggccgcaggggtctaaggcagtgccccattttcaaacactttcatatttctcccgcagaatgtatgaaacagtcaaaccaagtgtggtaagaaagactataagtagctccacatcagttgccaaaagaattgtgagaaactttgggcattcagagcctttgaggttttggagtctgagagaagggattgcgggccagccccacacaactggtggctctgcaagctggagcagttgttcagtttcttggggcctcagtggccttcgatgttaatgaggacatggacgcaaacgaccccgggccacactcggctccagggctctgtgtggctgtggaaccctggaagcctgagcttagctgcctttcaacttccatctgctgtactattgaattggcattgagcggtgagatggctgaaaggtagacatcgagaagttttaatattcagaatcttttcttctcaagacgctgaatgtaatcttagttgtaaatacccatcacctgccagtcaccgagcactcatgcaccagggctttgcgttatgtcctaagatcctcataaccaccctgcaaggggactatcatcattacctctgtattacagatggagaaactgaggcacagagaggtaacgtgacttgtctcaggccataaagctggggaaagtagtggagctggttttgaacctgagctgtgagacctcagagccctaaactctggtgcctgtgtgttcccctttcaacccagactttggaaatcagtagacaccatatgcttcaaaaaacaggggctattaaaatgacatcaggagccagaaagtctcatggctgtgctttctcttgaagtttatacaacaaccagatcaccgatgtcggagccaggtacgtcaccaaaatcctggatgaatgcaaaggcctcacgcatcttaagtaagtggggtaggcaccaggttccttagtatattctcttgatcacccccttctgttgttcaaagattaaatgtcacagtaaagagctttcatcctaaagccttccacttgtcccagggccatgttggtcaagtaaagatacctctgtgtgatctgtgaggcttggattctggaagggcctcccgttattggtagggggaaaggttggcattttgatttcattaactactaggccgaagaaaggactaactctcaccctttctggtggtctttttgccccaagggagtttcctgtcgggttgcaaggaagagcttgggcccttgccctgctgtaggtgtgccctgcgcagggggtgacagtgcgccaggcttggagcctctggtcctgccctgacagtggccacataccttgacccttggcagtcaaagtgggacctcccaggtctcccgagggaagtcagtgatgctgctgaggtcaattagaggaccccagggagggctcaggtccctgagcttctgcagagactgtggaccatctcctggagaggaaccctgactgactgtcctcagggcttcagttccctccctgacaggaggcccaggccatggctcttgtggatcccagaagaaagtgtacggttcccaagatggggctggaaggggctctgtgctggggaggagggtgacccacattggagcccctgcatagctggaggctgactgtgtgtgactctctctgcagactgggaaaaaacaaaataacaagtgaaggagggaagtatctcgccctggctgtgaagaacagcaaatcaatctctgaggttgggtgagtagaaggggatggatgtatgtggtacaacctgctgtgtgtgtggggggcgggccttgctgttcttttcatacatcagtacaccagaaggaccactggggctcgctgtcggggagagatagtggagagctttcaccatgctgcgaaactgaaaccgtgcccattaagcaataactccccggtccccctcccccctgcctcttgcagccaccctgctacttactctctctatggttttgactactctacctcatgtaagtggaatcatacagtatttgccttttggggatggctgatttcactagcatcatgtcctcaagattcgtccacatggaagcatgggacaggatttcctttttttttttttttttttttttttttgacagagtctcgctctgttgcccaggctggagtgcagtggcatgatctcggctcactgcaacctctgccttctgggttcaagcgattctctcgcctcagccacacgagtagctgggattataggcacccgccaccaatcccagctaatttttgtatttttagtagaggcggggtttcaccatgttggccaggctggtctcaaactcctgacctcaaatgatccacccacctcggtctcccaaagtgtcaggattataggcgtgagccaccgtgccccgccaggatttccttcttttttaaggctgagtaatactccattgcatggctatgccacattttgtttactcattcatccaagaacagacactggcttgcttctatgctttggctgttgtgaataatgctgctgtgcacatgggcatacaaatgtctcttcaaggactgccttcaattcttttttttttttttttttttttttagattctttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgctgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcgaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcattgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggcgattttgctcattagttgatgcagtttcttcctagtctcgatggtctttacattttggcatgattttgcagcggctggtaccggttgttcctttccatgtttaccgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgaactttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcagtgtagatgtcctttctggttgttagttttccttctaacagacaggaccctcagctgcaggtctgttggaataccctgccgtgtgaggtgtcagtgtgcctctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggctatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgatcccttgcgcttcccaggtgaggcaatgcctcgccctgcttcggctcgcgcacggtgcgcgcacacactggcctgcgcccactgtctggcgctccctagtgagatgaacccggtacctcagatggaaatgcagaaatcacccgtcttctgcgtcgctcacgctgggagctgtagaccggagctgttcctattcggccatcttggctcctccctccaattcttttgggtatatatccagcagtgggattgctggatcacatggtaatttttaattttttgaagaatcatcatactgttttccacggcagcagcaccattttatgttcccaccaacagttcattctagtttctccacatccttgccaacacttgctattttctctttttgacagtacccatcctaatgagtgtgaggtcctgtctcattgtggttttgattcttgaggctttttaaagctttttgtttcattataatttttattggattacaaaaggaacacaggtaattttatttggaaactatgaaaaataataaaaattatcttctcagaaaatgattcttgttaacatttaagctcagttaagctctctcactttctctcccttctctctctttgtacaacttttaaaaaatatagtaggggtgagactatatgtatctatactatagtaggggtgagactatatgtatccttcctttttcacttaatctcatgccttgagtagctttccactttattaaaaatgtgatgccattcaattgtatagtaaatacatatatgtaagcaaaacactgaaaactcttattctgggttccagcaagccatacctggaatggtgtaagcaggtagtttgcttggtgtgaacgtgttgttgaggcagctgccattgtgttgtgagtgggccacacgaacttgttctgttgtgtgtagacagtgtgtgctgatcctattaggaacagccaacgctttgtgtgagccacacacggttctaagtgctttgcttctgttaactcagtgaatcctcacaactccatgacggaatgctctaattatccccattttatagatggggcaactgaggtccaagagactacataatttcccgaagttcacacaggtagcagatggcagagccgggtcaggagtccaccatcttaccacgcagactgttttagccagagactctccggatctgctgtaggggacagaatacagctttatcgccgcacctgtccaccaagatggccgtagccacagagcttggttgggtaacgtcctctttatgtgacaggaacgttgctgatggggtttctgaaggtacttcctgctctttgtctcctggaagactgtgtcttcaggaatgtctctgaccctgcccagagttgaacggatgctgggaacccagcacctgcacacggccttccctccaggactctgcgcacctctgtgctccacaggagacatgcaggtgctttctctcatgagctcaggctcctgggctgacagctctccgaagctcgtggtgaggctcggtctctaactgtgccacttgccgatggcctctgttcacaaggcttcccctgctcttcgatcttgcatcaccccttgaatttgaaatccagagcagcccactcagagaccagtgtgaggaattagtgtccaggccacagatccagggactgggcacaaacatctgcctgttgagtaggaactgagctgtggccattggcaaaaaaggaggggtgagcatggctgtttcttggggagctaacattcactatcttgtctcctccctcaggatgtggggcaatcaagttggggatgaaggagcaaaagccttcgcagaggctctgcggaaccaccccagcttgaccaccctgaggtaactgtggccctgctgtctccaggggccaacctggtccctcccagctgctctaggtttgctggggaagggtgattcgtgctcctaatagaagaggaatttgcatgtgtgattttccttactcttgtcaaacctttctttgatgcataagaggccatctagtaaagcacattcttctctttttttaactttaagttctgggatacatgtagaagatgtgcaggtttgttacataggcaaatgcatgccatggtgatttgctgcacctatcaacctgtcatctaggttttaagccctgcatgcattaggtatttgtcctaatgcttgccctccccttgccccccacccccaacaggccctggtgtgtgttgttcccctccatgtgtccatgtgttctcattgttcaactcccacttacgagtgagaacatgcagtgtttggttttttgttcctgtgttagtttgctgagaatgatggtttccagcttcatccatgtgccagcaaaggacatgatctcatttttttttatggttgcatagtattccatagtgtgtatgtgccacattttctttatccagtctatcactgatgggcatttgggttggttccaagtctttgctattgtaaatagtgctacaataaacatacatgtgcttgtgtctttatagcagaatgatttataatcctttgggtaaatacccagtaatgggattgctgggtcaaatggtatttctggttctagatccctgaggaatcaccttaagtgtttattcagctcagtgaattctgcatgtgtcccacaccagccaaccaccacccccatcaagacagaggacatttccagcccctcagccatccctgcatgtcccttgctggtagagggagggtttcctaagtgcagatgaaacttaataagatgctggccagcagattcctgccccttccttgtcctcaggatgatgctggaaaagagggactcttcctctctataaatggggatgcacctacccagcccccgcttaggctgctggccaaatcttgggaccttggtatgtccacggctctgctgctgttcttcctaccactgaaaaagagtccaagaaggtggggacagtagcagaagagactttgccaggtcttgcagatggggtaccttgatggggccagcctttagaaggacagcttgccaggcctcgccagcctcctgcccatgtgcagaaacctgaggtgccgaccccagcccactgttgtgtgagcaggctgtgctgatgacccatttcccgtccagcctgcccttgtgctctgtgtgtgggctctggggcagcagcgcctgggcactactgctgcagctgaacacttctgcatcctgccccgagtgagcctgggctggggccacagccaggcagaggcttcccagctgttctgatgttgaagctaagattgaatgtagatgtgtctttaataattcaccccaagtgtgttccttcctagtcttgcgtccaacggcatctccacagaaggaggaaagagccttgcgagggccctgcagcagaacacgtctctagaaatactgtggtaatagctcgagtcatttcatttgtttgtttgtttttctgtgatagggtcttgctttgtcgtccaggcttgagtgcattggtgtgatctcagctcactgcagcctccacctcccaggctcattcgaacctcccgccttggccttccgagtcctgagactataggcatgcaccaccacacccagttaattttaaaattttttgtagagatggggttttgctatgttacccaggctggtcttgaactcctgggctcaagcagttctcctgccctggcttctcaaagccctgggattgcaggtgtgagccactgcacctggcacagagtcattttggagggtttaggtcccaggaattatcccaggggctgcacatggcctggaatcttaacagaaaaggtgtctcccaattggaaaggctctaggcctttcagttaagttgataatttcctcctagagaagagaatagccacttctacaagcataaacaggtacaggaggaggaagtgggctccgggagcctggatctgaggccttggccttctaggccccaggagaactagaacgctggccatgcaagctatccaggtatccttggataccttcagatgtgcttagcagaggccaacttccacacacttggctcaaaattttctcccttcctcctcttcatctgccttcccccaggcagcctcctccttccccaggtcttcacatcagggtttggcctttatgctccatccagctcatctgtcacttgtcacctgaagcccacagtcctcgctccctctctgcactctagggcacttactaagtggatgtggcctcctgagagtgttttttgttggtgttcccttttttatggccacttaatgttttattttgctttatttgtatttacatctctgtatcataaattccatacaggtggctgggagcagtgactcacatctgtaatcccagtactttggaaggctgaggtgggaggatcgcttgaggccaagagttcgagactagcctgggcaatatagcgagaccctctatctacaaaaaaaaaaaacattccttacaggttaagtgagggagttgtattacaaccctccctatcatctactcagagcccagtgctcatttgatcttgctaaattagttactgagaataatgacaatatcctcttcatgagagagttttgacattaggcctgctgtccagtaagtgcattttaaattctttcccctcaacaaatcatttaacattttgaaaagtagtttatgttttttggaaaaaatgtaagacactaaaggaggacatgaaagtacctcctaaagttcctgctaaaaggaggaagtgaaagtacctccctttgtgttttccaaaataacctttcctttctagccttttgttctatgtatgttcaaagatatgcaaaacagaatagcattcaagcagtggctctaaaaatattgtaatcacatactttacatgtctcctttagggtttctccatcttgatgctgttgacattttggtccaagtgattctttattatggtagggctgtcctgtgcatcatagacggtttagccgcatctctgccctgtacctcccagtggtgaggatcaaaaatgcctccggacatggccaggtgccccatggagagtgaaatcacatggatagtagtaatgtcaacacctagaagccctcaagtgctgactgcatgccatgtgttattctacactttttccctgtgttaactcactcagcctcacaaccactctatacgatctctactgttaacgttcaccagtgagaaaactcagacccaaagaacttaagcctgttgcccgaggtcaccctgctggtgggtgatacaaacctgcccaggctgagtccggagtagatgtcaatgctgtgttcttctccctcctcattctacctcattctccctacaagctgcacaacatctcgaatagatatcacaatatatttcatcagttgtttctgatctaaatttgttcagattttacattaggataataccacaatgcatgctgcaatgtataaagctttgtgtgtatatccttgcacactgtagggtaaatttctagaagtctgattgtcttaaaatgaagcacattaaaaatttgggcaggcacatccaaactgcccttcaaggaatttttttttttaaatgttctttctgttctattcttcttcctaatgattctttcgtccactggcacaagtgggtcctaccctgtttacaccaaggagctttggtgctttatccagaccacttctggttctaaggaccattgagagacttcctgaactttcagtcacttaacttgggtccctcacaagttaactgagagcaaagtactgaacacattttaatgtgcagtcagtgactgtttcaggtcttcaaactaacttggataacacactgtcagtggtgttcaagggaccctgggactagaggagaactgagaagcaggcattggccctttgttttccgtgggcccccatcttccatgaaatctgagggctcagcaaaggtggggagggagggtgggctcctctacaggtagctgggctaagaaataggagcccaggtacaggatttgcattaaaaatgagtcccattgaccttctgtggggctgacaggctgggcttggagcctggctgttttctgggttctcagcaagtgatcatctgcatagctggagagccttgggctgagctcccgctcctgtgaactctaaaacaatgtctgccaagtaggctctcttgagtaaatacttccttttttttccttaggctgacccaaaatgaactcaacgatgaagtggcagagagtttggcagaaatgttgaaagtcaaccagacgttaaagcatttatggtaactcagagagccttacaatttcagactgtgctacttttcaaaagtattttttgagataaaatttacatactgtaaaattcactctcttaaagtatacaattcagaggtttttagtgcaaccatcaccacctaattctagaacattttcactcctcctccccactccaaaaagccctggtatccattaagcagtcactccctgtcctcctccccagaccctggcaaccactaatccgctttctgtctctatggatttgcctactctgggcatttcatataaatggaatcaagcaatatgtgaccttttgtctctgtgttctagcatgtttcattcctttttatggctaaatgataattcactctaaggaaattttgcagtttattaatcagttgatgggacatttgggttgtttctactttttgactattatgcgtaatgctactgtgaacactcctgttcatgcttttgggtgaacatatgttttcatctcttttgggaatatacctgggaatagaatttctgggtcatatggcaattctgtaactttttgaggagccaccaaactgttttctaaagtggatgtactattttacattctcgccagcaatgtatgtggattccaatttctccacatcctcaccaacacttattattgtccatcttttaaaatctagttatactagtggatgtgaagtaatattgtggttttgatttgcatttccctgatgacaacaatgttgaatgtctttttatgtgcctactgggagtctgtatagcttctttggagaaatgtctccatatcctttgcccattttaaaattgggtttgtcttctaatgctgagttataggggttctctatatattctgggtgctagacctttactagatacaggttttgcaagtattttctttctttctgtggagtttttcctctttcttgatagtgacctttaaaggacaacagtttttaatttttgttttttttgagatggagtcttgctcttgtcacccagacaggagtgcagtggcatgatctcagctctctgcaacctccacctcctgggttcaagcgattcttctgcctcagcctcctgagtagttgggattacaggcatcagccaccatgcctgtctcattttgtatttttaatagagatggggtttcaccatttaggcccaggctggtcttgaactcctgacctcaggtgatccacctgcctcagcctcccaaagtgctgggattacaggcgaaaagccactgcacctggccaatagtttttaattttgatgaagtccaatttatctatttttttctttggttgcttgtgctttcagtgtcttatctaagaaatgattgcctaatccaagatcacaaagaactccacctaagttttctgttaagcgttatagttgtttcccctcacatataggtctgcaatccattttgagttaatttttgtatagtgtaaagtgagggttaacctcattctcttgcacgtggatatccagctgtcccggcagcaccacgtgttgaacagattatcttttcctattgaatggccttgacacccttgtcaaaaatcaattgaccataaatgtatgggtttatttctgaattctctgttctggtccattgatttatatgtctctcctatgccaggaccattgctgtagctttgtgtagtacattttgaaatcaggaggtgtgagttctactttgttcttctttctcaagattgtttagaccattctgggttctttgcatttcttatgaattcagactcaccttgtcaatttctgcaaaaagactagactctgctacatattgttttttctttcctttttagcctgcagaattatttgatcccattccctaagtgcaggccagcctctccagggagagcagagctaggacagggtcagaaagagagtcttggctgctttgtgcattcccaacctgcactggccctagtgaaggcagcccgagtgggtggatgtgcctggacactgcaggctttttaggggcattaggtgctctccttcctggcctcctgccacatcttggttggaggctgccttccctgccttcaaaaaagcctaagtggtgactagaaaacagcagagtgtaactgaatacagaacttggtgcccacttcctggttctatttttgtcccttttgaaagggaaggtcattacctctgccattgaacccaggggccctagcccttgtggggtatggctgggagcaccagatcctggctgcagcccagccaccagtggtcctgtgtgcttgggcagtaacagtgacaagagctcccttccccctggacactgtgcctaataccctcctcttgaaatctcacacacccagtggatggggggcactcttatagttattctcagtttacagatgacacaactgaggcacagacagatgcgtttatttcttcaaggttctgtagctgaacagtggggagggagggtttaagaggagctgcacccgctctgcaatactgcctctcacgagggagtcctcttcattcatgacagcatagggccctcgtcttcctggtaagggcttccttcttgggtcagtgccaggatttctaagggtcatgtttagcaggagcctattctacaaacagccaggagcagggaatgactctgtgatgaagcggagacactacagcctcttgatgcatttatttcctggttgggttagaagcgtagctgcccaagggagcatttcaggagaggcctggcttcctagcgatagctgaaaactttgtttcatttgaatcactgctacccagaacaatggggtgcattctcagagtccccattattaaagcttttccactgagccccatgagaactattcatgagaactatttcatggcagcataactgtttctcctccctccctcttgcatgttggtagcctcttaactttaaaacctgccttgcctttccctagctacctggaaggagacgtcagacttcctgtcccatggtgtgtttcttacaatttgttgttcagattggtggtctcccaaatatatataaaaatataaatggagtctcactctgtcacccaggctggagtgcagtggcacgatcttggctcactgcaacctccacctcccagttcaagcaattctcctacctcagtctcccgagtagctgggagtacaggtgcacaccaccatgcccagctaatttttttgtatttttaatagagacaggttggccaggatggtatcgatctcctgagctcgtgatccacccacctcggcctcccaaagtgctgggattacaggtgtgagccactgcacccggccccaaatattttgattatgcacctctgcagtgaaaaatgcaaacacacacatcagttcatgtattacattatgttcactataaaaacaaacagaaaatttaaaaaatatcaagctatcctttactctagtggatcttacctggacacttttagccagatacaaagtcacatggactcagttcttcccctgaccaacttgtctcttatcccaaaacacccttgcaactcccttacgaaggggtcaaatttgatccagtattatggattttatacaagttatgttcttctttcaggcttatccagaatcagatcacagctaaggggactgcccagctggcagatgcgttacagagcaacactggcataacagagatttggtaagatcccagcgtttgtcacagtaataacaccagtgactgtttactcaccaccactgactgtgcaaggcacaacgcagggtggtttctgtttattcctccagcaaccctgcacagtaatggtattacctctgttttacagaggtagacagaggcccagaccagtgaaataaggttgcccaaggtcactacgagagaagctagaattcagcccagaatgcctgattccatattctgtgctctcctgccctgggcccccgccctcatctaccttcattgggtgggatgggggaagtggccagtgaaatgatttcctagtggaagtaaatccccctgggactcagcaattgagagatgactgtgttggccaggagtttggagctcattcttccccttttctgggttccgtaagacatttccaggctgacttgaactgacctgtgctctttgtctacttcttttttctgctttgagaacttccttatgctaatagaagaaaaaaagtttgctttactgtgacattgagcgccatgccacttctttcttgcctcccataaggcacagacactccccactcagcagctcccttaacaacttaattgcctgggtgacgtgggactgggtggatgctgggagaggggccttattaactatgtcctcctttcatgactggggagaatttcatagccaattaaaaaaaaacaaaaaacagctccttggccaacacaggctcctcatacagtgttttttaaactttgctttagaacttgtttggaacttgtcataaaatcgatcagtttggtgaattgcaaccaacaatatttaaaaagaaaacagaacagaacaaaatatcaggatgcaatgtgcatggtatgaaagtatcatttcattcatcttagttcatgcttgcatgtgagtgggtgtgtgtttgcataagtgttggttcacaacataaaatgtaattcttatttagggttgtagacaaaaggtttttttttaaaaaaaacactgttggctaggcatggtggctcatgcctgtaataccagcactttgggaggccaagatgggcagatctcttgagcacaggagtttgagaccagcctgggcaacatgcgaaaccccgtcactacaaaaattagcccgacatggtgctatgtgcctgtagtcccagctactcaggaagctgatgtgggaggatggatgcatgggagatcaaggctgcagtgagccaggatcatgccactgcaatccagcctgggtgccagagaccctgtctcaaaaaacaaaaaagaaaaaaagaaaaacaccatcatagagaatagagcccagatctaaacagacacctgtggcctgtgtgcctgcgaagcccagcctgcccagcagcctgggaagcactggagggcactggaactgtttgcatgggtgtttgccctcaggccactccgtttctgctgattcttaagttttgaggacagcaggcagagggggagaggaaggagactgccagactacagaacagtttgcagagcacagttggcttccacttttctctgtagctggtcaggcgggtagtaaagacctacagttgctttaattctgtcaagtttcaaaatctgcattgcttccctcttgagggtcaccattcctacacaaggaaccattttagtagggccaggagacttcagcttcaaggcctgcacttgtgtcagggtggagaggggaactggccaccaattcagagagggcaggacaggcggcatgggtgctggtcttgggagtgtcttcacttaggtccctggcttgttctgggagcctccagagcatgctcctctgtgtgtgacttcatgggactgggctctgagaaggctgtggctttgttggccctgccagggactgccacaccaggccacagggttgtggttgagctggccggggagccacgttcagggagcagctctgcttggagccaacacttacagagtaagccttctccttggacttgttaactgtactgacacttatttctacctcattcctttctgaaaataacttggaagtctgaagtcccttgatgagttctgtctttaagaacagaaattagaggtgaacaatgaacactgtaaattacagaaatgtatcccactccagtataacagctttctgtgaggctatctcctccagactgtggctctgggagggtggggcctgagtcaaggtcctagggactagtgctgtgtcttcatttattccttgaataacgaaacgcttgagcatcagggactgtgctagcaccaaaaatccagtggtgaacaacatggcttcatgggttcactgtctagaaagggagaagcacattaaagaaaaaatcatttgcgtaattatttaattacaactgtgatgggtactatcacaaaggggaaggccaagagggaacctgatttagatgaggttgcagggaaggcctctctgaggaagcagcacttacactaagccatgaaggatgaataggagctagtcagctgaggtgagtattctgcgtagggaacagcatgtgcaaagggtctggggcaggagggagtgtggtgtcctggaagaactgccagaagctgctgtgccccagggttcagacagtgtggaagaggggactacaggaggctgaggagataggcagggactggaccataaaagatctgtgggtcatgatgtgcattttggtctttatcctaaaagtgatggaaagtcagtgaacagtttgaagcaggagaggcatgtgatcagatctgcaatgcaaaaagaccaattcttggctcttctaggaaactgaattggagaaggccagagtacgtggaaatgacctgtcagtaggacattgtactgatgcagggaagagatgatgggtgctcagaccaagatggccggccaaagacatagaggttccagggaggcattctagattcttaggaattaggggagaactttgtgatacaaggaacatggggatgagaaggaaggtgtccaggttgacccccaggttactaacctgctcagcaggatgagagtggtccattcactaagccaggggaccctaggaggtgtggctactttgaggtgtgggggagaggtccaagtgaggatgccaagcaggtaactgcctccacggacatacaaacaaggccgtggcattgatgagatcgggtggggaaaagggcttagccccaaacctggaggaaatctcagatgtagaggtcacatggaggagaatataggaaaggaaattgaagtagagtgctcagatgcaggagaaaaatcagcgcatataaccaagccaaggggagggagtgcctcaagaaggagggagaggagaggtcaggacagccaaaatcctgagggccaagaaagacaagacctggaaaatgtcattaaattcaggcttatggaggctacaggtgaccttagtgagacccagtgaacagagggatggcagctggagaggatccatgctaatatgaaggaactatctgcaaagggtatgttccttaatttcagggatacatgtgtattgtgtgatacacgagtgtgtgctatgaacacaccttgggaaggagtgtgcgaggatccttaacattttacctgtgtacttttgtcttcctccttttcaacagcctaaatggaaacctgataaaaccagaggaggccaaagtctatgaagatgagaagcggattatctgtttctgagaggatgctttcctgttcatggggtttttgccctggagcctcagcagcaaatgccactctgggcagtcttttgtgtcagtgtcttaaaggggcctgcgcaggcgggactatcaggagtccactgcctccatgatgcaagccagcttcctgtgcagaaggtctggtcggcaaactccctaagtacccgctacaattctgcagaaaaagaatgtgtcttgcgagctgttgtagttacagtaaatacactgtgaagagactttattgcctattataattatttttatctgaagctagaggaataaagctgtgagcaaacagaggaggccagcctcacctcattccaacacctgccatagggaccaacgggagcgagttggtcaccgctcttttcattgaagagttgaggatgtggcacaaagttggtgccaagcttcttgaataaaacgtgtttgatggattagtattatacctgaaatattttcttccttctcagcactttcccatgtattgatactggtcccacttcacagctggagacaccggagtatgtgcagtgtgggatttgactcctccaaggttttgtggaaagttaatgtcaaggaaaggatgcaccacgggcttttaattttaatcctggagtctcactgtctgctggcaaagatagagaatgccctcagctcttagctggtctaagaatgacgatgccttcaaaatgctgcttccactcagggcttctcctctgctaggctaccctcctctagaaggctgagtaccatgggctacagtgtctggccttgggaagaagtgattctgtccctccaaagaaatagggcatggcttgcccctgtggccctggcatccaaatggctgcttttgtctcccttacctcgtgaagaggggaagtctcttcctgcctcccaagcagctgaagggtgactaaacgggcgccaagactcaggggatcggctgggaactgggccagcagagcatgttggacaccccccaccatggtgggcttgtggtggctgctccatgagggtgggggtgatactactagatcacttgtcctcttgccagctcatttgttaataaaatactgaaaacactcttacgggttgagtctggagtttttgaagggacttggcttggtaagcactcattgactcctgagccccatcctgattcactccacagtggggaaggggctctggggtgatgtgctatgaggagagcctgatgaaggccaggggtgtcaccagtttgatccttcacaggcctctctgcctaccaagggacaggaagcggctgtggcagcctctgaggtctctccatctggcctctgaatctcttcaggtggcttctcagaggaaataacttgtgagtagggggtggctggtgccaggacaggccaagtgggccaaagttcatgccttcatcaccatgccatggtagagcccacgggccaggttcgacgtccactaccttcctcggctgttcactgctgagtggcggatccaggtaggcccatggcaagaagcaccgagctgccaggggcagcacgtgacagaggaaggcatgcagggcctccaacggtccacctctgagttcttatgagtccaagcctggctttgtagagcagcctgttaggaaggggaccgttgcgggggaaatcctgtacagttaagcaactacaaggcggcagttccttaaaggctcgattttggtggttcctacgaggtccctcccaaccccagacctgagtattcacctaataatcaccccaaggcagccactctctccttactgcagaatctgggcagcaaatatgcccagaaagaagaaagaagggaatgagcatggcccactgaaggccaaagggggagtaccacagacctcagactcgccaagtcttaccacaaagttcacttctcagcagacaaaattcacattttattaaactgctaaaactaaacccttgagagtctaaaatttactcagaaactaccaaatgttattgcttttagagactatcaaaattaaaactgctgcttctagggaattagaatttgtgtggtattgacttaaattctatttggaaatactttgatcttccagatggcaagtggtagattttctattcctcctgtaaaactgagaccaggctcctaatttgatggaaaggttctcttattagaaacaggtgagcttctgagcagaaacatggagacttttcctaatcaagaaaaagacaattgaaaaaaaaaattctgtaaacgagggctatatctctttctttccacaggacatcttgattgattttgggaaagaagctacagctcccatatttcacacctgcacttgtgtcatgtccatgctgacatggaacttctttaaaaagccatgtggagccactgtgtggccatgtggtattagctctctggagcgccctagctgtgtggctttggagcactcttaagacggccagaatcttgatttcctccttggaaaaactgagagaatctgactcaaaaggttgttgagaggattaaatgagtcatggaaagtagctggcacaaagcctggcacagagtcctgctcaacgtatggcagttagttactatcaagccagcgggtctcatttccgctcaccgtgggactcccaagttgtccccttctcactcataggctcagggaactttccaacaaggtccaatacaggactaggagttctcaaagtaaaaccccaaagtattcaacatcaagcttcctgcaatatcctacctttgtcagtgaaaagcatagctgttagttttcattattattaccaaagaccatactgccatttaagtgtcaagtcactgaacatagggggcacctgtgtcttcacagcacaaaagaacagggcaggagctggcaccaccctatggagccaggcccatgagcctttgccaagcgggaaagcgctttctgctcatccatattttggttcacttccaggtggaccacaggtctgtttccagtaaccaactgcttacttacaagaaaaaaaccttgctctagagctgaaaggcaaaaccatgaccattaacccaggatcatgaagaagaattttaatgaaagtagaatggcattatgaggaggctgagact

SEQ ID NO: 811 - DNA, 13617 bp, Human
tattaagcaactactgtatcagcaaataccaatgattctcaaactttgtgacaaaaatcatctggaggatattttaaaacagatcactgggtcctaccaccagaagctgctgattcagtacatctggggtgaaacccaagaatctgcatttctaacaagttcccaggtaatactgatgctgatgttcagaacaaaccacacaaccacaatttgaagagcagtggcttaaagagactttgcaaggtaaattctgtgatctcatagtgtgatatctagtgttaagtagggcatagagaccagggtttttttgttttttgttttttttgagatggagtctcactctgtcacccaggctggagtgtagtggtgcaatctcggctcactgcaacctctgccttccaggttcaagcaattctctgcctcagcctcccaagtagctgggattacaggcacctgccaccacgcacggctaatttttgtatttttagtagagacggggtttcaccatcttagccaggctggtcttgaactcctgaccttgtgatccaccccacccccaccgtccccttggcctcccaaagtgctgggattacaggtgtaagccaccacgcctggctgagaccagactttttacaaaatcactgttctgtttacaccttgaattagactttaccaagtagctaactactataacttctcttttgaagtattttgtattaaacataggtctcagactttcaagttaggattttttttttttttttttttttgagatggggcgttgctcttgttgcccaggctggagtgcaatggtgcgatctcgtctctgcaacctctgcctcccaggttcaagccattctcctgcctcagcctccagagtagctgggattacaggcgtgcgctaccatgtgtgtctgattttgtatttttagtagagacgggattttgccatgatggtctagctagtctcgaactcctgacctcaggtgatctgcccgcctcagcctcccaaagtgctaggattacaggcatgaaccactgcacccggcaaatgatcatttaagcaaatgatcgaagactcaagacacaaaactacctgaagggagtggctcccacatttgtagggtaccttacagagcaatttcccttcatatgattttgcaggtggtggggaaactctccgggcagttgtggcctgtgctacatcacccattgaccagaggtgccagtactagtgctcaagatcaatcgatcgatcggtctacctacctatcatctattgaccttcagtgctactaaaaacactcggatcttctaacgtctggtccagtctttcaccccatcacagtgagaggctgtgcacaggggtaacacaggcaacggaattatatgaggcaaacacagagatccaggtttctgggagtagcaatgaggttcagccttgcagtcacaaaggcaccactaaaaggcacaagtaatggcaggtaatgaggccttacttggagcagtttagagtacttcccacgtgtggtgacgcatgccacacactcaccaccaccaccactgccacaaatgaagtgcacactccactgctcctgtcctcaggaacctggaagcccccacctggtgtccgaggtgtggctcccactttaagcgtggggcacctcctctccggcctcaaacctaccggagctcccagcaggctgcggcacatctgacggctggaaactagaacccctgggtggggactccttaaggctcctcccggaagcgtagggacctcgctgcccacacgcccctccctttcctcctctggcgtcctggggtctgaggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggtaagtgctatctggcggtcaggggaccgtccagcctgaggcactttcctaggcttgggggtggccggtcaacaggccaggtgtcagtggttcctccagaggcctcgaactctcacagccaaatttctccggtccgtgcttctggagtgcgggccgagaagcgccaagtgcgtgcgaatcccagagtctggatcacgcagcttgggaaggaggaacattctttggggtctcagcaccgccttggggcggggccaccaatctaagttgaggaaagcattggggaggctgcaggaccaaattcattgcggcccctaagttattcactgggaaaggcgctcgaggagagaaactggcagacctatcagcgcgcacccgcggggcttctgcgaccggagtcgggtagtggcttccaggctgagagcgcggctgggccgggtgacgggtgtggccgcgaccgcaagggcagctgttgcggggttctctctttctttcatatcctatttccacccgccttaacgtcctgcgccttctcccaacacctttcaggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggtgagctttagacgcctccttcctctttcgctcaccataccagacccctctggcccagctaggggctcgacgacccttgcctcgctccttgctctcaggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgtaagtgcacggcggaggtagggtggacagtgacctgctagttggaggtttcaccctcagggtaacgaagtccacgtgcgcaccgacttgcgtcttggactattccgcggggaggtccaccttgagtgcccttcaaggtggcagtagtcgccaccgagttagcccttacccggaacctcttacaccgagcggaaggcccccaaccagggcagcgccaaggggtgcttgagcctccccacatttccacgaaccctcctgaaataagtgtaatatctgatttttcggtgtgcaaacctacccttcccatcccgtcagagtcgattgcagcctccaagtccctcagataaaaaataattctggagcctcctctgtcgccaacttctgcccggagcggccggcctgagcaccgaaggccggggactcaccgtccgttccccgcaggatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggagtgagcgcagccagtggggatggggcggcgccggcgccgggggcgagggctgcctgggggccgggggagcgtgctttcctcggtgccgggtcaccagcacagcgaggggaggctcccgggccccgccgattccctcccccgctgcccgcagggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccgggtacgtgctcccttcggcgctcagcgttggggtcccaatcctctccccaggggcgctcacgcaccggctctccgtccgtcccttggggtccccctatcccctgcgctgggctgggctggcctgggctgggctgggggcccctgcccttatccaggccccctgggcgggagccctctcccagtggcagtgcccctggacagctggagggcgcttcctggaacacgccgctggccccacaggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcaggtgagggcgcgggccgcggggagaggcgggcgtgctccccgtgtggctgccaaccttcctgctgtcgctctgcaggtggtgggggcggctggacgtcgcgggctccctctccgcaggccggccgctcactgcaggagggggcggagggcggccagggctgctccgaggcttgggcgacccttggctgggccgcggccggcggcttcgggggcggcggcggggcctgcactgcgggcggaggcggcggcggctacaggggtaggtgcaccgttggagagggcagctgagcaggcccgagggtgaggtgatgttagaacctaagtacaggccggagccctcgggaggataggtgtgggagaggcattaagccctgctcagcagctccaaacaaaaagcaggagctcttagaaaaggaggtcaaatacactgcaaatcagcatgcagacaggactccctagatttccgtttaatccaggatctttcccatcacagcaggtccctgccttgttctgcagcagtcttcagaacttagagctggccgagtgagcaagctgagcaaaggggcagaaaggcaggattgggttaagtcagtggttctcaaagtgtggtccaggaacaggtaatatccccacaacctaagttgttcgaaatgcacattatcagctgggcctggtggctcacgcctgtaattctagcactctgggaggccaaggcaggtggatcacctgaggtcaccagttcgagaccagtctggccaacctgtgaaaccctgtctgtactaaaaatacaaaaattagccgggcgtggtggcgggagcctgtaatcccagctactctggaggctgaggcaggagaattgcttgaacctgggaggcggaggttgcagtgagccgagatcactccattgcacttcagcctgggcgacgagggaaattctgtctcaaagattaaaaaaaaaacaatggaaattatcctgggagttgggggaaggttggggagatgctggtcaaaacaatgcaaaatggcagttaaataggaggaataccttccagaatctactgtactacatggtgactgtagttaatgacgatgtattcttgaaaattgctaagagaggcggggcgcggtggctcacgcctgtaatctcaacactttgggcggcggaggcgggtggatcttgaggtcaggagtttgaggccagcctggccaatatggtgaaacccccatctgtactaaaaatacaaaaattagccgggcgtggtggcatatgcctgtagtcccagctactcgggaagctgagacaggaaaatcgcttgaacccgggaggcggaggttgcagtgagccaagatcgtgccactgcactccagcctgggtgacagagcaagactctgtctcaaaaaaaaagaaaagaaaattggtaagagcgtagattataggtgttcttaccacagaaaataagcatgtgaggtggtgtatatattggtttgcattagccattgcacagtgtgtacatatttcaaaacatcatgctgtatacaataaatatatgaattttttttttagatggagtctggctctgttgcccaggctggagtgcagtagtacaaatctcagctcactgcaacctccgcctcccgggttcaagcaattctcctgcctcagcctcctgagtagctgggattataggcatgcgccaccatgcccggctaatttttgtatttttagtagagatggggtttcaccatgttggtcaggctagtctcggactcctgacctcgtaatccgcccatgtcggcctcccaaagtgctgggattacaggcgtgagccaccacacctggccctgaatttttatttttaattaaaaattaatttttaaaaagaaatgcgaattctcagcccttctctaacatactgaatcagaaactgtaagggagagtcccagtcatctgtgttttgatcaaataactagtgtaaatgcctttgtgcctgtctgggctgtactgctcatacatacacacatgatctacattctcacagaaagggactgtgaggacatgggacaggaggggctcaggcaggcaggaggcatcccagccagcctcagcgaggccttcaggctccagctgattaccccctcctcacctccttcactcccacttgtgaacagacagcatttgcatcatgatgctggagaagagagggccacactgggatttccaccgggagattccagcttctcccccatcccccatttttgtagtcaaactctccatcactctccacttccagggggcgacgcttcagagactgacaacctctgggctgatggggaagatggagtatccttcatacaccccagcagcgagctcttcctgcagcctctggcaggtattggccccaaccccacctctgagcctggcctggacttcttccgcagtccctgagcccactcctgcactgcactgaagagccacctgcactgtgaataaccttgcatagcacaggattcttgcatagcatagggtcatttgaaaaatgggctgtcatcatgccattgcactccagcctgggcgacaagagcaaaactctgtcttaaaaaaaaggaaagtgggctgccagtcgtgctggatggcaatgcagggcatgctgcgtgcttttcaagtacccccttgctatgaattcgcttcaaatacctgggagtgtgcaggcttgacagaagtcccccagcttctctcaccacccttgtaagcttggtgctgctctttgctctaaagtcctgggctagaattaaccatgtggctggaaaaggcatgtatttatttatttatttatttatttatttatttatttatttttatttttgagacagagtctcgctctgtcacccaggctggagtgcagtggtgcgatcttgggtcactgcaacctccgcctcccgggttcaagtgattctgcagcctcagtcgctggagtagctgggattgcaggcgtgcgccaccacacccggctaattttgtatttttagtagaggcggggttggccaggctggtcttgaacttctgacctccggtgatccgctcaccacggcctcccaaagtgcaatgattataggcgtgtgccactgtacccagccaaaggcatgtatttactatatcccagccctaccacaccatatcatatcagttcttttactcacagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatgggtatgtcctacctttgcccaaggtctggactcctggggtcacagactgggaggagcagtaggccactgggaaagatggtatagagatttgctgtgtgccaggccctgtggtgggtgctgggcaggggattggagattcatcggtgcacagtgcctttcagaggcctgtcgtccagtgtgggaggatgtttagatatagctatgtaaatgtatatctcaagtgacgattgttgtgggaggtataaagtgctttaggggtgttcaagagggagaggttgcttttgcccaggataatgggggaaggcatcatggaaaaattaacacttgagctgagtcttgaagcgtgggtaaaacttgagggtaaaggaacagagaagaccttcccactggaggtgtctctctttctccctagacctgcacaagcccccaggccctctggttctgatggtggctgtggtggcaacctcaacactgagcctccttatggtgtgtggggtcctgattctgggtacgaagcgtctagcaggcacagttgattcaaggctgctcctctccagtgagctgggatgggtttctgcggggtcccggggctgacttcaagaccactcaccgcagcagagccgtggtagactcctctgggattctaagataggaaggagctggggaggcctggggaaaacgtttaccttaatgagcatctggaggggtgtcctgggcaggtgggggagggagagttgatgggcaggtggagggtgtgccgttattcttcccacccccagtgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcaggtaagtcttctgcctccttctgagaacctatgcactctgaatccccacctctgattctctccctgctgtagtgaattataagtcccagaaaaaatctggcccacatcccttgtgtaagggagagggaggccctgagaagctccagaaggggaagtaacttgctcaatgtcacctctccgtcccagttcttagaatatgatctctcagctgggcgtggtggctcacacctgtaatcccagaactttgggaggtcgaggcaggcaggtcacctgaggtcgggagttcgagaccagcctgaccaacatggagaaaccccatctctactaaaaatacaaaattagctgggcatggtggcgcatgcctgtaatcccagctacgtgggaggctgaggcagaagaatcacttgaacctgggaggcggaggttgtggtgagccgagattgcgccattgcactccagccagggcgacagagtgagactctgtctcaataaaaaaagaatatgatctggcgcctgtaatctcagcactttgggaggccaaggcaggtggatcacctgaggtcaggggttcgagaccagcctggccaacatggtgaaaccctgtgtctactaaaaacacaaaaaatagctgggcgttgtggcgcttgcctgtagtcccagctactcgggagactgaggcaggagaatcacttgaacccgagaggcagaggttgcagtgagccgagatcgcgctattgcactccagcctgcatgacagagtgagacttcgtttaaaaaagaaaaaaaatcatgactcttggagcccagggattgcctcccgcccagggcgtctgcagggaccagggaagtcctcatcatgcactcccaccttgactctggcccgcatctgccctcttttttgccctggctctatgccagtgagcaccacccttgcagggcttctacctggggacatgccatggtatggagagagtctatatagggtcagctgggcatatggcaggggcaggggaggtaaagggggtactagactctctaggactcttctccaggccgcctgcccactcccttccaacgtgtcttcctgcagagccctgggccatggtgcctttggggaggtgtatgagggactggtaattggccttcctggggactccagtcccctgcaggtagctatcaaggtgagaggagtgggacttctggctgggggtaggagagcggaacaccctgaagggaaggacaatgactagagctagggttaaccccctctcctgaagcgtgcagggcagctcagaaactgtgcccttttcctccccagaccctgccagaactctgctcgcctcaggatgagctggatttcctcatggaggccctcatcatcaggtgcacctgggaccaggggcagggctggaaggcgggaggggaatgcccgggaacagtttctcttcaccctgaggctgaggtagcaagtcaggggacacagagggcctctccagctttgtggagcctaaaacatggtttccgtctccctcctggtaacgggatatgtcccccaccccactcagcaagtttcgccatcagaacattgtgcggtgtgtggggctcagcctcagggccacccctcgcctcattctgctggaactgatgtctggaggggacatgaagagtttcctgaggcacagtcggccacacctggtgagacccttgtcttagccccccccaggcccctctaaagaccctgtccatgtgtctgagacctacatggactgatgccccctctgcctgacccagggccagccatcacctctggtcatgcgggacctgctgcaactggcccaggacatagcccagggctgccactacctggaggaaaatcacttcatccacaggttaggagcagtcctggctcaggggacccccatcccaactccctccccaaggaacagcccttccacacagcttttaaggaaatagatcaggaagagcaagaacttctagattctggcagtgattttttttgcctactctgtagggatattgccgcccggaactgcctgctgagctgcgctggacccagccgagtggccaagattggggactttgggatggcacgagatatctaccggtgcgggacttgggaggtgggaaggctcttgctccaagggggttttccccgcaccttggtggtgaacaactcatcattcacctcctccctcctgtagggccagttattaccgcaggggggaccgggccttgctcccagtcaagtggatgcccccagaggccttcctggagggcatcttcacatccaagacagattcctggtgataacacccttcccctccccttccccactgttcccctcccctgaggctaatcctgtcctttccagcaacctcatgtgaggggaggctacacctgacgggcctcacttggttcccccacttgtgatgcaggtcttttggggtgctgctctgggagatcttctcactgggctacatgccctatcctgggcgcaccaaccaggaggtgctggacttcgtcgttggaggaggccggatggaccctcctaggggctgcccagggcctgtgtgagttgagtgctgcccgggaagggaggtccttcacaaccatgggtgggcatgaactcctgcctctccccaggtaccgcatcatgacccagtgttggcagcacgagcctgagctccgccctagctttgccagcatcttggagcgtctgcagtactgcactcaggtgtgcccccgacctaatctaacatcctggtcttgtgggtcaggagggagggccagaaaactctatgcccccctgctccctgactcttccattacaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcatccttcatctgggcagaccccccaccctgcagatgcttctaataaaaagctcttctcatcctccagcgatctgtggatgccagggaccggaactgaggaagagggggccggaggagggaggggctgaggcctgaggcacaggaagctgcatcttgtctttgagttttattaggaaggggagtccgtcgtggtgtgagacgttagaccggaaggtctgggcttgctaaataaaatccgcggtctggcacctctggagagggcagagcctcctcagaagagctggcctgaggaagaagccctttgccccctccccttctataagttagtgtcatttggctctgggaacgctggggcccgggtgggcaaaacccctggcatcggcggtgcccccccttagtggctggcacctggtcctgcaggacccggtgaactgccctgcaccgcggggctccagtctcaagccggcatgcacagtggggacaaagctgcaggtccacatgtcaggtgagcggcccgcggggacaggagtccagcctcatctctcagccaggctggccaggatgccaatgagattgtccagccccagcaaatagccgtcctcgcggttgccctcctcccagggccgccggtggtccaggatctggccatcggggaggggcgtggtcttgccgaagtcgatgagccacacgccggcgcgatggcagtgatcgtgcacaaagaggagcgagctgccgatcacctgcgagccccgcaccgtcaggccgcggccctgcccagagacgcccttgccgggttcccgccctagccctcgcggcccgggcacccgggcagccgccgcttacctcgtgcctcctgaagaactcggatacctccagggtgtcccggatctgctgcaggcggttcagataccgcctctgcagagggtggggtgggagaggagggcaaattaactaaacgccaaatgagcccctgctaacgatgaggagccgggacccacgctgtgcttggcaaatgccgccaggaggaggacccagggccccgcccagcgtggcccagaagggaaggagcgtagagcagttgcgagccagcgcggtgagggccatggtggggacacagccgagggcactgggccagatgacaggggcagtcctcggcttcaggctccccaacacctcagggtttgggatcccgctctcaccagcacttcctcatctccttgcacaaactcttcaaagacgcgaagcacctgctctcggcttcgcgtagtcttgaagtcggtgctgcaggagccgtccgctttctggatgtgggacaggagtgtcaggggccccgggcccgccagtggggaagaggacagcgtagagcagcggtacctcccagttgcaggggacggcgaggcggtgggagagggcggaggggcaggcggggcgggagcgggggatcgggaaagacagcgcgcagtggggctgcggcggtgccagcgaagcgcgcctgcctcaccttgatgccctcgatgcggaagccgagggtggtgctggagctgatgccttcccgccactgcatgtagcgcggcttggtgacggcgcgctgcgcgtgctcctcctccgt

SEQ ID NO: 812 - DNA, 16039 bp, Human
  misc_feature (1)...(16039): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagctctcttcctggcctcttgcgtctcccttaaaggaggtaggattgagcacaagctcgtttccagtgcctaacctggtatctcctcaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaaggtgcttttcctcccttgacttagaacatggctctgaagtcccttccagccaggaactctagtctagagcttttctgtctattaccatagctcaccatgtctgccagcctccctggccggagaactagttgcccaaacagggcaggactttggagaatgttagataaaaatagcccaagttgtttgagatttaaaagggaactggagttgtttatcctacagaagagaggtcttggggtgggttggggcagctgagtcaccaggtccaggcctgtgaacttgttttttcagggagggttcagggagaggaagcgaatccatgaacactcagcatagggcagcaagcagtaggcagaatttgggtgaacgccccgcttctttaggggtgaacacccaggggtcatccctttgaaatgggaagtgctactaaagagaagttatggatccctctctggagaggtaagaggaaaggataagcccccaactcagtgggatttttcatcccaccagttgggattgagaaagttttgtgtgcatggagacctcgctctgtaggattcagagttagagccgatggtctaggaggtcattggcttccaaatgcctgcccacaggccactgctcagctggtgcagaaacgtttcccagcaagtgtgtttaaaatatctatttccagggcccagcctcagaaattcagaccaactgtgtcttgaatgggcccagggcatctgtatttttttttttttaacattttgttcttctttgtattttgatttgagcaaggcaattataaaaagacatttttgaggaaatcaccatatttgtatatgaaatggtttttagggcatattactaggtatttgtttgttacatgtgataacagcatggtagttatatttacaaaggtgtgatatgtgagagatacatacttacgtaattaggaattaagtaatacagtgcttgggatttttctttaaaatgctaaagtaaatttcatggggggatattgatgaccctcccctgccaccaattacttcaaaattggcctagtgtttgcaattactaaagctgggactttggaaatcattatattctcttctacttttctgtctattggaaatttctacataaaaatataatcaatgcaatttatcacattaaccatttaaaaaagaaaacaacatttaaaaagaaactaagcaaagttaaagtagaaagaaaatgtcctaacctgtagaaaggtatctatctacacatatctaccataaatattatgcttaacagtaaagtgttgggctgggctcggtggctcacggctgtaatcccagcactttgggaggccaaggtgggtggatcacctgaggtcaggagtttgagaccagcctggctgacaaggtgaaaccccatctcttctaaaaatacaaaaattagccgggcgtggtggcgtgcacctgtagtctcagctactcagggaggctgaggcaggagaatcacttgaactcaggaggcagaggttgcagtgagccaagatcaagccattgcactccagtctgggtgacagagcgagactctgtctcaaaaaaacaaacaaataaacaaaaaacagtaaagtgttgaaaacgttttataaaaaagtttttcttttaattgacaagtaataattctacatgtttatgaggtacagtgttatgtatacataatacatgtataccttgtggaatgatcaaatcaaggtaattagaatatctatcacctcaaatatttagcatttctttgtgccaaaaacatttaaaatattatctttcagctattttgaaatatacagtccattattattactacagtcaccttgccgtgcaataggcaccagaacttattcctcctgtctcactgtaacttggtacccctctccttgttccctatccacttctcccacctgcctccttccagcttctggtaaccacttctactctctacttctatgaattgaattctaaaagaattctacttagattctatacataagtgagatcttatggcatttatctctttgcacctggcttatttcgctcatgatgtcctctaggtccatctgtgttgtcccaaatgagagtttccttttttttcaatttgagacaaagtcttgctctgtcacccaggctgcagtgcaatgtcttgatctcatctcacttcaacctccgcctcccgagttcaagagattctcttgcttcagcctccttagtagctgggattacaggcacgtgccaccatgcccggctaatttttgtatttttaatagagatggggtttcaccatgttggccaggctggtctcggactcctgacctcaaatgatccacccgcctaagcctcccaaagtgctaggattacaggcgtgagccactgggccgggcctcagtttcctatttttcaaggctgaataggattctgttgtatatacataccacatttaaaaaacccattcatccattggtgggcatttccatatcttggctgttatgaataatactgcaatgaacgggggatacaggtatctcttcaatacactaatttcaatatctttcgatatatacccagtagtgggaattgctggatcacatggtagctctatttttagattttcgaggaacatccatactgttttccataatggctgagaaattcaccaccagcgacatgcaagggtttcccttttcaccacatccttgccaatgcttgttacttccatcttttggataatagccaatctaacaggtgtggagtggtatctcattgtggttttaatttgcatttctctgatgattagagatgttgaccattttttcatgtatctgttggtcatttgtatgtcttcttttaactgtctattcaagtcctttacccattttaaaaacaggtttatttgttttcttgttattaagtagtatgagttccttgtatattttggatatgaaccccttattcaatgaacatttgtaaatattttccacccattcatagattgtgtcttcactctagtggttgtttcttttgctgtgcagaagctctttagtgtgatgcaatcccatttgtctatttttgcttttgttgcctgtgctttagggatcgtatccaagaaatctttgcccagaccaaagtcttagaactttgccccaggttttcttctggtggtttttatagtttcaggtgttacatttgtctttaatccattttgtgttgattgttgcgtaagaggtgagacaaagatctattttcattgttctgtttgtgaatatccagttttcccaacaccatttgttgaagagactgttcttttcccattgtgtgttcttggcccctttgttgaaaatcaattgtgggtttatttctgggctgtccatcatattccattggttgatgcatctgattttagggtatatgtatttttaatgtgctccccaagaagtccttacattctgctgcattgacaaacccgtggccaagttttaggcctaggttctaattaagcttaattctggaggcaaagtctcggcggggacacccaggccctcctcagccctcaagtctcatggtattcccccccaccccaactccatttagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacggtatggggttccccaaggccccagggccagaactcccttggcttccctgtcccctgggctggaagcacccttgtgtgccattgggaactttgcttatggactaaagggagggtctgggatggtgggtgggcagaggagggagtagaaaccacctcagccctcagagctatgctcttgtgagatgctcctcaaaggaattgcctactagggcaattgggcaccccagagcccttgtagatgaagcaataaggctctgagaggctgtgtaacctaccagagggcgcccctgttatgggagagctggcatctgcaaaatccaccctctctcctctccaccactgttgattccagccccttctgggaagatcttcagcatctataaaacaccgctttttcttttaaaatacaaaataaaattgtggtcattacagagatcatgtgctgcattggtaattgtggggtttgtcatcttagacaaaggatactgaagggggttggctgaaatcacctctaaaggcccaccagctctcagtgtccgtgtgccatgaaataaaaggattttgttaattgctatcatttttgtttcagttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtgtgagtcagctgggctgctctcagcatggggagggagactgggagggcctggtgcaatccaaaacgcgtgcacctgggatgctggtgccagccactgtgttaggtgctgcttcacatagctctgcatccttaataggagagaggtcctactgtcctcattttagagatgagggaactgaggctcagtattagcaacttcctagggttgcacagctaggacttggtggcagaaccaggtctcttggatctagggtcctcccactggagcacagcggtgtttcccaacaacatccccctcccccggggccatcttcagtgagctgtgctagttcctgttgttacagtcttctgctgttcttcctcagagccagggatacaaagggcttctccttacttcccctactctgctctgctcctcgccagagctgctaaagtcagcaaatactgctccaggctgtcagtcaggtgccggggctgtagggggagggagataatagaggacatggaggccacggtcttgcctaggaggatcttgcatcctggctggggagatagagtgtgcacagaggagactgtaacaagcaactcttattggacagcagatgagatgtccagtgcccaatgaaacatgccaacagtaagtgctctgggagggcccagtccagtgtgggcagagtctggcaaaggtgaaagtgactcctgctagatctgcaacaaatttcagtttgtgaaggacactcaacagctcagtgtcatttaagtctcaatgcagaggaaggcactaagtgggtatcaggcagtcttaagagtttttcatacattcattcactgatacatgaaatagttccaaatctcagctttacaacttttgaggtatatgactttgggcaaattacttaacttctatgtgcttcaggatcctaatatgtaaaaatggggctgatgatagtatttacctcctataagtataaaagttaaaagaatctgatggtattggtacatggtcagtgctgtgtacttcacaactaccttatgaggtcagtggctctgacagagtaattaatttgtccacaattgcacagctagtaagtggtgaagctgggacttgaacccagatctagcagcccccggagcctcgattcttacctgctgtaccatcctgcctcactgttctgtttgctgtgatgggagtcatgtgcagagagctggaagcagttagcgcatctcctgagggaatccttcagggcatggtttggaaggccaggtagggattcgcagaaacctagacacatctagagttgtggcctgtagtttgccttgggccactcactgaatggttcctgacagtgggcaatggatttcatgggaccagagtcctatgtccagaatcaccgtgccccatggtgacaggccacaaacacatctctctgggcctgcagatttcaccgtgaccaacgtcatcatcttctttgcctttgtcctgctgctctccggagccctcgcctactgcctggccctccagctgtatgtgcggcgccgaaagaagctacccagtgtcctggtgagtcttgcaaggaggtcactgccccgtccttcccagccacacccgagcttccaggagggcagggagctcttttcctcccagccagtccattgccttagcttgcctctgctctcagccctgatgtgattgggagataccttcatcaagcgctgtggggacagagggaggaagtgagcatgaagcccagtaccgagaatgttgccatccagtagctcagatgagacacatggaatcacaaatctcaatgaccacgagccattttgatatgatctactagtagttggccatggactagcccctgtgcattgcatctctgattatgaggcacagttattatccccatttcataagtgaggaaactgaggcacagagagattgttacacacagagggccacacagccaggaagagtcagggagggaacccactttcctactgctattagccatgggtgttccacaagagagaaagaaggaaaggccagaagtgctggtcctcgggctgctgccagagtgggccagaggagagaggacactggggggcggtggggatgctgcgccactggagaggggatgctggcaggggacagggaggggctcatggaggaggccaagccctcctcccctcccagggtgtgtcctcttgctacattgtactgacaaatgatacatttgtggcaagccagtctccaaaactcagcttgcaaagattgggcagcattttccaaacctcggcctggtctctggcctggagttcaggccgcattgaagattgcccaccatagcctccatagctggcactattgcatgatggctgagggatcagctgggaaggaaccagctccgtctgcaaggcaggggccccacaactggaaggggaatctccagagcgatcctgggatctctagggaaaacaagacgagagacaagtgcagtggcacaatctcagctcacttgcagcctcaccctctcaggttccagtgattctcctgccttagcctcccgagtagctgggattacaggcatctgccaccatgcctggctaatttttgtatttttagtagagacggggtgttgaccaggctggtctcgaactcctgacctccggtgatatgcccacctcggcctcccaaagtgctaggattataggcatgagccaccgcaccctgccccttctgtacttttggatcacagaactgacttgtccttgagggttttttctcttcaggataaatatagctcaatcccttcatctgatgatcgtagtcattaccacatgaataaattataatgcacagagcactgacacattcattagtttgttctcattcattagcttgtttgatttgatctttcaacagttcatcaaggtaagtattattggacaaggaagggatttcaaatcaggacagttgaggatgaattccagatgtgttctttactgttgtgccactttgtgcaagtcatttaacttctctgagcttcagttttctcctctaggaaatagaggtaataatacttctcttacagaattattggagggtaaagttcaattcaacatatatttattgagcaccttctatgtaccacactttgttctaagcactgtagacacattacaacataaggaggcaggtactgtcattatttccatgttacagatgaggaactaaagcacagagagggtaagtaatttggtcagggtgacaaagctgataagagtcagagctgggatttgaacccaggaagtctggctctagaggacacatcctaaatcaccaagcaatgtgataggaatagggactcaaccaataagagctgcatttgaatcatcatgtaccaaggaaatgagggcagatgtgcaacagtgagtcagtgagtcagtcggcagaccttaggagggcctactgtgtgccagctcagtttagactctggagacagggtagtaaacaacactagacagttcctgccctcaaggagtttgtgttcttttgggaatgtggagtaagtgagtgtgtgtatggtgagagacgaaaacaaacaagtaaaataattctaggaacaaagtgctaggaagaagtaacagggttaatgtggagagagtggcaggagtactgctttaggcaaggtattcaggaaggctttgctgaagaagtgacatctgagctgagacctaagccatgtacaggacacagccatataaagtgccgagagcatttcaagcaggagggagagtgtgtgcaaaggccctgaggcagcacggtgcttgatgtgttctgggacagaaagaacaccagtgtggctagggcagaggggttatgtggcttccttgaaacccttggcaattaacagagagcagccccttcactgtgagttccacacttgtgccactgccccacgctgcagccaccatgttcgcgtgagtcactactcggggaatagaaaacttaatttggtgtcttacatccagaattttagaaaatgaagtaggcaggagggcatagactgggatacaatagaataagaactgcagaaatatcgtggcacagctcataatgatgagtattattttgtgaaactggtttcagttatttacatacgggttatatatacaagtcattatgcaacttatttctgattttgagtcatagtcaaaaaagtttgaaacatgcttctagatgggtctagcctgctttcaggtttgaaaagcactgtggatggagccacctgagagttttcaccatgctcagcagaccttggttctgcctgttactccatctgggcctgagaatacaagtttcttgtgtatctggcctgagccaaactgggaattgcattaggaggaaagctggattcgaaaacaaaacagaatacattccagtgtaatttagactgtagtctcctccatcgagctctcctcctgggcctggccttccccggcagcactgggatgggtgctggaaggtgactcctgcttctctcactctgccctctcttccccagctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacggggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcgtagggatgtgaggttctgctgaggaaatgggtatgaatgtgccttgaacacaaagctctgtcaataagtgatacatgttttttattccaataaattgtcaagaccacaggaatcgtgtgaaactagtcagattgctgatggcacattggctcatggaggactcggttgttgataatgaggagggtaataatgtgtgggatgtgtgatgtcactttaaggaaacagggctgaggactcaggcttaaatctgacagacccagggagtcctcatgctacctgtattgtgaccttgggcccattacttatcctctccaagttttaatttccccacctgtcacgtggagttgacaactccccatgaggatgttgtgaggtgtaaatgaaattgcacataaaaagtttaacatggtgccaggcatgtggtactatgtgccactagctgtcattggctgttgagtctgtaaagaaaaatggacagcttttcttggaaacaagtgaaaatgaaagcgataaggagtgtgcagcgggactctttcagaagacagaaaaggaagaggtggaaagcacaatgcaacgttttggatgtgagttctgacaatgtggagagaagaacctggaaacccctcctttccaggaagacagcaaactgggcctccctggagctctgttcccagagccctgtccctggctccccttgcccaggaggcatgtcccagtggtggttctcctaagtgcggaagccatctgcactctattctagaagcagcctgctccctccatgaaaaaccccatgtgggtttgaatttctccccatgctcagcccagtgggtagaacaaacccaggcccgcggcctgagcttcctgggtgtgcttttctcttcgtcctacctgaatcccctagaaggtgactggggacacctcacctcttttcccctgtgtcatctccaatcttgcctcaccccgttcattctgagaaaataactagttctgaggaagtgctgatcctatcatcttcagagaacttgactaatatcacgccatttcagacctgctcaggcttttgccctagagccctccttgtcaatattggaaagaaaagtagtgttggtcactttctcctggaaatgaggtgttagcgatggcttattccccatggaaaaggcccctaaggtctaaatataaagattcagagagtaaaaggaattacattcaaggaactgcagccagtttggttggatacgacagatcaaagagcagcttgcaggacagaaggaagtcagaagacgcagcccttggtgcaggccctgcctgctccgtttctgtggaatgagtaggagtttgcgctggttcatctctgctttgaggctgctctgtaaccactcaccacagacaggcccttgggagaaactgagcgagtccttccaagcagccggggctgatgagacacttgcagatttcttgggaatttggattacagcccccaacagaaggccccagctgttcttcaactgagcaatctccttcaagggcttttccaagctgaggaatgcgtaatgctgtctttgtgtgagctaatggaacttcctcttagtacagagagggggtaaatgggccaccattgagtgaagaggaaattcaataaactgtgttttcccaactttgtaaatagctatagtcagggtgtgccttgtctacccagcatatattcatcccccggcctcagtgttcacactttcacagaagacacacagtccctaggaagctgggtcccacccccagagcccatgctgctctgctgggtggaaggtctctgagccccacatgggaacagcacagcaagggaagctgtaggctgtgaccacctgggaccactgacaggtctgctgcctaagtggcaggtctgggcagtcagggctgatttgatcaagcctcaacctagaggaccctagatactaggaagcttgactcattcatttcctgttgtgctcatgggttaaaaaagcaaacccacagttttgggtttgaagtaaaccccaatttaaaattaaatgcattgttattaatgacacacagcacattttcccactatcatctcgatcctaacttca

SEQ ID NO: 813 - DNA, 25966 bp, Human; identical to SEQ ID NO: 632

SEQ ID NO: 814 - DNA, 13614 bp, Human
  misc_feature (1)...(13614): n = A,T,C or G
gaaggcacaagctggagccctgaaagcaaatgcagtatagccttctccaccactgcaccagggctgggcctgttgggggaatccagacccaaccgttcaattttttaacatagcatttacccaaacaccaaaaactaagtttaccgaagttttagattctcaactaaatcacttgctgttatgttcagaagaaagtacatttataaaccttgtaagcaagccattgcatcaaaataactcaacatagagttagaccaatgttaaggcattttcgtggaggaaaaagcattttttcaccaaagacctaatgtaaagaaagccacattaagccatgaactcaaggaggatgaacatgaccgtgatctttgaacaatttggcaggaagctgtcacatttatattaatacaaagaatgggttgctacatctctgcatgtctacattctacctcttcatgatccggttcaaattccacctccctcatgaaaccttccttgatttcactccctccacaccactgctgtttcctccaaacacccacagcattttatccaaacctctattaatttatctccaatactctagcaccatcacagcatgtggcatgtagtagatgacaggaaatgtttactgaatgaatgtaggaatatacatcattaacattaatctgctgtccagatatgttctaacccaagacacctttctttggatcattttcaaagttcctaagtgacctcaggaaagatcagaactccttatcatagcatctcaaatacactctttacatattaatacatgctatgtatcatacatgtagacacatgcatttatacacaagaatacctgcctttaccaaatatgtatgcatatatgtaaatgagtattcacaaagactgtgtatgataacaaactacatgcatgtggactcagaataagtgggaccaggttacatgatttgaaaagcatgcccaggggcctctgacaaacagtctcctatgtagccatattgtctggaaatctctcagtgtcttactccttgaagatgtacaacatctcattctccctctcccttgtcttctgcctgtgaatataagccaaagtatccagctgttgaaggcctagagctgctgctccactatggcccagccagagactcaagtgggagactaccatgcagagcttatagtagctcccagctcagtctctctaaacataccctctggggttgaatcctggcccctccacaaatgaaacatgtgacttaaacaggtcatctaaatgtctctggatttgatttcatctgtaaaatggagatagtaatagcatctccctcccaaggctatgtgaagatggattggggtaatatgtggaacacagtacaaatgtctgggcaatcataattttttagcaaatgttcattattatcatcatcagtattgttctctttatcttttccatggaaagtctaacttatagactagggattttctaatatgttgataccaaaccacatcctccagaagcagctctaggccccatacaaagcctgctttgtaataacacagtcactcattctctccacatacaatgagggaggataagtacagagattctctagttgggctccttggtcccaagatatctaccacaaacctcaaaatattcccctgcataagttaattcaacctcaacatcttacatagtcaaaaaatgtatccacataacttcaggattagtcccttgttccttttcctcaaccaattttgtaaaaggaaataactaaaacatccaaaagcaaagagtagaaagttggagttttgaaagactgttgaaagactcccccatttgggggtactaaatcacattataaaattgcaaaactgtcagagtgtaattaacctatgttgcttcatattcctgatgcagcaattgtttaagacatggctttaaagaggactgcaagagagctgtgagtgacacatgatgctgtgaacgtcagggtgctcgccagggaagggccctacccagagggacagaaagaaagccaggaggggtagagtttgaagagaagatcatgttctccctgaagacgcttccatttctgctcttactccatgtgcagatttccaaggcctttcctgtatcttctaaagagaaaaatacaaaaactgttcaggtaaatgaactatcagttaggtgatgtttgatttgctgattattaggaaatagtgtgggttgttttctcttgttaattaaaacagcctgaaagaaattatttgggtgattagtttgagattgaacatctccttttagtgatttggagggttccaagctggtaaggactaggccttttaaaagccggacatgaaaacaagctgaattctttaaaggctgggaaaatactgctgtagagttacccctagttgggaaacttttgtagaagaaatggttttatttataaaatggtatcattttctttctcatttacctaaggtttttccttccaggatatctgcaatcaagttactatatgtctggtgcttccatacaggcattttctttgccgccaaaaattccagatatagaaaataatgtgaggatggtagattacaatgaactagaaatcagtacacagtaaaatcatatttcccagcatcagattgtggactgtttataaactcttggaagcattataaaagcagaaccaatagtttttttccattgtttcacagtctgaaagtgaacccaaatttttaagaaacacaagggaattctgtcacaaatctctcatgcacagttttcttagcattatagtttggagaaagcattattattattaagaggttatctcttaattgtaacccccgggttaatgtaaagtccattgagtgcttattctatgcaaggcaactgctacacatttcacaaatatctcatttaatcctcacaagaaccttattggagcattattattttcatttcagagacaaaaatatcttaaatcagataaataatgtggccaagtgctcacagttaattcatggcagagttaagatttgaacccaggcctgtctgattccaaagcgtgtgatctggtcagtgtcacctactgctgtggttagagtgtgtcccttgaatttatgtgttaaagatttagtagcccatgtgacagtgggtcctttaagaagtacttaggtcattaagaaagattaatgacactcttgtgtgactggattaatttttgctggagtgggttctggctcttgcagaactggattagtaattaatagaatgggtattataaagaggggctgccctttgtgttttgccccttttcacacatgcttgctccccttttgtttctctgccatgttatgacacagcacaaggccatctcagaagccaaccagatgcagccacctgatcttggacttcccagcctccagaattgtgagagaaaatcagccccttttatgtataagttacccagcttcagatattctgttatagcaacagaaaatggactaagacactgacaaggtgccaggtgttcacaggcagcatgaggtctagttaggttacatttcactgtgtatgaagaaacttttaagccaaacttaaaataggtaatttttaggctaaactctttggattttgactaaatttaacacttccaaagagttactttggtgaataaaatgctaatatcaatgatattgctgttcccctaaaagatatttgaaattattttgaaattatcagttctcatttgagaggcaacatggtgagttaaaatctgaatcatcacttggaaaattccttaattctctgtgcttctgtttgttcagcagaataaataagccttttctacagtagtgaagaggataaaaaagaggaactgcactgatgcaacaaatacctcaagagaagtcaattaatgttagtcctaatttttttgtaaaaacaagaagacagtctcctgactgtagagtagcactttgcctgtgtgatgtgatcctcatcccttatgagacacccttttttatgcataaccattaactggagcactgagtggaggaactgttctttctaaaaagagttgttctctcaaagccaacctacaaattaatttgtgttattgttcctgtggctgtcaagttatcagacctctgtagtaacttagaaagggttgcaaaatgaccagagaactggaggtcctttcacagcaagacccctatgtgcttgtctttgtccaggactacctggaaaagttctaccaattaccaagcaaccagtatcagtctacaaggaagaatggcactaatgtgatcgttgaaaagcttaaagaaatgcagcgattttttgggttgaatgtgacggggaagccaaatgaggaaactctggacatgatgaaaaagcctcgctgtggagtgcctgacagtggtggttttatgttaaccccaggaaaccccaagtgggaacgcactaacttgacctacaggtgatatctctagggtttcaggatacactcatttatccagtatggactgggctcttatatgacagacactgttcttgggatacactaggaacaagtagataaatatccctgcctttgtagagtgtgagtagtgaatgaatatgagaatgaaaatgttgagataccgtgggttctttccactccaaggcttcccgttttagtcttccttctccaacaatctaaagaggactacagcaatgttaggctgtctctctaagcacttactttaggacccaacaaaggcttaatcattgctggagagagtcaagtccctcctttcatacatcttaataataataataatatctaatatttgtggaatattattactatttgacaagtaatgaactaaatgctttatatgtatttaatccccacggcagccctatgagagggatactatattagtatcctcattttatgaataggaaactgaggtttaaagacatgtattaacttgttcagaacccacatctgtcctccaccctgagacctgcactccctccttatcctctccagtggtagcacaccatgatgcaactcacttcaaaacagaacaactcatcagttgatggactactgttctaaataacatttaactcttcatacatcctctcattttgaaggattcgaaactataccccacagctgtcagaggctgaggtagaaagagctatcaaggatgcctttgaactctggagtgttgcatcacctctcatcttcaccaggatctcacagggagaggcagatatcaacattgctttttaccaaagaggtaggtacaaagcagtcatgctcagttttgctttctttggctaacctgaaacttggcaaggatctaatacaaatgttcttatttcagatcacggtgacaattctccatttgatggacccaatggaatccttgctcatgcctttcagccaggccaaggtattggaggagatgctcattttgatgccgaagaaacatggaccaacacctccgcaagtaagttaatcaagattatgtccacacacagcttctgaattaaccttttacagattagaatacacacacacacacacacacacacaataaaggtaacataatatttcaaactcacaaaaagtgatcatttgaaatttttgctacctcatgatactaagtcaatttgggatttttttaaaaaaagaaagaagaagacatgctgaatctgattactgaccttacttcttaggtcagagatcagaaaatacagactacggccaaatcctgcctgacccctgtctgtataaataaagttttattgaaacagggccacatttatttgtttctatatcataaatggctgctttcactctacaatggcaagctgagtaattgcaacatggatcatttggcttacaaagcctaaaatatttgctatctggttctttacagatactgctttagaatatctttattttaatattcccaaatttagtgatgtttgaaaagagcctatttttccatttttggaaattcatttagaaattataatttctataattagaaattagcctatttttccattttttggaaattcatttagaaattataatttctataattagaaattagtctattgagaaaagaacagacaccttccctctcatctagttagttcatctccttggagctcttcttcagtggtatgcttctgtacagcaagccactcctttcaggagaaggctcctattaagaaggactgggctgcttgaagggaagaaatgaggctgaggacaggtatacccagaccatgtggtacttcacaaaatatggggtaacaatatgccagagagcacttttagaaaataatcagaaaggcaccttttacctttgcttggcacctgttcctcctgccattttctcaacatgggtatgttacgagggtctattctacctaagtccatatgctaggagctgtgtgtagccaaagataggtaataaccctcagctcctctccattccctgttgccctcctcactagttcggatgatcattacctcttacctgaacgaatgatctagattcctaactggactctccatctccagtatgtgctccctctaatttttcctaccattgcagcagggtttgtttttggaagcccatcttggatcacatcactctcatgcttaaaagtttcaatgtttacacattctgcaccaaataaggtccaaatacttccacttggtattgaaggctcttggtgcttgttcatccttgtctttcttggcttgtcttcttatttcacgtattccattcacatcgggctaacacccacattgtacattcactgtttctaggtcacaccctatgcttttcatcttcctcacatttgcttgaattgcttcctctccctgaaatactcttcccatgccccaagcaccaccttttaaaatctctctcatcttgccatgctatgtatgtcaaaggccaccttctgtcttgccttgtcctggaaatgagaacttcctctgcagaattctgacagcttttgtatctccttctctgtcatcactcactgtgtgctttcaagttgtttgcacacatctctcctcttctagactatgcactccctgtagagcagagaaccacaacaaattgcccacagttcctttcacggtattccaagcattcaaagatatttttctgaaatgcactcatgaatgcataattaaaaggatgtgatgataagaaacaattcttagagcatgggtagaattttagcaggctaattatcaacaggaagttgaacattgcagtaagagcatggatcttgccattatacctgggtttgaccccaatctgtcacttactagttgagggaccaagtaccagctattcaaaatctatgggcatcagtcactttactataaaaatattgttaataaaacttcagaaaaatgttatgaggattgcataacattagattgcctagtatgttgtaggtactctacaattatggctttttttaaaagtaggcatatacaaaaatgcatcagtgtgtttgtgaggcagcatgtagactgctggactgaaggattcatgttaaaaggcaagcactcaaatatctgctggagccaagtggaggaggtcttgaaggccaggcaaaagaggttgggctttatttgataggaagtgagatcctgggaaggttttaagtctccagttgtgaacggcactatgctcatggaagttaaaacatggagaaagagagcaataagggtaggatttgtctctctccagtagagaattcctagagcatcttagaaagctcagaaacagagaagagctggtgctaagctgtgggtgatgagggagccaacatgagccagccctccatctgaggctgctccactgctgggctggcttctcttctaactacttgctcacagggactctactcgtgaggctgagtgtctgggacagtggagatggtgattgtgggaatgcaagagaagaggggttcccaaagtcatgacggctctgccattacttctccaagtctcagatgcacatttgtaaaatgtgagaattggaataaatgcagcttttctgggttctaagagtttataagaagttcatactcacctagtcgccatctatgaccactatcttgattcttctcaatgtccactttctcaggtatctgaaagaaagatgaaaaagacagccatgggaagggctatttccctgagcagttttgacttggaggttgcattccttgagatcatgtttctgccaccctgggatccacactgagctgtttaccacccgtgtttgcatttcagattacaacttgtttcttgttgctgctcatgaatttggccattctttggggctcgctcactcctctgaccctggtgccttgatgtatcccaactatgctttcagggaaaccagcaactactcactccctcaagatgacatcgatggcattcaggccatctatggtaaggtcttctcaagagagtcatagtacatggtaggacctgggaataggcgaacactcccagaatctgaatatctcttcctttgcacttctgcagtttccataaaactgaactctgaatttccccagtaataaagcattaacaaagaaggtgtgagggactgagcctctattgctgccctaaaagaaaaaaagtttaagaagaaatgcactacagtgcttcccagttattgtctttggatggtggggatttttttcttcttttttaggctttccaaatttccaattttaaattttttttggggggggggatggagtctcactctgttgcccaggctggagtgcagtgacgcgatcttggctcactgcaacctctgcctcccaagttcaagcaattctcctgcctcagcctctcaagtagctgagattacagatgcccaccaccacacttggctaatttttgtattttcagtagagaggtgatttcaccacaatgaccaggctggtcttgaactcctgacctcgagtgatctgcccacctcagcctcccaaaatgctgggattacaggcgtgagccattgcacctggccccaattttaaatattctaaaaagacatgactattctttttcctacagcaatcctgctcccagatgtatctatcaaagaaattctcatgtagatccataaggggacatgtacaaatcatgccaaagatgttcactgcagtcttgtttgtggtaatggaagttggaagacacctgggagtctattaggagaagactatacagataaaatgtggtagctgcacaccatgaagtgatgtgcagcagtgagaaacatggtactagatgcacatatggcaacagtacagatgggtctttaaaacttggtactttgtgaaaaagaaacagaatgagatatattgcacaatgtattaattaaattacacaatatataagtctatgtaaatttaaaatgtatataaacaaagcaaggcatttttcaagaagaagaaagggaatggtagtggagtatggagagaaaaaaagaaacttttttaaggcatcactgatacatttcaaggataagtataggggccttttgccatattgcctggataagaccattacatctctcttcacgcttgcccttctgttccctagttggctgtgaataaaaacaagaaaccaataagggatttactgctctctaaaaaagtgtggaatggaatggaatagtggattggagtgaaatataattgaatggagtggaacagagtggagtggaattggggaaagcccttttctgtctctggtgggacagcactataaaatcaagcaagcatgccagggtgccacaaccagggaacttttttgtgattgcagatatttcagaaatgttgagcctatcctaactgcctctattccccaatttcttcctcctgcccaccccaacaacacccctttattttgttcaccaatgtttttatcttaactattattatagcctttcattccacagtgagaaaacacatgaaaattcaaatacttatagaaaaaatattgctaaaatttgacttaggtgtatgctatagcgtaaaagactaatatcattctttcctgaaagtggattttggtgaggagagaggcaatagatactgagtgaccaaaaaagcagaaagaggaactgaaaagtcagagaagaattagtttagaatttaaaagggaaggaaggagcatagaattcaaatttctttacttcacagcttgacctggaacttaccctgaaaaccatcattactcttattaaagaaacaaaaactttaaaaggatgaaatatacaattactttaatactttatggtatagtctggtagcacttaccttcacatgaagacccttcacctttctgagaagtctctgatgtacccaagagtcacaccggacttactctcataagaaagacctttttttttttttttttttttttttccaggactttcaagcaaccctatccaacctactggaccaagcacacccaaaccctgtgaccccagtttgacatttgatgctatcaccacactccgtggagaaatacttttctttaaagacaggtataaaattgaaatatttcttcctttgattcctcttactgacataccttaaaactggattcaaattaagtcacacgttagtcaccttttccttgaattctatacttgtgcttctcatcggaattttttataggttctggggcaccactaggattatcatagccccctgagcttaactttatcatcttcgtcttttaaagactatttgtaccatttttgtgtctatactgaatttatgcaattgagtattttctgggtaactcaagacatccaggagaaaaaaaaaacatgaaaacattcacaaacattcagatgcctttggtgatgtaaacagacatgggctacagctgcttgggaaccccatagctgaaacaccaaagcaccatccagttccatccaaaatcagtcaagtaaatggaacctgcgcttagctagctgtgcagcaaatcatcaaactgagcgaaatttttatttgtccattggctattttgtgagtgtgcaatcacaggctgagggtacatgctgttgcttttatcaatatgttcacagcatttactgggagcaataatgaaagatgctacaaagtaagatttttcaatgtccaaggcaggacaatgccaaatgtaatcaaataagatcactcccataaccttccctgaaagctgtgaagtacttgccagatggacaatatcactataaagcttcgccatatgctggtcactgtgctaggaactttgcattcgttcgattgttatattctcccagcaatcctacaaggaccatcactagcctaaaagtcacaggaactgcctacttagactgttatgtataagtgtgtgtgtgtgtttccttatgttccgttaggtacttctggagaaggcatcctcagctacaaagagtcgnnnnnnnnnnnnnnnnnnnnnnnnnnnnnnnnnnnnnnnnnnnnnnnnnnnnnnnnnnnnnnnnnnnnnnnnnnnnnnnnnnataatttgtaaaaatggaaaagtcgtatttaacacttaacctgaatcattgacaggcaaccaatactgggctctgagtggctatgatattctgcaaggttatcccaaggatatatcaaactatggcttccccagcagcgtccaagcaattgacgcagctgttttctacagaagtaaaacatacttctttgtaaatgaccaattctggaggtaacgtaaactattttttcaattataggttgaaatctgtgtttctctaccctgcttacaaaccttcaagcatttcaaggtttaaaacaatctagatagtctctaataggttttaccgagaatatattcttttttacaggatgattgatgttaccatggcttttgaaatttttcatttctataaaattaaaatgtctatgcaatagtattgaggattctgcatcaagaaacaaagaaaaccttaacaaagcactagggtgagatacaaagaaagatttaagctaattctcacttatgagttcaactcagacatatgcaagcaaatgttatccagatagcctgcagaatttggttcccaagttgaacctattatgtatgtttatatatctatatacacacacaagggagttatactatataccaattaagtaaaagccttgaaaatataagcttactttgggtaataacagtgtgtcagccatcaagcctgttttagaattaatgataaccatatgttttataaatgtgtacccttaggtagagaaattaaccattcttaatcctagtaaacagggcattgtgagaactgaatgaaaaaatatgtgtgaggagactttgtaaattatatacaataaaaaaaatttttttcgttatattctgtattggtgttaaatcggatgacattttgtttttaccagatatgataaccaaagacaattcatggagccaggttatcccaaaagcatatcaggtgcctttccaggaatagagagtaaagttgatgcagttttccagcaagaacgtaagtaggaaaaaaaaaacctaataaatgtgttgtttgtttgtttattatagaggagacagggtcttactatgctgaccaggttagtgtcaaactcctggcctcaagcaatcctcccacctcagcctcccagagttctgggattacaggcattagccaccgcacctggtgtttaaattttttaaatagcatgtttgcatttgaatgttatgttggaacaggggcagggttttctaactgaagacatctgagatattctataagctaattcaataaattatctctctttttttatagatttcttccatgtcttcagtggaccaagatattacgcatttgatcttattgctcagagagttaccagagttgcaagaggcaataaatggcttaactgtagatatggctgaagcaaaatcaaatgtggctgtatccactttcagaatgttgaagggaagttcagcatgcattttcgttacattgtgtcctgcttatacttttctcaatattaagtcattgtttcccatcactgtatccattctacctgtcctccgtgaaaatatgtttggaatattccactatttgcagaggcttattcagttcttacacattccatcttacattagtgattccatcaaagagaaggaaagtaagcctttttgtcacctcaatatttactatttcaatacttacatatctgacttctaggatttattgttatattacttgcctatctgacttcatacatccctcagtttcttaaaatgtcctatgtatatcttctacatgcaatttagaactagattttggttagaagtaaggattataaacaacctagacagtacccttggcctttacagaaaatatggtgctgttttctacccttggaaagaaatgtagatgatatgtttcgtgggttgaattgtgtcccccataaaagatatgttgaagttctaaccccaggtacccatgaatgtgagcttaccagggtct

SEQ ID NO: 815 - DNA, 14820 bp, Human
tcctcttccatcctccctgatctgtgaggtctggcctcttgtcctcttccagaaattgagagcttggagggtcatcacctcaaccgttgtctagttcaagctcctaagttttccttggagaaaaatttaggcctaagggaacacagtccttcagaggcagaggctgcaccagaacccaggtgttccatgctgcaaagcagagtgttaacactggttcaagaacatcttgagggccaggtgcggtggctcatgcctgtaatctcagcactttgggaggccaaggcaggcggatcacctgaggtcaggagtttgagaccagcctggccaacgtggagaaaccccgtctctactaaaaatacaaaaattagctgggcgtggtggcgccagcctgtaatcccagctactcgggaggctgaggcaggagaattgcttgaacccaggaggcagaggttgcagtgagccgagatcatgccactgcactccagcctgggcaacagaatgagactctgtcaaaaaaaacccaaaaaccaaaaaccaaacaaacacccaaaaaacaaaacgaaacaaaaaacaaaaaaacaaaagcacgtcttcagagttcatgaacccaggaaatgtaggcacaagtgtgtgtgtttctgcaaaatgagagggtcccgagtttcctaacatacttaaagtgttttatgatgccacaaaaggctggcccactctttttttttttttgagatggagttttgcactgtcgcccaggctgaagtgcagtgatgtaatcattgcaatcatggctcactgcaaccttgacttcttgagctcaagcgatcctcctgcctcagcctcctgagtagctgggactacaggtgtttgccaccatgcctggctaacttaaaaatttctttattttgtagagatgggggtcttgccatgttgccaggctggtcttgaactcctggcctcaagcgatctccctttttggccttccaaagtgttagattacaggcgtaagccaccgcgcctggcccccacctttatttttatttttatttattatttattattttttttttgagactgagtcttgctctgccttcgaggctggagtgcagtggcacgatctcggctcattgcaatctctgcctctgcggttcaagcgattctcctgcctcagcctcccgagtagctgggattacaggcgaacgccactacatccggttaatttttgtatttttagtagagacggagtttcactatgttggccaggttggtctcgaactcctgacctcaagtgatctgcccgcctcggcctcctaaagtgctggattacaggcgtgagccaccgcgcccggccccactcttaataaatgcctgtctccaggtgctgggtgggaggtgggatggaatggaatgaggtgaggacgcatggatgcatggatgaatggatgggaagttgagacgacgcgcccacacgagggaatttcctttgaaagagagcgaaattctgagttgggaaactcttccttgaaacgcctccccataccccagctgtggccttcccgttttctgcgtggtggtgtggggggaacttcctcaggcctctccgcagtggagcctctttcggttctgccaggatacctagaggcagcggagagcggggcagggaggggaaaaccgtgagggtccctgtggcaggccccagcacccatgggatctctctccggtcgcaggaagcaggctagctcctagcccgcctcggcttggcctttgtgggacctgggggcaaagaagaagagctgtctctgggaccatgcctcctcccgtacacagcaagatgcgtccctaaactcccgggggaattagacttgtgggaatgttctggggaaactcctgcgcggtgaattgctgggggctccgcccccccgataggtggaccgcgattggtctttgaagaccccgcccctttcctgggcggggccaaggctggggcaggggagtcagcagaggcctcgctcgggcgcccagtggtcctgccgcctggtctcacctcgccatggttcgtctgcctctgcagtgcgtcctctggggctgcttgctgaccgctgtgagttgtttttgccccgaccagacgggagttgggagtggggaatgagaaggaaagggaaggaagacttcggggaagaggccttcctggctgatttttgtgggggcaggagggtgggtgggagctgggcaaggtgcccccgctcctggctgaatggggtgggctgcctctctcttctcccgggctggggtcccgggagcggcctacaggggccgctcagggaaggcactggctgcccaagcgtgcctagacggcctggacgggtttagggagcctcagaggctggccacacagagactggtagggggttcagagggcgggaagtgaggcggaccaagggaaggggcgggtctggcccgtttcctgtccccttcttattgtggacagatgccagcctctgtaagtagttatcatctccttgccagctggggctgccttcttccagggcatcttgtgggaacaagagatgggtgcagaggcccaggtacttttgtgagaaggcaaggagcttttaacatcgccttccaccccgaaccgtatcttgggtgttccaacctaggaggaatccccagggctttgcctttttctcctgaatttaagatgacataggagacccctggggagatgaacagtttatgggacacaataaagggttaggagaccagagttctggttggctctgaccagggctggtgatcagagggctggagaaaccaggggtttctccaggcaccagaggggctcagagccaaccaagcatatctccgggattttcagaagcctacacttgactcactttttgtttaaatgtatttttgtagttcctcattctggaggctgggaatcccccaagtacctggctccttcatcccagcccctctggcctccccctactttagagggctgtagattccggcctgaagcctgggcaggaatgacccatggtatcaaggaaagcaagggaagcagcaagggaagagagggagtggggaggctgctttggtcccacagctttcactttcacctgaagcaatggctcttagggaacagggaggcagggggagggcggagctggaaagaggtaaaggggggcccttgtggtaggagtggagaaagagccagaggaggtggggtgaagggtgtgatccaggcttctcaagagcagagtttgccctcataactcccaactttggctccaggtagaggctgggctgtgacaacaatgtcagaagctatctattgagggcttcttgtgtgtcaggctctgagccaaacactgcctgttttctttgtctgatttctcacaactcccccattatacagatgggcaaattgaggctcagaaagggggattgtcttgccaaaggtctcatagctagctaatggaagaacctggttgtgaatctacatctgcatgattcccgagcctgcctctcagatagtgagagtctccaagctctggtcctgagctgttttgtggcagaaggaccagaactatggggagtgagaactggagattgacagacttttaggggagcgttttatttctcatgtgtttgaagatggtatcaaggactttcctatctttgggagtgtgggagctccacgttcacaggatggtgtcttgcaatgagctggtggggggcagtagccttttctacttcctttcccattttgggtaagacacatttctgtaagtaatttgctgagatacccaggttgaatgagagccaccagttaggtaggattctggacagccagccaggtagccgggctgcttgccatatatcatgcaagcagaaacaaatgaatgatgattaaaattgccatttaatgagcacctactatgttcctgacactgtgctaggccatatacatgtattctttcttatcttcgtaatccaacctgcagggcaggcattattactcccattttagagatagagaaactgaggctaagagaagcaaaataactagtaagtgttacaaagtcaggactggagtctaaagctgtctgactctcaaacttgtgttcttttcactggctgttcccaaactgtgggacagttttaaggagcacatggacatagaattaaacatacacttactttacagttcttttaaaaatccttctcattttttcaaagaggaagtctctggagctagaatagagttaatgcctctcaaaggcttgctaatccttcttttaaaacaaaaatcaagagcaggcctgggagggccttcaacaagcaaacaaccagctgggttttaataaccttgttttgtttccccagaatttatttttagggttaccttttatttatgagaagtgatactggttcttgtctcttggcaatgatgtgaggtttacatttaaagtaaatgtaccggccaggcacggtggcttgtgcctgtaatcccagcactttgggaggccaaggcagtcagatcacttgaggtcaggagttttagatcagcctggccaacatggtgaaaccctgtctctactaaaaatacataaattagccgggcatagtggtacacacctgtaatcccagctactcaggaggctgaggctggagaattgcttgaacccaggagatagaggttgcagtgggctgagatgatgccactgcactccagcctgggcgatggagcgagactctgtctcaaaaaataaaataaaagtattgaaattaacaataagtaattaatagcatgggtggtacctggatgtagtaaaatggtgaagatgaaacacaagttgatggagagaggagcattgagacctgagttctcatttggactctgtcactgtgagactctgggcaagtgaccctcctctttggtgctcagtctcaactatctgtaaaatgaaagtgtgagtttacccttccagctttacattctagcattttatgagggaagggctggatgaacagatgatgaggagttggaggaagaaaacatgatgggctttggaaaggagcaggaagggaagcagaagaataggaggaagaggccaagtgctaaacatagccccaaacagcactgggaccagctgaagtcagccagcttcaggactccaggggagctgctggagtccccatatcctatgggatctttgggaagaggaatgactcaggcatcaagccccaaggaattctgttctgttcagagaatattgtgagtttacagtaccattgctttgtaaaaataccagaatgattctctgggtgcgattataatcagctcagttgacaatttacttgaaaacaaacatgccaaatatcatgcaggttccactttctgttttgacttgcacttcagtttgcagcctctgtcctggatgacttttacctttctgctgaagaagttgcaacggagatttcaagatcccttcaaattgcacaattctgtttttaggtccatccagaaccacccactgcatgcagagaaaaacagtacctaataaacagtcagtgctgttctttgtgccagccaggtgagatgccaaccctctagccccatcatggagtccccctttgctttggtggcagacgcagaccccatatgttaactgtaaactcaaatctgaaacgacccatttcccagccctgcttcactgtcagaatgttctggttccctctctaccaggtaaaactctgtctaccctgaactagggatcccagcttctccatcttcctcgcctgattatgaaggatccaagactttcatctttgaatcccctaccctaaagcctggcctgatcattgtgtggttagtgtctgactcatggagttggccagagccctccctcatttcctgatgttttccaggacagaaactggtgagtgactgcacagagttcactgaaacggaatgccttccttgcggtgaaagcgaattcctagacacctggaacagagagacacactgccaccagcacaaatactgcgaccccagtgcgtgcgctgttgggaaagggacgcttgggaaccgggctgatattcccgacaatgcagccattctaattttatgtagccagggtctgctctgattggttggagtccgggctgtactgatcattaaatgatttgattgccatctctacttggaagagggtctgaggaagaaagagcaggcaatgtggggagtgaggctcagagcatggcccagcagggggttcccatccttcctgcccttctcttctcagacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattggtaagtggctcatctgggaatcagttttggagggggacagaggagcttagggcccaaggtgaggggctgggcagtgggcacttagccccagaggcagaggaagcagaggctccaacctatgtcggtatccccactggagtgagctgcagacgggaccttgttcattctgccttctgccatggggatctgcctttgaagggcaatgggagaagtcctcctggggactgcagctgtcgggggcagtaccacatcgggggaagagtgctcaaggcaggagctcttcccgtcctgcctggccactggctgccttgtgagccggacaggtggtccactgtgatggttaatgtccccctccccacccactcccagctacaggggtttctgataccatctgcgagccctgcccagtcggcttcttctccaatgtgtcatctgctttcgaaaaatgtcacccttggacaaggtataagcactcatcccttgtgtttcctgctctaagagtggcatggagctgcctccattctctccagccacctgtcctgtccctgctcccagaggtccacacacactcatgtacttgtgaagcatctgcagagtggcctcatggccaaccagacaggcacatttccacattttttttgcctgctgtctctttgaggtaatagacactgttgatctctcgcttcatgagagcctcctatcttgggggtattgggacacttattttagctttccttctgcccctcctgcttctcctcagttttcctcgtcttgctttcaccttacctggctttctagggctttctgggctctgggtgctcaccctgagggcctccctctcttacctccaactccaaacccacaccaggtcctgccactggctgtctacgtgttttgggaacttactgtctccactgttgtcactttagtttgggcctcatcactgtggtctgggtgatgccttttctgcctcctggcctccctgcctctgtctctcccctcctgctggttctgtctccatcctcttgccaacatgagcgttcgacagtttctttcaaatcatgacactctcctatttgagatgcttcctgtctctctgttggaactaagactccttagcatggcacccaaccttcctgttgcatttcctgctctctttcctgcatcgcatagcttcatgctacttgcaatcctctgaacacactgttcattctcttccatcaaactcatctgcctggaataccttaaacatgggccccaggccaggcgcggtggctcttgcctgtaatctcagcactttggatgccaaggcgggtggatcacttgaggtcaggagttcaagaccagccagcacaacatggtaaaaacccatctctactaaaaataccaaaaaattagctgggtgtggtggtgggcgcctgtaatcccagctcctcgggaggctgaggcaggagaatcacttgaacccggaaggtggagtttgcagtgagccaagatagcgccactgcactccagcctgggcaacagagcgacattctgtctcaaaaaacaaacacctgccccattaactttttgcatttgatttttaaaaatgggcaagataggcacatgggacagaaggcacaaaagagccaaagtgatgtctttctcccatccctgccccttaggctcccagttctttctggagggagccattgttccttgcatatccttccagagattctacatataaacaaaccaacacacacacacacacacacaaacacacacaaaatttccctccttttacttttgcacaaataggagtatacattttatttgttaactgtctgcctttccctaatagattgaaaattccttaaatgtagaaacttggccttttttttttcttccattgatacatcccctatacctggaacagtacctgacgcatggtaggtgcttaaatttttactgataaatgttgactgataactggaggcaccactggtatagtttttttttttttttttttttttttttttttttgagacagagtctcactctgtcgcccaggctggagtgcagtggcgcaatctcggctcactgcaagctctgcctcccaggttcacgccattctcctgcctcagcctcctgagtagctgggactataggcgcccgccaccacacccggctaatttttttgtatttttagtagagacggcgtttcaccgtgttagccaggatggtcttgatctcctgacctcgtgatccgtctgccttggcctcccaaagtgctgggattacaggcgtgagccaccgtgcccggccaccagtggtatagtattaatggaatcagtgcattggcttacgtatctgattacagctcagtaagtgtgtgaccctcactgagcctcagtctcctcatctgaaaaatgggaatgaccttcatttcacaaggcttgagctaaaaacatgtaaagtgtattgtaaattcctgaatgctctactcatgtaagactaaagtaggccgggcgtggtggctcacacctgtaattgcagcactttgggaggccgaggagggcagatcatgaggtcaagagatcgagaccatcctggctaatatggtaaaaccctgtctctactaaaaatacaaaaattagctgggcgtggtggcgcacatctgtagtcccagctactcaggaggcggaggcaggagaattgcttgaacctgggaggtggaggttgcagtgagctgagatcgcgccactgcattccagccagtctggcgaaagagcaagactctgtctcaaaaaaaaaaaaaaaaaaaaaaaaagactaaagtacatggtttcttcaaagcttctctctctttctcccaccttagatgatttttcctttgcaatgtcctgtgtccattccgccccactcctcctggggccacctggaccaggtcttcatcatctcatatctatatgtttgctgtgtctcctggctggccactcttctgtaatttctcctcctctgagctctctgggcagctgaatcttctcactagtgaagtcgcctggttggatgctgatgagactgaccagctgaatccagttgaaaacttcacacttggcagtgatctggttctaaagacacaattttccatagtttcctaacaccatcctgcatgccacctgccttatttccccacatcacatcgtcccacttagcgggactgcactgctgatccaaattttacatcctttagggcccactcaggtcatatgtcctcagggaagtctttctggaagaaccttaaaccagaggttctcaacagggggcagttttgctccctgtggaacgtttgccaatgtctggacacatttcattcgtcacaaacggagagggggatgctacagggatctggcggatagaggccagggatgctgctgaacatctgcaatgcataggacagcccacccccacccccacacccccagtaaataatgatccagcccaagtgtcactggtgctgacgttgagtaaccctatcttaagctgaactcatcatctctccattccagccttggtggattctgtctcctctgaaccattcccatctcactttagcctacctagatcacaaagcttggcactcattatagactcccctatttattactccttcaagatgtgcaagaatcttttctctgcacttttaagttctgtaagaagagtctgtgtcgttcctataataaccagcataggacgttgcacgtgttgtgtgctcagtgaacctggatttgttgattgttgactgactcactctagagttggaaatcttatgcttggggaaacttaatatctctttctttctctgtgtgtgtgcatttgtgcacgtgtctgtgcatagctgtgagaccaaagacctggttgtgcaacaggcaggcacaaacaagactgatgttgtctgtggtgagtcctggacaatgggccctggagaaagcctaggaaggtgggaactgaagggggagatgaggcacacaggaacactggatgggaaaaaggggaggggaggcagtttgggggtgtggtatcacagctctgccacttatcttgggagtctgggcaaatcacttcccctctcttagcctcagtttcttcatctgtaaaatgggatgataacagcacttccttagtaggttttgattttagagtgagaaggttggcctacagtaaagatcagataatgtaaatcagtgaaaaaggtcaggggtaagaaaattacattctctttacctaacgctaaatgaccagttaatgggtgcagcacaccaacatggtacatgtatacatatgtaacaaacctgcacattatgcacatgtaccctaaagcttaaagtataataataataaaatttaaaaaaacgaaaaatacattctctttgctttttctcaaaatgtactttcctctttgtagggctgggactagaatgaggtgagcaaggcacttgccctcgggcgcaatatttaagaaggtgccataaaagtgtagtaatcaaggtaaattcattttgatgcaatatttttaaaaataaaaattaatgcaaagaaatccatgatgagcaagatagcaacattttaaataaagaacaggatccgaccctgtgtttgcatgaccctgcctcactcacctcaccctaatcctggccctggttccagtaaaaggaataggcagccagcctgcaggccgtagtttgctgacttggtgtccgcctgatgattttcaaaatatggcattaaaagaatgtttaccttgatgactgagtgttttggacatccttttcaattttgtcctgaaacaatttcatcccttgcctcacgctagtctccgccctgccttttggtctttcttttattttcccactttgaaaaaaaaattcggcatgagaaatactttacctttcccctccactcttctataccaaaagcaacatgcagacatgaatcatgctagacctcggcattgggcagagagcagggagtggcggggagcatggtgagcaggtggtgacagccactgccaccactcgcttctagatggttcccaggtggggaggctgccaactggaacccagtcttcccagtttgtaagagaaatcagatgtctaggtttgaatatgtgatctcccagtttaaaaatgtcggcaaatatttccaaacgttaagaaaatgttctggctcctttaaagacatctgccagccacatttccccaaggaccgcggtttgaaccttctgatgtagatgagctctgacattggaagattctggagtctgacaagtcacagcaggttgagggtagggagaaactgcaggtgaggggtgcatgctgaagtcctgatttctccaggtccccaggatcggctgagagccctggtggtgatccccatcatcttcgggatcctgtttgccatcctcttggtgctggtctttatcagtgagtcctcaggtggggaggtgttgggggagggaggggagaccacctgtttcttatctggcctctccaactccccatcctttttttttttttttttttttttagaaaaggtggccaagaagccaaccaataaggtaggtcacccctgagaacccgggacagagttttgacaaactgggaagatggcctcacggttgcctatggggcagtaaaactgattcagagtctgtctctgcagccagtggggtggcagcagaattggggactgtcatccccacccaccatgctccttccatccagagctcaatcccccacagaactgcccctggcaccactggcagagcctaacactggctgttcttcactcctttcctggcattcaacgcgtggggagctgcatcctttgggccttggggctgggtcaaatgggtgggagcaaatgtggcagccccttaagcccactggctcccactctggaagctcttcgtcgcccttggtgtggccagcagggggcaggaggcacccgaggaatcagcactgacccgccgtctgggaaaggggggagggcttggggaagggatccgcttcccagggaggggctcctcagaggcacagctgcccctgctgctgggggtgacctcacaccttgcctctccaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctgggggagggttggttaaagggagatttggctttcccataatgcttcatcatttttcccaaaaggagagtgaattcacataatgcttatgtaattaaaaaatcatcaaacatgtaaaaagaaaaacgggggtgaacatgctgggtgacatgagctatttaacctgctgtcaggctcacggaatgagggcattttctgtagataaataagaatgtccccaggctgctgcccctccagggtggtttccatgtgtgctcacatgtggtattgagattgcaaagtgctcttcccatttgattcatgttcacaaaaatagccttccccagcagggtgggtctgcatccctccctcttttacagaggtggaaatgaggtccagagaggcgaagtgacttgcctgtggtcacacagcggtgtctggtggtgccatgctcagagctcctcactctgggtcctgagctcctcccagatctgcctgctgtctggaactgacatctgtagctccttcccagggagatcctgggtctctcaccgccttctgacctccctgtggctgcaggagctactgcttctcggtcagatggtatccccttcccccaagcagtatctcaggataaaaataaaccatcctgttctcttttcctgctgagccaactgagggggagcctagccaggaggagcggcagatggagtgggagcagaggggaggggaggggaggaaggttggaggacaaggaggagaaggaagagcaatgcaaagtgccatgcagaaccccggcacaaaggttcgaggtgaggtttaacccaggggtctcagcctttcccaggaaagaacctgctttggatttccccaacacatcctgctggctggagggtgtggggcgatggggggcaaggggagatgtggagagggcttatcccagtggaggctgtgagggcagctgcgagccaagagaggggcacctggcttggcaggcttcccagaagagcttcaagaaccatttggatacaccaggtggaggcctttggtttagaaagtggagcaaagtggtggtggcggggaaggggaactttgggacctaattcttgtctcttatctagagcctaagagtgagtgttgttcacttctttggtggtatggtggaaagagaccaaagacccacgcctgccacagatcatctgtgtggccttggatgagtcactttcactgcttcacttctcagtttccctatctgacaaatggtgacaatatctgcagcagacgctattgatgcctcctgtgttctcttctaggtcagagcttctcaaatttgagtgtgggtcaggcgcagtggctcacgtctgtaatcccagcactctgggaggcttaggtgggca

SEQ ID NO: 816 - DNA, 15595 bp, Human
  misc_feature (1)...(15595): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcctttatgaaactatcattttcaccaaacctataatttttccttcagggactaccttgtcttttgtggggtgggatccagtttccaatcggctaaaaggctgagtccttgggttcagattgtgcatggaaataattaatagtagaggcttgtagtaagacatattcaaacctaaatctagattctgttactaataatctgtgtggcttcctgcatgtatcttaacctctcttgctccctaatcatcagtcttaccatctatgaaatggggacaatttcagtactttctcacaagactgtggaaggttagaaacattgtgttggctggcatcaacatgccaataactcccaagatattagctgtcatccagaactctctcctctgagctccagactcatttagctctagatgtattttcaacaattctgctccagtgtttcattggcttcattaaactaatgattacctaaaaattaaacactttttcttctaaacaaatttgttccaactttaacccctttccattttagtaaaagaaactaatatatatcaaatttctcccaccagaatgcaactggttgctttaccaatgactggcagtaattagaagagggccaggcaaaaaaatttatcactttgatatctatattttccaataaaaattcaaattatgctaaggtgtagtgattaacctgatgtcacataaattcaccatgctagagtagttatgatattattttcaatttcaaattttgattgaggaaaagatgctaaaaaattaggactctgggtgcagtcatccatttgttcattaagtcatgtatttagcaagcatgctaagtacttttaagcattttgggcacaaagatgttaatgagcacaaagatgtgggtataggatgtgtgctaaaaatgcaaattcaaagatatagtgctttccccaaggaaactaaatacagcaaagaggcaagattgtatagtctagtagtatttacagtctagacaagagcatggactgtcctgggagtgtccatttcaggtaaattatcatcatcatgagctgtgagcaagagaaagagaaatatgaaagcagcaggtgaccaggaaattagcattattcccaatgccacagaaggaagaagaaaagctataaaaacaaatttaagaggaaatgaattgctaagcacagtctggtatgaatttgataggtgagagaattctgcagttgcaaaaaaagatgtgtgttattcgctggagacatggtaaaatagaatgtatttttagaggagtttcatattacagagttatgtcttaggtgaaggcagaactctttaagctgtgcccatagttaaaggagtctttctatttctgacagaagacaaccacaaaaaaaaaacagttaagatgttggaatacctgggcaaagatgttcttcatggtgtttttaattatttggcaaaacacgatgttctgacattgaaggaagaggaaaagaaaaaatattatgatgccaaaattgaagacaaggccctgatcttggtagactctttgcgaaagaatcgcgtggctcatcaaatgtttacccaaacacttctcaatatggaccaaaagatcaccagtgtaaaacgtaaggttgcatctaacacgataaatatgttaaattttccagaatatattcaactccaaggcccatgcagtgttatctgtgatctacctacagtttcatttctaaactctcattttcagtaaacatgtcatcatcctgttagagaccaccttgtcttttatgggacgggatcaaatttccaattagccaaaaagctgtgtccttgtgtttagactgtgcacagaaatagttaataagggagattttttagtaggagatacctaaacccaaacttagattctgtcacatgtgaactatgcagcttcatgcaagtttcttgaccttccattctccctagtcatcagtcttaccacctgtgaaatgtgggcaattccagcactttctcacaagactgtctacagccagaaacattgtaatgccaggcaccacatgccaacaacttccaagataccagctctcattcaggactctctcatctgagctccagactcatttagctctagcggcatataaaacaattctgctccagtgtttcactggcatcacaaaatgaatacagctaaaattaaatgctttgttttccagaataaacgtgctccacttttaacccttttccgcttcagtaaaaagaagtaacatgcaccaagtttctgctaccagaatgtaactggtttcttcaccaattaataagagtaattaatggagatcctggcacatagcagatacctaattaatgtgtgatgaataaacaaatgaagtatacgcatgcaataaagagtgctttcttaattattatttgggcgctacaaattggaattttccaatgcttactcatttctgtgagttacaaaattatgatcagggaactactataaaatgtttaaattttataacatttcaaaacttttgacacggattgaattatcagtattattagagcctaaatgttctcagatccatgttttccagggaaggactcaatttgccatagactttaaactgaaatcttcagccctgaactactacagcttaccaataatcacatacgatcatgaacataaagcaacataaattgttcaaacctcactatacaaaataaactccccttctctgtggggaaagtttcccctcaacagaaaccacatgctagtatagttgtccaagattttaggcaaggatgcattcttattaatatttaaactggtcttttgcaagtattttccttttcctcaaacctggaatggcatgaggaaaaaatatcggtttttaaaaatcagagataatgcaacaaataggaatcatatttgtagcaatacgggcttcaaaatgattttagcaatcccagatatcatatatgatgagcactaaactctaaactgaattagcctatctgatcagcagaggctgtggcaagaaggaggcagctgcagatccctgcaggaggggtccagtggctctctgcactctatctgcatttgtattctccagaatgatcgatcccagaatactttgagtacactggcacagcagaccaggaagctgggtgggctgggctattagaagaggtacaggccttggctaggcctttggatatggttataattatgagggtttccaacaaagcattggattctggagtgcaggataagaagaatcctagctattcatttgttatttaactgtttacacacacacacacacacacacacacacacacacatatatatatacacactatataccgatgatctgatttagtcaggagataaccacctaagtccctatgtgctgtgggaaattgctttactgatcctgtaccactccactactccctttcttgttgtgtcaatgttaagagattcctgagcagattcctgagagattcctgtttcattagataatagataagactcaaattgaaatttttatctaaactcctgatttccacattacttcctgttgcactgccaggctaatagaaactctctttggaaggagactgcactataatatttattattttgtaataaaataatatttttgtactaattctactactggatataagatagaatttctgtctaatttctaattttactggaaaacacctgttctacacacagacacataaaagtcttaggagatgactgttaagttggaagttctccaaacctttaaacaggaaaacataccctcagaccagtaatatcccaggaccctagatgtcttcacattggcagacttttctgaaatgagaagaaaaagcatctgtcactgtttaatctatgaaaaaagagatgcttagaaggtatggtttccttacacacttagaacttattgcattcccagaactcacgcttttatcatactctttagcaagacatttactttaaaatattattaaaaatgaagagaaacaaatgattgatatataaaaaatacatgaaatatttaaaaacaatataaattttatacagaacaatattactttactcatgattcctatgtcttggttgggtcacgtaaccaaacataaaagtatacttgtccatttctttcatgaaaagaaatcttgttattagatcttactaaattcttctttgaatttgtatacataaattcctttttcttttccagaaggagggctcaataatctcccagttttttgcacaatatcggtcaaaagagatcaatattacatttcacaaggggatagatcagaattactcagaagcaaacttatccaaaacagatgtattatttcctcacattataaaatatgagttggacagtgttggctgtccagcagtttagagacaagatgttcagagttacgtcagaatctcatacaaatatttgtccctttgaccttggacacagtactattgtgtactgtgttgtcactagacaacctttcttcataaataggtgatttcacaatttgttgaaagataactgaagcttatttcttctagaataattattaattcacataaaagttgcttaaaaaataccaggatggtacaggattcaatattctatcaaacgtttgttgtatacatgtatctgtatgtggtgtgaactaggaggggactatcaatccaaaatgggatgttgtcccatccacttttgtagccaccagacataacttgtggctagtgacatatgttgaaataataatattttgaatatattatgttaaataaatatattattacaattatttttaccttttgtaaatgtgatattagaaaatttaatattgcatatggaactcacattgtatttcaaatagcactctgacaagtatttacttagcacactcttgcccagacacagcagaaagtccaaataaatgaatgagtaccctagcgtaaaaccactggaaaaatcaaactgtttttctgaatatagaaaagccaaatttaactttaaatcatcaagattttttctccagaataatcggaatctatagttgcatcttcttcttggtggggttgtgggagtctgctttctctatcagggaattctcacaacacatttccttaagctggaaattaggtacagctataacccctaaatataaagagtctttttcctaggatttctctctctctctctctcaaagttcttaggtgataaattgggtcacagaggcagaaaccataatttatattttgtgatatcccacagctcttctgcaaatcgaggctggaccacctgagtcagcagaatctacaaatatactcaaactttgtcctcgtgaagaattcctgagactgtgtaaaaaaaatcatgatgaggtgctgtgctctctgtatgaaatggggaagaagagagaaacaattgctttcattaaatgcaatgcacatttttaaaaatggggtcttgctctgttgcccagcctggagtgctgtggtgtgatcatagctgactgctatcttgaacacatgggctcaagagattctccagcctcagcctcccaagtagttagcactacaaatgcacactaccttgccaggctgatttttttttttaatttttgtagagatatagtctccctatgttgtccagtctgttctccaaatcctatcttcatgagatccacagccttggcctcccaaagcactgggattacaggcgggaaccacagtgccagccataaatgcacaaatacttaaagcactaaatgatgagggggtggtgacagtggtaacctttatgatagatgctttcagcaggcaagggttcatatggcttcaaacaaataccagtgctcattcaatccatgataaaatgtagctttctcttttttatcatttattgatttttgtatcaatttgggatttattacaatttcagataaagccacaaaataaaatgtttataacatggctgagtagtaattgtttatacccagttgaaaagcctagacataaaatatatttgaaaagtataattaaatcttgaaaatcattgtaagtttatgtttttaaaatagtaccaaaataatcataatacggaaggcaaagaaaatttgctatatttatttttactggagccgatgacaacacctcttggtttatatgaaatttgatttgaacctaaatataagaaatgtttgagtaggtggagaagaaaaaggagaaggaagggggtaggaattattctagtttcctcaagattctagagtgatcattccagatatgtcctggttcttgctctgggctcttgagagagaggaaggcagtgtcttctgatagaggttagggaaggtggcagctgcatgaggtcttaaaaaagcaaaattgtgaggcatatggaggttgaaaagagactcgggtaatcaaagttgcttcatctccatctcctgcagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggtaagaacccctaagccatctcacactcatccataggcaacacagattcttctaataattagttagctttatagaagttcaacaaggtttaacaacctctgggttcgtgtgcgtgtgtgtgtgtgtgtgtacatgcgcacatgcactagcaaatgaaattattgaacacataaatcagtgtctcttttgagcctcaaataccctcaactccataaaactagacaaaatatgattggcatgtattttcgcaattgttactgagttccaataagatcaggtgattgggatgtagccccaagattccacataaaatcacagagtaatgtgttttaggcaggagggcactctatttttatttttatttattttttgagaccaagtctcactctgtcgcccaggctggagtgtagtggcgtgatcttggctcactgcaacattcaccttccacaagcgattctcctgccctaccgagtagctggggctacaggagcgtgccaccacgcccggctaattttctctatttttaacagagatgaggtttcaccttgttagccaggatggtctcgatctcctgacctcgtgatctgcccgccttggcctcccaaagtgctggaattacaggcgtgagccaccgcacccggcccaggaatgcactcttaaaacaaatattaaatccaaactttggggccaagagcttttcctgatactgtggataagtctgtaaatgataccagaagtttcaaattgcaaggatctaggttagagtggaggtaaaatctcacaatataaacgaaaccggacaatttcagataatgagtgtgtgtatgtgtctatataagaataacaagagaatccaaagtaagcaaaaaggaaacatgagagagaatgttggatggggtgcgatgtttttgggttggtccagaaaagcctctgtggggagagaacacaggagttggacggcactaccggaaggaatggaatggctctgggaagatgagaatgcagcgccttcccagtagggggcgctacctgtgaaagagctgagctgaaaatgaaactggcacatgtgaggcacaacagatcagtgtgactagagattgaagcagaacagacatagtataaggatgagtatggtcaggccagaagattgattttattctaagcaacgtatgttgggttttacaaggacagtggtgtgatgcgtttataacacatgactcttgttaggaaaggagagaaaagattgagataaaaaaaagtaatataagtaacatataaaaatatacaatatattaagaagacagtgtatggtgtgtcagcagggagaaaaagtaggaacccacagccccattacaaaggaaaaaaaaaacaaaacaaaaaaacataaaactgctgtcatgactgagtaagcgctatgtgaagcaccacgacccggatgttacatatgtttcttgtttcgctcatggtaaatctaggaggtcctattaattgtgatgcttctctgactgaagttagacattgctcttttataggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtggtgagtgctgaggctgaacatctaacagttttgaaggtgtatgcagaggattgtgatgtttggtttatatttaggggaaacaatgttagaccccatccagtgcaaataaagtacattgaattatgaagaaactctacctaaggggctgatataatgagaaattgtctcatcagtggagaaatttctgtacaattttatccacggtgatagtggtgaaggaagtggtgaaggagatcatcagaatccctaaatcaaagttaaacagaaatattcaaactttgaaatggaatcatttacatgatagcttgatttgtaaatgatttacagacatgttgacattatgtggtttctgaagaatttgcacttgaaactgaagttattatgtgatacaagcaccctatttattcacaattattgaagggaaaatgagttgggagttaaggaaacttgaggggatttaagtcaatcttctctctccctctttttattcctgacttccaattacctcatgactattgggatgtatattttgttttgtttctttaagaaagcagcaataatttaactgaaaactggtaatgacatgataaattcactattaatttacacattgttgaatgacactagagacaaagcaaaatgtgtgtgtgtgtttgcatgtgtgtgggtctgtatgtatgtatgaaattagttagaaagaacactgaaaaataacaaggtgggcaattgtgatagccatgctaagtgaggcacatcagtgtataaaaagttgatgtctcttgatccaacccaaatgtccatcaatgatagatagactggacaaagaaaatgtggtacacatatcccatggaatactgtgtagccctaaaaggaatgagatcatgtcctttgcagggacatgaatgaagctggaagctatcatcctcagcaaattaacacaggaatagaaaaccaaacaccacttgttctcacttataagtgagggttgaacaatgagaatacatggacacagggaggggaatatcacacaccggggccagtcggggggtgggcgacaaggggaaggagagccttaagacaaatacttaatgcatgtgggcttaaaacctatatgataggtgcagcaaaccacaatggtacatgcgtaactatgtaacaaacctacacgttctgcatttctattctggaacttaaagtaacataaaaaaaaaagaaagttgatgtctctacagaaaaacatggggaactctgggtcagagactctccagcatccttggcactcatctcttcacagtcatctgagaacctggaggcagattctgtttgcaagatccacgaggagaaggacttcattgctttctgttcttcaacaccacgtatgtgtcttttagtaacagtcaaaaatttgggggtgctgaggccacctttgaatgattctatgaaatcaagataggccctatgcaacaatgagctgagagaatggtgtgtgctctctatatattttgcatgatcttatgtgtgctgtgagaatagattccttccccctcccacacacacattttaaaaaactgtacttttattataagtgttacactttacagtcaaaggcataccaaatattaaagcaatacaatacaaggaaccccattcgccacacaccatgtaaacatagatgatggatgctgtttttttaataaatccatttaacattttgaatagaagttttatggatcccagtactggctgtctttccaaatgatcaacttcaagccctcttctacatatatcccacttgatcctacaaagagcaatgttattaagtgtccagataaaaatgtgaatgagctttaaaaaaggtaagaaatgttagggtggagctaattaggtctaattacaggaaacagtcgtttgtatttcacctctaggtaatcatcctaaagggctttctattttactctttccaagttgtaaattttcaagtcttatttttaaaccactttatggaggcatagctgacatatgaaaactgtacatatttaatgtatgcaactcaataagtttggagattagtacacacccctaaaatcatcacccaaatctatgctgtaaacatctctcctccaaaagattcctccagctctctatttattattatcatcattctgcaagggtgtgataaggataatttacataagatctactctctgcaaatttttaagtatataagacagtattatttactattggcaccatattatacagtatttttctatattttaatcttctataactgaaactttggatgtgttcatctattttgtttattatatggtgaaagacatcatggtgcaatctgtaaacaatcttggagcccgacggtagttttttgttgcttcctcactgaacctaaaagtttattcatccttctgagcttctattctttcctttgtaaagtgaaagaattccagttatttctcaagtccccttttctaagcaaagtgaatgaacatgaggtccataataaaaagttagttccaagaatcaaaatacaatcactatgcaatctcttgcaatacttacaagctgtcttttttgttcaacctttgccagcttttctgtttcctctgtgtgaaacctaagtaaatgtttggttataagggatttccataaatctatcaagtaaattctcaagctatgcaaaaacaaaaatataaacaaaaacatagtgaaagtcgtagcccaaggcataccaggctgtatcatcatagataacgtgtcctggagagaccgcacaaggggctccatcttcattacggaactcatcacatgcttccagaaatattcttgctgctgccacctaatggaaatatttcggaaggtaagcttccatttccttttctagtcatttacttatttgctcagaaagaatttatcattattcactaatcgaataaaaatgacacagtttttcaggcaagcaaaagtagtatggcacctgatttctgtcattcaggtgtttaaaatctgctttagagaaagaaaatgtcaatatatcccagaagaagagcaaagtaaaacaaaataatatcagctataagcttcctattttgggttataacttattaaaattcagagaatagaaaatattttgaaataatttttgttaatttactaaatgaataaaaactggatggaggtgaggggcttcatcctgatgacaaaggggtaaatgaggcttgcatggcttaagactatctaggactcacacttttgtgagagatatggatactgaaaatatgggttaacaaaaaaatgtgcaattacagattgtggtagaattcataaaggcatgtaacagggaataaaaaagaaatcactctttccatgggaaagggcagaagggaaggtttgctactccttgcccaacttgggacattccttattccccatccttcctactttattttctccacagttcttacctcctcccattaagcatatattaatagtttatttatgtgtctgttttttacctgtatttactcactaatatgcaaacttcaggatggcggggatttgctcagcacctcaatatgcctgacatatagcagacattcaattaatatatattgaataaatagatgcatgaatgaatagataaatgttccttctctttttaagggaaaataggattggtattaacacaggaaagtgtggttgtttctaaattaaaaattatagagaacagtaaaactcttgtgggaaaaggaagatataccactggtgtttaaagaagattgtaccataaattgagatggggtttctgtgaatagagaactgggaagttaaatccttttggatgattaggaattagacattgtacttttgagggtattcctgggaaaagaactagaaatattggatttacggtaagcaggatctcattgatcagtccatgcataagatttcagaggtcagcatggtggtgtgggcatgaaagttgttcagtgttcaggccttaaagcaagattctgggatttaattctccttaaattgaagaatcagcgttggtgggggttgaaagtactaaatcttccatatccagttctcatgagcatatcccaaaggatatttaattgatttccacatccgtaggtcaaaaatggaaaatagagaaaatggaggttgaaaagccttgactaggcatgcagtgtttattttgatgtaaagtgtacagtatgacatggggtgtcaattctaagaggtagagtagcagtgttaaggagttggaatatccatgggcttggtcctatcaaccctggaagctctcttcattcaggcatttcctggttcatggtgtaagatgcattctgagaacccaaaatccctcatatctcatctactgttttttcttttaggtacagaaatcatttgaagttccacaggctaaagcccagatgcccaccatagaacgagcaaccttgacaagagatttctacctctttcctggcaattgaaaatgtaagaattgagagttgttggagggtgaaataaatgaaagagctatatcggtggtgaagttcaatgaccaatgacagctgactgcttatatggtcaagttagtgttctttattgatgtagtctggtgagtatttatttgctcttttttattctacttatatgcatttagtttccctcaactatataatcaatcaaagggtaaggaaaattgcagcaaaatgtaatacacaatgaaagtcctaggttagtaattattaaaataataatgtacaaatattaccattattaattatgttcatttatctctcatacactccctctctttgtctctctctctgtttctctcccacctgccacacttagttaccaaacagtgcatcagaccttgaacaaaacagagtaaacacaggagctatctatggggaaagcagggctttggtcctctgagtgcacatatcacattactgttgttgactttctccttagttcagctaaagatggggtccttgtcacacgaccatgagaaattagactcacagacaatctgaaaggtgaggagggcagggtttattgtgtgaaaaggaaaaaaatgggaaacagacccttcacagagccagagtcctgctaatgcccttcctgcctcgcagattgaataccaggtaccacccaggaagaggaggggccaggcttctccctgctgcaaatggcatgaacttcccaaggctccaccccagtgtgcattcttcccagtgcacagtctggtgggaggttctgccagggagccctttttacttggctgtctcattactgacattcagccacagttatgggactgtagaaaatacatgctcaactataggtactttattcaggaaaacctgccttgaaataatgaaattggaataaagaatgcacagagttggagagtgaatcatgtggttcttatgcaggagaggtgttccagcacagaatacaagtgcaaatgccctggggcagaaatatgctgaacaggtttaaaaagaactacaatgagatagtgtgaccaaaagagaatgcaagtgagggaactgacagagacaaattaggagaaacagtgaggagcctcatcacaatgtgcttgaacatcacatggtaaatctttaaaaaaatattatctgagtagataggaaacccttccagtgctttggaaaagagaagtgacataatttaacttaggttttacaaagatattcctgagtacttttcactaaatagacacagaggtcacagatggaagtcgagggaaatggcaaaagcatatggcagaagatggaagaagaatcataatgaaggatgggatgaaggcagtgaggggtaaccatcttgaccttctgtcctttctctcttctgcaggaaaccacaggcagcccagccctcctctgtcaacatcaaagagcacatttaccagtatagcttgcatagtcaatatttggtatttcaataaaagtaaagactgtatctttttagattgtatgaactgtatctttttagattctctaatagacaatataatttcaatgaaaatggtggacgagtgaaaatgaagtggaagaaactaactagattttcgagttttatggctcatgtaacatctatacttggctgatgaagacgactggctgtgacttaccgccaacaatagaatgaaagaagatggtgttaaaagtataagataccacctcatacccattagaatgactcccatcaaaacatacaaacaaacacaaaataacaggtgtttgcagggatgtagaataatcggaaccctgtgctctgttggtgacaatgtcaaatggcaccactgtggaaaacagtatggaagttcctcacaaaattaaagctagaattatcataggatccagaaactccacctttgggtacatccctaaaataattgaaagcagggtctcaaagatacacttatacacccatattcatggcaacgttgttcatgatatctaaaatg

SEQ ID NO: 817 - DNA, 49677 bp, Human
caaagtgctgagattgcaggtgtgagccactacacccggcctcgtttagacttcattgacattcccccaccccacccctcttcccacatcctcagatgccgtgtgaacagcttgaatcccacactccacaggtccttctcctcacaaccctccatggcaccctactgccttcaaaataattcccaaagtccccaccaagaccttcaagacaccatgtgatgggcccacctttgaaacatcatctcttaccagtataggtgtcaccactgcctttatgactttattccaaagcaccacatgtattcccacctcagcacctttgcacatgctgttcctttggcctggaatgctcttccctcagacgttatagcacctggatccttcttgtcatggagggttctaagctcacatgttagttccgcagaggtgtccttcctgagccctggatctaagacatccccttccagctctccatcccgtaactgttttgtcattgtcatagctgatcccacttgcttattcgtgccttatgtccccccactagaatatcagctccacgcaggcagggatatctgtgttgttcactgctgtgttcccagcgcctagaacagtgcctggaaatgtgcggaaagcagatttttgtggcctttttcttcaaggtcattggacaccaggaatcctgtagcagaccgctcccttcccccatctactcggagtctggaaatccccaccttctggggaaccccttcctgtagttctaaggtcaggactggggccgatttgtttaacacagagagcttcctggagccaagcctcgagctaactgctttaatgcattaactcacttaattctcactgccaggagagtgggtacacattatttccatttcataggcaaggaagtggagaggtacggagaagtcaagtcatttgcccgggtaggaagagggggaggcagtggaatggagacacttgctgcctgggaagactcgaggtggcccctccaagctgggggcgtgggcgacttgtttcctgttgggggagggggagaagagtacattcctccctccccgccctcccacatgttgggggagaggctggctgagagcatgtcccactccggactagggggaaccccactgtccgtctcagctccccatgaggccgtggagaaaatgtaagtagcccgggggcgggcaggggggtgggcgcagaggccacggaagccagcggtcggagagggcttcctggagaaagatgcacccctcctagaattgggggacaggacgggcggccggagcgaggctgggctatacgggcaccggctgtagcaaaggcaaagctgagggctggggccagaacccaaatcgggggcctggggccgtggcgggtcgggtcagcatgatcgcagatagtcagggtcgggcagggctgggctccctccctggggcgatgatgaaagccgtggtcgctattgcaccgcccagccctgcgggcactgataaggccctgcaggagggagtcagcaagggcgcgccccctggaggccaggcccctcgaccctgcccgccctaggccccgccccttcatctggccccgcctccaggcgctgaggcacctggtgacctgccggcgttgagtgggtggggctaaagtcgccccgcccctccgatcctcacttctatcttcagactgtgggacgcgaaatcgggtgggcacgtggtgggcgtggcttcgcaaggcctcgcctttttccggacccgcgccaggagagccctccgaccctggcagccgcggactagcgggattggtaggcggggccagtccgggctccgccctcatggcccgcccctccagccgaatctccgactcgcgcgcggcctgaggcgtggctcctggtggccccgcccctgccccgcccctgtcgcggccggcctcccccgccgggctccgctcgcacggccggttcctctttacataacggcgcggggcggcatgggcccgggccaccgcctccgcccggctgcccgcccggactgtcgcggcccgcggtggcgacggcggccgctgcaaagtttccccggcggcggcggcccgggggcgcatcctcccgcaactgtcaagcgctggcggcggaaatgatgaggcgctggccattttccgagcccgggtttcctgcctgagccccgctcgagcgagccgcgagcgaggagccggcgggcgggagaggacgcgcccagggcgggggcccgcccgccccctcgggatttcgagggcccgggggcgcgcgacgccatgggccggccgggcccagagctcctgtctctcaggtgagcccgcgtttgcccgcgctcccctcctccggggccgggagggcttttgtggggaaagaggaggccccgtgtccagttctgcccgggctctgcgcgtcacccccagcccaaaatactgccctgcagccaactcggatggaggcgttccggggtgacggctcccagcgcctacgaccccccactcagccactacccccacccacacacgtgttagggagagcgttggggtaactgaggccgtgggatgggggagagggcatcgctgacgcccccagcccaccctacggtagcctcgccggttgggggcggccctcccctcaacttgtgcctggggaggagcggtcaggggtcacccattgctaccctgaaagtgaaagtagtcaaactgaggctgtgagcacagatgagcccttgggtgtgggggcagcgggggaggatgcgccggcccctccccactccccattccgggccatgtggctaagagggtagcgccctgattcaggaagcccctctccccagttcctgcactgccgaggtcgaccgggccaggcccccgcatgctgctgaattgggcggttcaccagggctaggcgtcccagagacaggtttctggtattgatcctctcacacctcttgcctggggttccctgggaatcccccgaccaaaaaacgtctggagtgggtgttggtcttctagatccgcacggtagggatggtatttcagaggtctctgatgcctggtgcagaaatccccttccctcccttccctccctccggccaggggagctttgttttgagggagggggactgcatttgaggaactggagaggagggtctgcctgcctgtcccgcttctttttttctttagtttcctcattctcctgtttctcttccccattcccagccacaatgatgtaggtgaggaggtcactgcctgcagctgggggcctccagggaggggcacggccaggctgggctgagtgggaggaagtgaaatctggtggggggttcagagcagaggccccggcaaggcaatgtcggcaaggccagctttggtggcaggagggaccgagatctgacccgcagcccctcgccggggagatgacagttccctaacaccggctagcagccaggcctcagggcccctgccagggcagtgggcctgtgggtctccagggatgcaggcgcaggttgtgtctgggtttcccatcactgacctggctgcctgagtggaaacagctctggaggctcctcgggacctgccctcgtggagggagagccgtcagaggccacctgggcaggctgggctcggaggatgagagccagggcctactgggggaagttggaagggtttttagtgcacttttcctgagccttttcccactaccccctctgggagggaaaatccttctgagccaaagggtgagcattcctagaacttttgtgagtccctgtgggccacagagcggccagctgggaaggggctggctcagagcatcagcagctgggggctcagggtctgcaggggctcagcaggaagtggaggaggatagtgaggagggtcctggagactgtgctttgctactcctattgccttcgttcagctgaaggcgtgggcaagtgactctgccctcagtttccctctgtgtaaaatgggggagtaacaggtttgcagtggagatttaatgagccagtgtgtaatgagcacctgctgcctggcaaagagaggttcagttgcaggtggtggtggtggtagtggtgattttatcattgccttcattagtgttactgttattggctatgaggtgttccttcagtagtctcccttgagcatctcttgcatacatagcactggaatttcctgggtctttgggagcagaattttgaagatctgggcacttccttagctataaggccttgcttaactgccccacctcagtttcctcatctgtgaaatgggtgtgctaatagtacctacttcctagagtcatgggaaccatgaatgagtgaattcacagtgtccagagtggcttggtcaggaggaagagaagaagtagccttggggccggaatgatcttttttgttgtgggtgttagctctgctggctttctttcctcatccccccacccccacccccatgcctctcaaacctgggcctgatcctccttctccgataaatagaacttttgagtacaaatcagatcccacaggactgctgggcccttggatttctggctcccgctgtgccacccccagacattctccatatcccaggtggagcagagctggaggcacttggagggacctcctcgctgccagtctcagtgccacctgtctgtggtgaggggagaccgggtgccctccccagccaaggtggggagggtcagtgaagggggtctcagggacatagtagggagctgtcccacagtctgggccaatacagctccttttgctggaaacacctttgggacccagtttacatgaccccacacccttctgagggctggtgttcatgagggtctcccattgctggggatccttgggttgatcacttaagctctctgaggcaattgagacaacatctgtgaaaggctttaacagctgtgcacttgctgtgacatggcacataaggcactgagcgctgagcctggcactcaattaacaatagtagatattattgctattaataaaacaagaggcttttcctgctaaattcccacttctccctggtagcagtatggactttggggccaaatctgggctctgccagcttccaggtgtgaggtcctaggcaggttacctggcttctctgatctggacctcgcctgcccgatggaagccaagagttccagcctccccagggttgggtgtgtgaagtacagtgtcaggactggaactgtgttggctgtacttgctctggctgtgtgatcttgggctggtcccttagcctctctgagccacaggtctttttgtctatgaaataggggggttgccaactccctgttagggtggttttgagaaaaggaggcatgcacagtgcccggcatgcaattggcactcaataagtgcaagccattgctgttcatgcccaataggggctggcacttaattgccaggtttcctgggaaaacggtccccaagggcccgcgggcgttcagcatctttgacgaggcagggcaggaagccgctgccgtctggcagaccggagacgcctgcctcggcgagtccagaggtgcagtgctagctgctcattccctgcaaggccccattcctcactacccacccttcccaaggaaactgaggcgggcaggctgcccaggggaagtgactcagccggggtcacttgctgagtcaggccttattggacccaggagtcctgcaccccacctccccagcttcccggggcttgagatcccttggagactgagcaggtcctgaggcctggcagcaggaccaggccaccactggacatctgctcaatggggccctgctgccggggtgacaagcatccctctaccagggctccagggttctgctggccaccactagccatccttcctcccagcaggggcagaggacacttccccaggggaacaggtcctcctggtgcccccccactccccgccccagccggaaacccggcagctgagcagttagatagaagatttttcctcccacgccaccctgtcaggggtcggccagcagggccgggccacaggcttccttgtgagccaggcctggagcccctgggggcccacccggatgtggctaccccccggctggccagtggggagccggctgctgcccaggacatgtgtccccagggaggcctgggaggaaggaagtctatgccctcctcacaggggctgactcacaggcgcccaatggggggccccagctgggagactgggaatgtgatcaatcagggaggtggacacacaaggggacctctgacatgggatctgccctttcagagctcacacactggtgtcatctcaaggaggagaggcccagagagggcagtgtatgctgcgagaggcgaggtaattgagggcttacgcatgtccctcctgatgtccccaagtagcacgtggggaggaggttcacccacaggctgccctcctagggtctcccctgtctgccctcaacccagaggcagtgaaaggaagaagccacggccttgggatggggggcgtgcgggattctgatggtgctgcctctccgcagggagatggttcttggctttccctacctcctgaaacctagctggggcggtggctgggatgtcaggctggcggtgtgggcagaggaagccagaggacatttcctgttctggcagactgtgctggcctgataaatgtccccggggcacaaggtgaccccagcaagggtgcatcagtgtccagccagctgccccgtggcctggggtagaacccacctctctgcctccccagggaccctgccttcgccccctgcttcccgtgggcatctctgcgtctggcaacttgaatgctgtgaaagggcagcaggccgcctgccaggcagtgtgtgtcagaatcccacaactctctgggcctccttaggccacagggtctggactctatgaacagttggtgctaggcatggggaagatagaaatgttccttgtggcctagattcaaccaggaggcctccctggaggaagtgtcccctctgaaggtgtgagacttcctgcctatatctgtgagctggggcaggggagagtggaggctctggactggcccaatttaacttcatttaccacactttaagaaatcttccccaggctgggagcagtggttcacacttgtaatcccagcactttggaaggtcaaggtgggaggatcacttgagcccaggagtttgaaaccagcctgggcagcatagtgagaccctgtctctaccaaaaaaaaaaaaaaaaaactgggtatggtggcacatggctgtggtcccagatacttggaaggactgcttaaacccacaaggtcatggttgcagtgagctgtgatcatgccactacactccagcctgggtgacagtcagacctgtctcaaagaaagaaaaaaaaaaaaaaatcctccccaagcctcagcaggggaattcctaccatggataaaggctttctctgcatgtgggcctgatcattaaaaggaaaatttcagcctcccgaattatactattatccagggtgattagatagaggagaggctgagaagccctgatctcagcggggcatggattaaggggaccccacagctcagccaggttcccagcgattcaaggtcctgcgatttctcaccgacttggtggctccagggtgcctggggctggctgtgcttcttggggagcaccaggtaccactgctgcttcgaggccctcaatagccctttggtggacccggttgtgttctgagcttggggtcctgagatgcagacaccccccagccccagctggtgggcgtgcagctagctgccttcatgtatttgctgcagggagggaattgggggtgggggacaaggatgcaccaggctgagttattccttctgcacatcatcctgcccctcacctggctgcaggatttggggaaaccctggagacccccatagctgggaggttcctgccccagaaggaagcctgagcaggtgaggggggtctcctgggtgctagggcccctctgtggggaaggtggtttatttctctggctgaccaggctcccccgaagctctgtgctgggatagaagtgtcccaaagacaccctgcccccaactcataccctacagtcgaagcctgagggccccaggtccccctggcgtgatcatcattgcttcctgtccacagcttgtcagcccctgatcccagggttgtcaccatctgatcaattgctttttctctgagcctggcacatagtaagcactcaataaacgccactgcctgggccagggtcagggagggatccaccttcctgtggcctggctgccctcctggccaaaaaacctccctggtacagtcccttccatagcttgggctacagctgactgctctgggctggcaacttcctgcccggagcagcctgagcagccgcctctcccctgagaagatcttttgttccagctccccatgacgccccgagcccagcccatgaggcaggcccccctgtggcttcccatggcgggcgagcctgactccgaggctggagctcttttctaacagtgatagtaagaaaatagcagcagccacttatgagccccatgccaagcacactgcagacatcagttctttttttcttatagagatatggtctgcttctgtcactcaggctggagtgcagtggtgtgatcacagctcactgcagcctcgacctcctgggctcaagcagtcttcccgcctcagcctcctgagtagctgggactacaggcccagccaccatgccaggctaatttttttgtatttatagtagacatagggtttcatcatgttgcccagcttggtctcgaactctggggctcaagcaatcctcccgccttggcctcccgaggtattgagattataggtgtgagccactgagcccagcctctcatttttgttttcttccttttgccctgtgacagttttcctgatcattggtgggtttgggacctggacagagctactgccgactcctgactccagctggagctgaatgagacttttatattctctcctctgggactcactcattcatccaataagcattcattgggaagtgagcccttcttgtgtgcatttaggcactgatcagacattttgggggtcccttctgtgtgggggtctctataatcactagctatggggccgctctgtttcagcttccccatctgtaaaatggaagtaatcgttggacctacctcctagggctgttaggaaccttggaagaggtaatattttgtaaaagtagttagaaaaatgcctgatatgatcttggcatggtgccatgagcctgtagttacagctactctggaggctgaggcaggaggatctcttgagcccaggagttcgaggcagcagtgagctatgattgtgccactgcactccagcctggaagacagagtgagaccctgtctctaaaaagagaaagaaaaatgtctgatgtgtagcagacgctcagtaaatgccattgttcttatgggaggactggtggaaggggcccaatgaggggggttcccagccgttgcctgggcagtgagggacctggagtgggcgcagctgttttgaggaaggctcctgccagggtttggccctgcagttgggcttcaagactctgacatacaggactgtgcggaaggtaggacggcccagggggcgggggaggttggttcatgctggttgccacgcatctgccgggagagcaagagtttgcaaatccaactgatctcttgcattcatatgttcattcattcaagaggcattcattgagctcctgctgtatgctaggagctggagatgaagcagggaatgactcatggaactcagtctgttggagagatagtcactaataaaagcatcctgtcaagtgataatgtgtgaccagtgtgctgaaggtcaagttcagttgggagctcagaagaggcttctcttatgtgcaattggaagcagacagggcagagggaatggctcatgccaacacccacaggcagctggcgtgactagcggcagatcgtgtaggtggggcaggagcctgggtctggaatcacagctctctgggcatcctccaagccacgagggcagcgcctgtctcacctgtgtcaaggctgggtgtggggaacagtaggattgaccaagaacaggtgcccttatgcaggggttagaccctccccccttcagggacaggaagaacatggtggccaagggcagatgtggcccctccctctcccttcccatctgcctgacagcttttagtgactacttactgtgtgcaaagtacctactgtgtgcgggtcccaaggaccctgtgatgtacaaaactgtcgactgtagcagggcacggtggctcatgcctgtaatcccagcactttgggaggccaaggtgggagggctgcttgagcccaggagtttgagaccagcctaggcaacatagtgagaccccatctctacaaaaaatacaaaaattaaccaggtgtcgtggtgtgtgcctgtagtcttagcactttgggaggccaagatgaggatagcttgagcctgggaggtctaggctgcggtgagccatgattatgccactgcactccagcctgggtgacagaacaagaccctgtctcaaaaaaaaaaaaaaacattgtcgactctgcatggcccccttccatcgagggcagaggcacctacttgtgctttttggggtttcttgtggagatcggctgtgggggttccaccatggcctcatgtgacaggggcaccctttgttgccactgccctgcagacatgcccagcgggacatggccacatgcagagacggtgcctgtggaggggtgtgtggcagagagaaccccatttgtaggttcgcatctccaccttgcattccctttcatgggttccttacaaggtggatgccatgctgccacctggttggcagatgaggaaatccaggttcagagaggttgagtcaggcatcaggagccacacagccaatacgtgtccccctttgtaatgtgagccctgggagagcagtgttcgtctgtgctgttcaccgtggtatctcagggcctagcctggtgtctggcacacagtaggccctcagtaacacctgaagagaggatgaaggagggcgtgattggaggcagcaaatgtacccaggcccctgtggctctgtagcttgtgttgtgcagccactacccctgcccagggagggagtcactggagtggcactgctgttcattcagggtgtgctgatatcagggatctggggcccagttttgtgcctgagtagggagagcatttcttctccatcttgaagagcgacatggatatgtggtctccagcaggggcccaggcccagcgagggtcaggaggaaggaaggatggtgcccacagaggtcccaactgttctgcaccgtggacagcagaggggtggggggtctcagtgccattctggtgatgttgtgcctaaggaaaggccctctggccatgggaggagaaggatgccccagttgagatgggcaggcaaaggtctgctagtcctgagggtcccctgtcagtgcaggaaatccctctggacccccgtgacttttgttaatttattcctttttattttttgttttatatttatttttgtttttgtttttgtgtgtgtgattttttttttttttttttccaggacagagtctcgctctgtcacccaggctggaatgcagtggcatgatctcagctcgttgcaacctctgcctcccaggttcaagtgattctcctgcctcaccctcccgagtagctggcattacaggcacacaccaccacacccagctaatttttgtatttttagtagaggcgaggtttcaccatgttggccaggctggtttcgaattcctgacctcaggtgatccacccacctaagcctcccagagtgctgggattacaggtatgagcagctgcccccggcccatttatttatgtatttatttatttatttatttatttagagacggagtctcgctctgttgcccaggctggagtccagtggcgtgatctcggctcactgcaagctccgcctcccgggttcatgccattctcctgcctcagcctccccagtagctgggactacaggtgcctgccaccaccccccgctaatttttttgtatttttactagagatggggtttcaccgtgttagccaggatagtcttgatctcctgacctcgtgatctgcctgcctcggcctcccaaagtgctgggattacaggcgtgagccaccgtgcccggccctatgtttattttttagacaccaataatatactctcaccgcaacatggaaataacaacaatgtcagccagtctttatgaagcattttctacgttctagggctttacagctatcaattcatgctcataatatgcctatgaagtaggcatgatcatggttcccctcttacagatggagaaactgaggtagagagtaatcatgtaagtcacttaaggtcccataactaataagttgttgctggttttttttttgtttttttgttttttgttttgagacggggtcttgctctatcacccaggctggagtgcagtggcaccatctcagctcactgcaacctccacctcctggattcaagcatttctcctgccccagcctcccaagtagctgggactacaggcgcccgccaccacagccggctaatttttgtatttttagtagagatggggtttcaccacgttggccaggctggtctctaactcctgacctcaagtaatccacctgcctcggcctcccagagtgctgggattacaggcatgagccaccgcgcgtggctggtgctgggatttgaacccacattccagaatctgtgttcttagccatccttgctagagataagcagtaacaggcttcttggttacttccccaccatccccacatcccaattctgattcctccccagaggtacccactgtttcaggatgagtttgcttctgccagacctttcttgcccaccatttacaaaatgtttgtgtacacataaacattagtagtttggttttatgtatgttcatgtaaatgggattgtctagggtgtcttgttctgccgtttgctttttcgcttagtgaatagccctggagctctcccagaggtggtggggtgggtcttcctcactctttccccctgatgcagtcttccagcctatagatgggccagattctttcactagtctccagctggtgggcatttaggttgtttctagtttttccccattataaacgttttagcaggaaatatgtagcagggagcaagtatttctcttgaatacttaaaagtgggattcctagagcctgattgctctggctaggactgtcagtactgtgttaaatagaagtgaccagagtgggcatccttttctcatccctggccttaaaggaaaagttgtcaacttttcaccattaagtacaatgttaactgtgtgcttgtcatatagggcctttattttatttatttatttatttatttatttattttttgagacagagtcattctgttgcctgggctggcgttcaatggctgatcatggcttactgcagccttgacttcctcaggctcccaagtagttaggactacaggtgcacgtgctgcaatgccaactcatttttgtgttggtttttttggagagatgggctttcaccatgttgcccaggctggtctcaaactcctgggctcaagtgatcctcctgcctcagcctcccaaagtgctgggattacaggcctgagcctccgacctcagcctttatatagggccttcagtgtgttgaggtacaacataccatctatgcttaatttgttgaaaatttttatcataaagatatgttgaattttgtcaaatactctctctgcatctatcgaaatgatcatatggtttttgtacttcaaaagcaggattccagagtctagaatcaattctgccaaattggccatgccccttacagaatgccacttggtaggggagtgcatgtttccctgcatcttcaccagcactgggtgttatggtcgcgttggatttctgctgtggtgcccggtgtgtaatggggcctacacctgcttgcccacctgcttactccttgtcgcccccccacccacgtgtctttcagcccggccgcaccacctgggtctccgccatgaacgggcctgccctgcagccctcctcgccctcttccgcgccctcagcctccccggcggcggccccgcggggctggagcgagttctgtgagttgcacgccgtagcggcggcccgggagctggcccgccagtactggctgttcgcccgggagcatccgcagcacgcgccgctgcgcgccgagctggtgtcgctgcagttcaccgacctcttccagcgctacttctgccgcgaggtgcgcgacggacgggcgccgggccgcgactaccgggacacaggccgtgggcccccagccaaggccgaggcgtccccggagccaggccccggccccgccgcccctggcctgcccaaggcccgcagctctgaggagctggccccgccgcggccgcccgggccctgctccttccagcactttcgccgcagcctccgccacatcttccgccgccgctcggccggggagctgccagcggcccacaccgctgccgcccccgggacccccggagaggctgctgagacccccgcccggcctggcctggccaagaagttcctgccctggagcctggcccgggagccgccacccgaggcgctgaaggaggcggtgctgcgctacagcctggccgacgaggcctccatggacagcggggcacgctggcagcgcgggaggctggcgctgcgccgggccccgggccccgatggccccgaccgcgtgctggagctcttcgacccacccaaggtaagtaagccctgcccgcggggttgcgcactgcactgcgcccttcgccttcaccctggggagagcgcgggctggggaggtgtgatggctttccagctggtggccacagagtgtccagagggaactaggccctcttaaaaaagaacttttaggccgagtgcaatggcttatgcctgtaatcccagcactttgggaggccgaggcaggaggatcgcttgagcccaggacttcgagaccagcttgggcaacttagcgagaccctatctctataaaaaattagccaggtgtggtggtacgtgcctgtggtcccagctgttcgggagactgagaagggaggatgacttgagcccaggaggtggaggctacagtgagccgtgatcatgccaacacactccaggcctgggtgacggagtaagaccctgtctctaaataaatacaataaaaaagaactttttattttagaattttagatttacaggccaggtgcagtgggtcacgcctgtaaccccagcactttgggaggccaaggtgggcagatcatttgaggccaggggttcaagaccagtctggccaacatagtgaaaccctgtctctactaaaaatataaaaaattagctgagcacagtggcgcacgcctgtaatcccggctacttgggaggctgagtcaggagaatcacttgaacctgggagggaaagttacagtgaactaagattgcaccactgtattccagccttggtgacagagtgagactctgtctcaaaaaaaaaaaaaatgtttagacttacaggaaagttgcaaagatagtagtgttcctttacacatggtacccagcttcaccgaaggttcacatcttacgctgctgtgtacattggttgtagctaaggaaccagcacgggtacatcactattagctaaacgccactgttcctttggctttgccagttttcctctaatgtcccttttctgttccagctcgccccccaggataccacatgaggtttagtcgttacgtctccttaggcgcctcttggctgtaacagtttccaaccctctattgctgatagccttggcagttttgaggagtaccagtcaaggattttgtacaatgtccagggacacctttttgccttcacatttgggtgtcatgtgggctggtagcaggtcactctgagatccttgaaaactctgactcagactggcattgacagattggtgttttatttccagagggctcaaaaccttcagagaatttctctgcacctcctgtgccttggtgatattttgcaagttaaaaagaatttgtcctttggcaaaaccccattgctacaaaaaataccaaaattagctgggcgtggtggtgtacgcctgtggtcccagctactctggaggctatggtgggaagatcgcttgagcccagaagaccaaggctgcagtaagccaagatcgcaccacagcactacagcctgggtgacagagcgagaccctgtctcaaaaaaaaaaaaaaaaaaaaaaaagttcttttccttcacagctggcttaattcctactgtgctgttgaggctgaaaggtcactgtgttctactcacctgccaggctccatctttgactcaggtatgcatgacaggaccatatggctttcatctaattgctctctctttgggatcctgttacgtggtagggccttactctagagcatgagcaaaaccgatgtgatactggccctgaggggctcacgatgtgggtggaggaaacctatggttactctttcattcattcgacagatatttatggagcacctactatgtgttaggcacatgctaggttctgggggaccaggcgggcctagtggaggctgttgaggaaataaacccacagatgagcatggaattaaaaatggtaaattgtgttctaaaactggtaaactgtgttctaaaggaaaagcaatggggtctctgggaggataactgaggggtcccggtttggcggtttgggagagtcatccaagaatcctttgaagtaacgttttcaaactgactgtggcgtaacatgcagacctggaagtgcgtgaagtatgagacacatctgaagctctgtgtttccgtgtgtgtgcaacgcaagtgaccagcaccccagagggctccttcatgcctcccccaggccagtgccctgtacccccatacataccacctcttatcaccacaggttcgatttctctgttcttgaacatcatgtgaatggaatcacacagtaggttgcctttgttttattttattattttattttgagacagggtctcactgtgtcacctaggctggagtgcagtggtgtgatcatggctcgctgtagcctcaacctcccagcctcaggttatttttgtgcctcagcctccccagtagctgggatcaccgtcacgtgccaccactcccagctaataaataggttgccttttatttctggctccttttgcccagcataatgttttagagattgatcacattgatcgtacatgtcaatagtgtcttccttttttttttttttttttttttttttgagacaaggtctcgctctgtcacccagctggagtgcagtggctcgatctcagcttactgcatcctctgcctcttgtcctcctgggctcaagcagtcctcccacctcagcctcccgagtaactgggaccacaggcacgtgccaccacacctggctaatttttgtattttttgtggagatgggatttcaccatgttgtcaaggctggtctcgaactcctgggctcaaatggtccccccacttcggcctcccaaagtgctatgattactggcatgagccaccacgcccagccgggtttgtttcttttgagtactgaatagattccattgcacagctgtctccatgtcccacaactggtttatcccatcctctgttgatgaatatttgggttgtttctattttgatttatgaataaggctgttatgaagtttgcatctaagtctaaatatggacacacatcctttcatttctctcaggtggattcctagaagtggcattgctcagtcatagagtaggtacatgtttactttagagaaattgccagacttttcccaaagcagctgcaccattttgtgtcccaccggcagtgggcgagagttccgggtggttccacttccccaccaacacttgagcacttggtgggtttttttgtgttttgttttgtttttgttttgagacggagtctcgctctgttgcccaggctggagtgcagaggcacaatctcggctcactgcaacctccgtctcctgggttcaagctgattctcctgccttagcctcccaaatagctgggattataggcgcgtgccaccacacccagctgatttttgtatttttagtagaaatggggtttcaccatgttagccaggcacttggtgttaagagtcaccggtggctgcgttcctggatctcaaggtggctttactttgcgtttccctgatgactcatggaggttaagcaccttttcatatgttgattggtcatcggaatttggtcgtttgtgaagtacatgtttttattgtctgtctagccttttttaaattgatttgtaaaagtcgttatatattttggacaatttctttgcgttttaaaagtcatttcctacctttatggcctggcttttcatgaaaagcagttttgttttttttttttcttgagatggagtctcactctgttgcccaggctggagtgcagtggcgcaatctcggctcactgcaacctctgcctcctgggttcaagtgattctcctgcctcagcctcccgagtagctgggattacaggcgcatgctaccacgcctggctaattttttgtatttttagtagagatgggttttcgccatgttggccaggctggtcttgaactcctgacctcgtgatccacctgcctcagcctcccaaagtactgggattacaggcgtgagctacctcacctggcctcaatttttgtatttttagtagagatggggtttcaccatgttggccaggctggtcttgaactcctgacctcaggtgatctgtccgcctcggcctcccaaagtgctgggattacaggtgcgagccaccacgcctggccaggaggtcacttactttcattctaagtaaatcactgggccttccaggcagagggaacagcatgggcagagaccctgagtggggaatgtgtttagcatgttttgaagaaaggacaagatgaagaggccggtgtggtgggagcagagagagggagatggggagcggggaagtacatgtgggtggaggacactgggaacgggaggacttagtgttttattccaagcacaatcagaagctgttgggaaaacgcaagcacagataaaaaacggttttctcatcatttgttaaaaatctcaaggctgtgacaccatgaaagacaaataacggccccaatacatgatcttatctgtgtgacactgtagggtttttatttttttattttttatttttttgagacagagtcttgctctgttgcccaggctggagtgcagtggcacggtgtcagctcactgccagctccgcctcccgggttcatgccattctcctgcctcagcctcccgggtagctgggactacaggtgcccgccaccacacctggctaatttttttgtatttttagtagagatggggtttcaccgtgttagcccggatggtttcgatctcctgacctcgttatctgcccgcctcagcctcccaaagtgccgggattacaggcgtgagccactgcgcccgtccagggttcttaactttgaaaaacaacctcagtggctgggcgcagtggctcatgccagtaatcccagcacttagggagaccaaggcagattacctgagattgggagttcgagaccagcctggccaacatggtgaaaccccatctctactaaaaaatatcttggtggccaagcgtgtggctcatgcctataatcccagcactttgggaggctgaggcaggtggatcacctgaggtcaggagctcgagaccagcctgaccaacatggtgaaaccccgtctctactgaaaatacaaaatcagcctggtgtggtggcacatgcctgtaatcccagctactacggaggctgaggcaggagaatcacttgaacccaggaggcggaggttgcagtgagctgagatcgtgctactgcactctagcctgggtgacaagagcgaaactccatctcaaaaaaaataagtgaatatataaaaaataaaaataatcttggaagaccaggtgttgggagccagctggccctgggtttgaataatgaataagctgctttctcagctctggggcaagtggtatcacctttctgagactcagtttccccctctgtacattggggagtactcatagttcctaccccatagggctgtgtgtcttggtggggagagcgcatgtgccacgtgcctggcgctgggagcactccatgagtgctgtgttgctgttgccacggttgttgtggtttgttatggttttgacttcgggcggagagcccaggtttatttccagtgcttgctgggccctcaggggaaggcatccccaagactcctgttctctgggagccctgatggtagggccccatcagattccctagggcttttcccaatccagggaaccagggaggtcccagagggctttgccgtagccctggctggctggggctctgtcacaggcttggtggttgctgcggggcctggggtgttgcctgcaaagcaagcagccctggggaggcttctcctagcccctcggagcatcaggtggaacagtccgggcggctcaggagcatcccctcagtgaatctgtgtccaggtgatgggccaagggtgctcagaccacaactcttgcatgtgcttgccaggtagtcaactgtgatccctgacctctgacccaggggttggctctgggaacagttttaaacaaaaggaaaagaaagttctgacaaccagtgggtggtggcgaagggcttaagctttggatctgcacttgcggtctgtcacttaaagggtgccctgcaggagagggagcagatgtaatcccagtgccagcctggtggaggccctgctgcccagggctggaagaggctttggagggagagagccaagagaaggcagctgcccagaagtctgaggccaggtgggctcagcccacaggtgagcctcacctgcagttgggccccagctctgcccccgacctgctgtgtgaccgcgggcctgtggagcagggtgatggtgtagcacctccaggggcactatgagggctgcgctgggagagagcactctgtgactgggggtgtgcaaggggaggccacagtctgccaggggtgggggtgtgggtggaggagatgtctgtgttttccaaggtcaggagaaggggagaaaagtcccagctttctctggtctcagtggccactgcaggtgggcagcgtgggcccttgggaggtgggagggggctgccttccctggggttggtcagcaaaggcctcttggcaggaggtgccggtcctgatagatctgggtgaaggagtcccaggctgaggaatggcaggttcacaagccctgcagtgagcgtgaaccaggcaagtctgtggaatagccaggcagcctggggttcgagggaacagggaaaggtgagactacaaaggtagtggagctggattgcagaggcccttgtgggccacagtggggactttaggttttacattaagagcagtgggaacaattggaggatttaggcctagagggcctgagacacttgctggggccacctgcgggtgggagtgggtgcaagggaccctccaggctacctgtggtctcccagctcaggcccgcgatgggagagtatgacatgatttcctctagagacctccttcccctgggcaccgctgagccccaggcagggcaaggacaggggagcagtgtgtttatgtgggggaaaggtgacatgcctttcatcacccatcatcgggctcacgaccgacactcttgcaacaagacaggtcagcaagagaaaagcatcacaaagttattgaatcaaagttttatgtgacatgtagctttcaggaatgaagaccgaaagaccccaggaaatggtctgtctggtgtttaggtttgatggagcagggatagctgcgtaaaaatgggattgggatgaaagggtgtgatctactgagctagacggaggcggggtcccagcaaggcctgcttgctcccattcctcttggcctctgcatggtgttccttcctcccagtgtagggcaggacctctctggaacttacaacctgcctccctcagacaaggtaggttggagaatttctctgtggatggctcctacccaggaaggtaggggaaggttagagttatatttctaggttttatggctggctttcagggagaggggttctagattctatgacccaccttgaggaagaattctggttccgtttttcttttatctttttttttttttttttgttaagagagatggggatttgctatgttgcccaggctggcctcaaactcctggccctaagtgatcctgctgcctcggcctcccagtgttgggattacaggcgtgagccactgtgcccagccgcctagtttctatgactcacttcaggggagaaggagggtgagagagacaggaaggcagaaggaggtgagagagactttgcttctgagggccccttctgagcccttctagtcttctttagttcaagtacgtagcatgccacagcacctttctttggggtgttgttttctgagccccaacattcatggccctgaatgtgtgcctctgtgtgccaggtgttgccctaaattcttggaccttcccatgagctggagttcactgacccatttgacagatgaggaaactgaggcactgggagaagcaaagagacttgcctgggatcatgaagtgaaggggatctgaaccctgagacaggaactcttgatcccaaggggcccctaaccccaagcccttggccccctgctgaactggttcaaaccagagagtgtataacccagctccaggctgggctgggcctgaggtgtgcgtctcacctggcagttacaagaaaaggaaattgcactggttgccacatttacaacctaaagtggagagatttcacagaatccagacttctggtttctcttatggaatccggggatcggccgggcacggtggctcatacctgtaatcccaggactttgggaggcgaaggcagatggatcacttgaagtcaggagttcaagagcagcctggccaacatagtgaaacccagtctctactaaaaatacaaaaattagctggccacagtgacgtgtgcctataatcccagctactcgggaggctgaggcaggagaatcacttgagcccaggaggtggaggttgcagtgagctgagattgcaccgttgcactccagcctgggcgacagagcaagactccatctcaggaaaaaaaaaaaaaaaaaaaaaaaaaaaaaatcagaggatctggcggtgccaggccggcattggagggggtcccagcctggcctgtgctgccactggttcagcagtagagcctgacggggaggcgacagcagtgggggccctggggaaggagaaagattccagaagcagctgctaggctggagtagctggccttgggccccagaccttcccggggaggtggggctcccatttcaaatggagcatgcccagcctgccgggcctcagtttccacatatgcccaggcatggattagctgagatggtcttgaagtcctgccagccctggtggttctggaggttgagcctcagtttccctcatctgtacagtggaggacatgatggagttctagctgttgataaatgccctttaaaccaccatttattgggctttccttatacagcaggcactttactgacctggcttcattttatcttcacagcagccctgtgagggtagctgcgccattaggcccatttcacagatggggagactaggtctgagagagcttaggtggctttcccaaggtctcacagcccctgtggctgagaggggcttggaacctgggcagttggctgcccctgtgagcagtgagtccttagaaggacttactgtcagtattattgatggcactgttaactagggccctgcatgggtgggggcacctgttttgggctcttggactaggaaaagctcctgtggccattttatccaatgccaccattttatagatgccaacaccgaggcctggagggggctggccagcgcccctcacctggcacagaggactctgcctggcacatcccacccatggcctctgatgcccagcttggagaagtggtagaagaggggctgggggatgcctcagggggacttagccctcagccctgagccccccgctgcatcacaggcctgagtgcccaggaggcagtggtctgggtaggagtggctgcgactcgggggtaaatgtgcttcagagccatccccactcatcccctttcgagccaggtgtccctggtgtgtgacttggccttgctgggcctcagttttctgtaaaatgggaagtgtcatggggggcaggctacggtaagcactgatagggcaggtgaggggcagcctcgggcccacccttctggcaggagacatttggggcacccagaagccctggaacaaggccactctgaccttgattttgggagcacaaagtccccccaagagatagcacaggagcccgggtgtctgatgagtgacccatcccttgggggcctcagttcctgggtgtgcctgggtctgcaggggaggcagaggcacaggtgggcagctccctctgggtgggctgtgaccctgcctgggcacaggagggccgtgcccgtccgtccttgccgtgattcttccaggtggcaccgccctcacacctcctttacagaggaggaaactgagacccggggaggccacaggagtcgggctctgggcccagagcctgggcggggatgcaggagccacccccatgcctccgggtgtgggaaaggggaagcagaaagaaagggacgtccgccggaggcctggcggtttcctctcggggcaggagtgcgaggaggaggaggaggaggaggaggaggaggaagaggaggaggaggaggaggagggacggcaggaagccgcctcgggctctgacaggcgcggccctggcctgcccctgcccttctgagcctgtgacccgggggaaggcactttgccctccctgtgcctcagtttactcaagtaaaaatagctgaatgatggctctggccccaggatcaactgagtgctgtctgggaagcacctagagctgtgcccaacacagccagtgttcgctggggcctgcaaggctttgctgctgcaggcatcactggcgttgtcatttttatttattatttatttatttagagacagagtctcgctctgtcgcccaggttagagcagagtggtgtgattttggctcactgcaaccaccgcctccagggttcaagcaattctcctgcctcagcctcccgagtagctgggattacaggcgcccaccaccacactccgctaatttttctgtattattagtagagacgcggtttcgccatgttggccaggctggtctcgaactcctgacctcaggctgtccatctgcctcggcctcccaaagtgctaggattacaggcgtgagctaccgcgcccggcccatttttattaattggttttcatgtgacaggcactgtgtccgccacatcccatggaatccttatcacaaaccccggaggtggggacagtgatgaagccatttcacagccaagaaaactaggcacagagaggtccagaaacttgcccgaggccccagagctggtaggtggccaaggcaggaaatgagagtccctggtgggtctgccaaggccggggggcaccaggggcagggggtttgtgtttaggccccagaacaggcagagagaaagcacccaccctccaccgtcagaacgagcctgtatcccggcaagcagggcagactgagccctggtcttggcaggcaggcagagctcaggtcctggcgggcacacaggcttaagaagccggttttttcctgggcccacgtctcctgggggaccagcggcagaggctcctggggtaggaacggaggtcccatcctcactctgtcctgggctgccatgtgacccaggtaggtcccagtcctctctgagctatgaagtgggtgcctgcagtggccttctgggagtgatggggaaggcggagggggttgggcagggctcctgcggccccagccacacacactgccgccccatctgcccccttattggggttccatgcaaaatcgtttttgaaaaagtgctttgccgcttagaagaaacccccgaccgcgctgaaaccacgggggcagatggtatcggggcgcttcctttcagctcaaattctgcgaatccacagcctagaaagtgccctgaatccaacaaggggggaggtaattaagttattatggtccatccccaccccgtcctgcttaccaggcctggctgctcttactggcttcttggaagttggtgtggtatttttttgttttgtttgttttcgaggctggtattgagatgagaccattgtggggtcagggctgtgggcttggaggttcagggtcagggtccaggggcgaagggtggacgctggagaagggcagatggacagggtcaggttcagatcttggctcttgtatccttgctgtgtggctctgggccaagaacttggcctctctgcgcctcagtggctcattacagaaaatgggatgccagcacttgccttagtgggttgttttgagccaactgcaggctcagggagtagctggcatgatgtgttcctaccctgaagggcagaaaaaggggaaggaggccaccagatcccacaggtgggtccccagggtccctccccgggatgggcagcagcctggctgctccccacagcaacccctggctggccccattggcgctgctggaaatcccccacccagttctttgtgaatggaaaaggaaactgattgcgctagaagaggtctccgagtgccggccgggggtggggggcggggggggcttcctctcccagtgcaggaggggccacctcagcttcctttctggggccccataccccctttttcctatctcccctctgagttgaggaggaggctgtggcccccgcccactgtttggcctctggaaccactgggtgacagtgtacatcggggcgattaagggccacctggcctctggacctccctcgctgtggctgctgcctgggaccccccaccccatgcctgactcgaaccccaacctcagctctacacacaggggcaccactgtaggaggagagagaaacctctctctagggaaccacctggaagggggccctgccctgtcttcatctgggtaccccatgtaatctaggaaactgtctttaacttgccgagggcctccatgtctgagttcctaatgttttttattttgctttttcaattaataaagctcatggcagaaactatttaaagaaaaaaaaaaacagtaacagaaaaacctcccacaatctcactacccagagagaaccagcatttccattttggtagatgtcattattgtcatttttgttttgtttttgagactgggggacactgctctgtcccccagactagagagcagtggcgccatctcggctcattgcatcctcaacctcctgggctcaaggtgatcttcccaccttagcctcccaagtagctgggactatttaatgctgctattagcatagacattagcaggacaccatgccctgctaatttttaagtttttttgtagagacaaactctcactatgttgcctaggctggtcttaaactcctaggctcaacagtcctcccgcctaggtctcccaaagttctgggatttacaggcgtgagccaccaccacacccagcctcttctctgtctttaactttgcctccgcctccaaattccaattccttcagcaattgctgggaagggattactttttgcacaattctgtctggagccccttgcaggcaggagcttgtggacaaaagcttcagcctttgcgggcctggcattcctcatactatttggtcacctgcttttttcactttgtgtcctgaacatttttctgtattcttttttttttttttttccacctcctaggttcaagcgattctcgtgcctcaggctcccgagtagccaggattacaggcatgtgccaccacgcccggctaatttttgtatttttagtagagacggggtttcaccatgttggccaggctggtctcgaactcctgacctcaggtgagctgcctgcctcagcctcccaaagtgctgggattacagccaccgcgcccagcccatttttaacttttttgctggtatagatgaccctgggatgaacaccttatgtcagtcttggtgcccacttctgatgattttcttctgctcagttcctagaaggggagtgctgggtcaaggcttttatgagcacttctgatccgttcttgctctcaaagctttattgagatataatttacaaaccataaaattcgcttgtgtaaagcgtataattcattggtttttagtatatttacagagttgtgcaaccctcaccataatctaattttagaacattttcgtcatcaaaaaaggaaaccttgtacccatgaacagtcactccccatacctccctccccagcccctggcaaccactcatctcttttctgtctccagggatttacctattctggacatttcacatatgtggaatcagactatgcagccttttgtgtctggcttccttcacttagcatcatgttttccaggttcaccgaagttacagcatgtattttgttcctttttatggctgaaaaatactccattgtatggacttgccacattttgcttatttgtttatcacttaatagacatcaggttatctccactttctggctgttatgaataatgctgctatgaacattcgtggacaagtttttgtgtggatctgtgttttcatttctcttgggatacatctaggagtggaattgctggggcatacagtaattctatgtttaattacattgggctgggcacggtggctaacgccagtaatcccagcactttggggggctaaggcaggtggatcacttgatgtcaggagtttgagaccagcctggccaacatggtgaaaccctgtctctactaaaaatcaaaaattagctgggcgtggtggtggatacctttaatcccagttactcaggaggctgaggcagaagaatcacttgaacccaggaggtggaggctgcagcgagccaagatcatgccattgcactccagcctgggaaacagagagagactctgactcagaaaaaaaaatgactatatataaaataaatatgactgccaacctgttttctgaagcaactgtaccattttatattcccaccatcattgcgtgagaggactccagtttctccatgtccttgccaatatttgttattgtctgtcttcttgattgtagccatcccagccatcttaaagggtgtgaagtagtttctcagtgtggtgttttttttgtttgtttgttttaaacggggtcttgttctgtcacccagcctggagtgcagtgcagtggagtgcagaggcagctcactgcagcctcaaactcctgggctcaagtgatcctcccacctcagcctcttgagtagctaggattacaggcacacaccaccacactcagctaatttttgtttttcactacactacgtgatgtggttttttgttttgttttgttttgtttttgttttttgaagagctggggtttcaccatatttcccaggctggtctcgaacacctggattcaagcagtcctctcacctcagcctcccaaaatgctgggattacaggtgtgagctaccgggtttagcctcagtgtggttttgatatgcatttccccaatggaaaatggtgttgagcatcttttcatctgcctaatagccatttcttattcttttgatacattatttttgagtagccttccagaaaggtcatacgcatatatcttcttgtcaccagtggtgccagcactgggtattattttaaaaacctttgccaccttctggatgaaaagtggttatcttatcctaagtgtgaccatttctctttgttaaaagttgagatatgattcatataccataaaattcacttgtttaaattgtacaatgcattggcttttagtatatttaaacaattgtgcaatgatcaccactatctaatccagaacatttctatcaccctagaaaaaaaccttggagcagtcagtccccaaactccctgcctccagcccgtggcaaccactgatctttctgtccccgtggatttcgactgtttctcttctgttccttggtcatacacatttcttgtgatttatcaggctatttactcagcatgtttgtctcctgcactgcttgcctttttcttgatttgtgaacactacacggcacggatattagctctgtcccatgttgcaaatatttccctggtttccgatttgacttttcaattttgttcctgcatttcttgacctatgggggtttgcaagttccaggcagtaaaatccagtgatcttcgcctttatggttttattctttgcttttttaccttagaaaggcctttccccacccaggatcagataaataattatttaggttttattctagttctgtcttggtttcctttttcacttttaattatttaatccagctggcttttgttatgggtggctggtgtgatttcctgttgttttgtgatgtcagtgagaggctgtgtgtcaaggcctgtgacatggtaaacgttcagtaaacaggagctaaaatgatagtaatgagagtccgtgccgggtggagctcagaaggacatgggattcccggtgctgtgccgtggctggaggaggacctggcctggctgtgccagttggctgggagcccctccaccccagaagcccttgctctcacctcttcttctgaatcatcgttcttcgaaggcaggcagtagctaccgttgtctggggctttggggatcttggtggtgatgagtcccctctcctctggtgcactctccccacccgagacgggcgacagaggttttttgttgtttcttaaccacatctttttccacccacacccggtgcagagcagatgcttggccggggcttccccgagctggtcctggctttgtggcagggggatgggccgtcggtgccccattcaagcctggggacctggccccactggtgtgtgctacagtagacccagccctggggccccatgataccctcggtgatcgtcacagatgcggggcctggctacagtcctcactggtgttttttttgtttttgagagggcatcttgaagtagcccaagctggagtgcagtagcacgatctcggctcactgcaacctccgcctcccaggttcaggtgattctcgtgcctcagcctcctgagtagctgggactacacatgcaccaccacgcctggctaatttttgaatttttagtagaggcagggtttcaccatgttggccaggctggtctcgaactcctgacctcaagtgatccgcccatcttgacctcccaaagtgctcgttacaggcgtgaacaacccccacccactgcagggagccaggcttgccccctccctgccaagggagctgcttgctctcccttctgtctggaggccagcacagcctggcactcgtggtttggggcgtccatggccttgtggtggcgaggcgcagaaggcgtcacctgaaaaaggtgtggccaagggcaggggtgctgggcttagccaggctggccacagtgggggcaggaaggattcctatggggacagctgggagcaggatgtggtcgtgcgaggcgtgggctgacggcagctggcatgcagcaggggaggtgtgctgggaccaggcctggagtggggtctggtggccctgccgtgtatggagctgagtgccgcccagagatgccatcttgtcctcagaagtggctcaggcctgctggggacagggcaggtggatggaagctgctgcatgccctgtgccatgtgctggtccgctggctgtcactgcagcgcagctcccggtgcctgacagttgtttgtccttatttggcacttgagagcccagcggtttggccagaatggtgccctgtgcggagggcacagcttgagtgaaggtgtggagggaaaaggccctgggggtgtggctcccctccttccatcctgctccttgcaaggcccatcccaggacattcctcctagccaggtgggctggatggggcctggacttcctgtccatgttttgggatgagagcgctggggaaggtgcccactgcggggtagggagtgtagggctttccaggcatcatccctcataagccactgtccccaggccttgcgcatagccccaccatagccgactcgagagtagaagcgtcccaccatcctcacagcaggctgcaggggccatgtgtaactggcccctccacccttggccacctggtggagtcggcacccatatctgaggaggggaccatgttgctgctggggactctgggctggtctggaagcaggtgtggtgggggctgtctttccctgtgtgaaggtcttcctctgggtgtctgtcgctgtagggaggccactctagcatctgaaaggggctctgtgtccttgccatcatgattctgtcttgggggtggttgctgtctctctgagagggggctttgtgtctgtgtccctgtgattctctgacatgcaggaggaccatgatgggaactgaggggaattcactctgggtggggttttagacaggtccccaagtcctgtctgtcccagcatctctggctaatcacttcccccgcccccctcccgccacacacatacacgggaaaagcaggctggtgtgtgtcctgttgcccacaccacactcagtcactcagtgtgagctggggtgccacctgcctggaggggggatctgactctgaacagggattctgtatttgggggtgtcacactcaccatgtctgtctctgcctctaccatctgactgggagaattcctctcagggttggggtgggcaccaagccttgctcccagtaggggcccagccctgggttgggcccagaggaggtgcttggagggtttactgggtgacggatggatgagcacttgggtaggggcctgggacccccaaagccctcagatgtctgggaaatagggggatgttctggctggggaggtttctgtttctggcattggggggctcttgccaggaaagggcttttctggcagccatgtggcttttctggaagcttctcccttctctttcctcctcccctgtggggaaagggcacctgaggcagcagggtgcagaccaaggggggatctggcccataatgaacagggtggtgggggtctaggagccgctgccctgtggactgggcccactgggcattcagggcagcaggcaggctcacttgcagaagtccaaggagtgggttccattatcatccccattttacaggtgaggaaactgaagcacagcaggccaaagtaatttgctcagggccctgcatttgaagggtctgtgaaggaggggccaggcttggggtcctggtggggggcatagcagagaagcgccctgtggcctgtagttcccacactgattcagtcgctggaactggctcattgccttcagtttgccccccaaggagcttgggaaaagggggctgagatcacccatcacaccccatacctccctctgcttcccaggcacttgagagcttgggggtcccaggtacctacccaagtgctcatccatccatccacccggcaaaccctccaagtacctcctctgggcctgccccagggctgggcctcagctggcagcaaggtttggtgcccaccccaaccccaagaggaactctcccagtcagatggtggaggcagttgcgtcatcaggaaaccatggccggttcgataagctcagtgctgagggagaggcacaggaattgcactaatcatgactcagtggtcagagaaggctccctggaggagaggaggttttctctgctgggacatgcagtttgggtcaggcagggcatcacaaatgcaggggctgggtggcaggggaaggtgtgggcgggaaggcggctggagggagaccaggtgttgggggtgctggggctgggggtgggcagatgaggattggagccctggctcaacttcgctattccccatggctggggcactgtgtgattttgcctcccagagtctgtagcatgggggctcctgatggtgcccttgcggggaggtcagggggctgacacacctgagcctgcctttcagcctgccctcttccctggccagctggaggggccttgggaggcccaccccagccctgagagcactggcttgtagcatccctatcactcatggtcttcactggggtgggggatggcagtaggggcaatcatcccctatgccccccgttacccagcacaaaggatgcttagccagcaaaaggcttatgatgaatgttgagcacccaccacctagcaggcactggctcgcggccaaggacaccacgtgagcaaagccaagtcacggcagagacctgcatcaaggaatgcgcaagaccagctcataggacaacaggcagggaaggaagtgaaggggctttgcggctcaggatttagatactgtggtcagggagggcctccctgaggagatgacactttgaaaagcagtcgtatttgtgaagctgtggggggagctgcctctctgagggcacaggccccgagtgcacctggcacactgaagaagagtggaggccagtgtggctggatcagagcgagggagggaggcccaagaggctgaggaggtaacaagggtctctcagatgaggaccacaggggagtttttgtttttgtttgtttgtttgtttgagacagtcttgctctgttgcccaggctgcagtgcagtgcagtggcgcaatcttggcttactgcagcctctgcctcccgggttcaagtgattctcctgcgtcagcctcccaagtagctgggactacaggtacctgccaccatgcccgactaatttttgtatttttgtatttttttgtgtgagatggagtttcgcttttgttgcccaggctggagtgcagtggcacgatcttggctcaccacaacctctgcctcctgggttcaagcgattctcctgcctcagcctcccgagcagctgggattataggcatgtgtcatcacacctggctaattttgtatttttagtagagacagagtttctccatgttggtcaggctggtctctaactcctgacctcaggtgatctgccttgcctcggcctcccaacgtgctgggattacaggtgtgagccaccgcacctggcctaatttttgtatttttaatagagacagggtttcaccatattggccaggctggtcttgaactcctgaccttgtgatctgcccgcctcggcctcccaaagtgctgggattacaggcgtgagccactgcgcccagccgggagtttcttttgagatgagattttgctctgttgtcgaggctggagtgcagtggcaccatcatagttcacggcagcctcaacctccctgcttcagcctcctgtagctgcaggggagttttgagcagaggagggtaggctggagcagcatcgtgggggtggaaatagctaattctggacagacttgggcgtagtctgatgggacagatggcagtttttgatgctgcccaactcccagagggcccaggtgtcacactgttttccagcctggctcctctctcctcactgggggctccttgtgaatacccctttcccccagcagttgtctgggactggaatcctggctgctcagctcccagcatccaccactttctgcctttgagggatgggccgtgcctcccctcctgcacatcttctgtggctccctggcatctggggggaagatgggggacagaggcctccctgcccagctctcttgacctccctcagaccccagccagctcagacgccggtgggtttcagatccacccaggtcccatgttaaaatgcagattccaaactcccttccagatgtcctgtgccagaaggtcatagaagcaccctgtgctgtgttccctcccccttggaggtctcttgagccttctcatctgtgaagtaggtgaaggcacaggagggccacgtgaggctcacacacactgctccttgcacggagctggcccggggcagggtggtgaggcttctccttcataaatctcactgtccatgatgcccaggattgtcctttgctctggaaccatgacgtcctacttggtttcgtcgtgtccttgatggtgtgacgcccatttctgtgacttcctcttggaaaactttttgaaaaatgttgccggcctgtgaattccacaatctggaaactgctggtgggccacccaggctccaatgcctggcacacagcagatgctcactaaagggtggtgtggggtctgtgagcgtcatttccagccacagtcaagcccctgttgtcttctagcctggggctgtgccttctgccctctgggtgttggctcttgctattcccttaacctccagtgcctttttctccaccatccccacttcggagaatattcagcaaacgctactgctcctttctctgtgctgggccaagaccgaaagatggaaaaggaagagggaggccttcttgagcctctggtgcatgggagcaggggagtgacaactcaggagggctgcccagggaggggccttcttgctcccaagtctctcttaaggctgagctcctaaggccctgtgctcctccctgccttaccattcccctgagatccttccataccctctgggagctctgttgcacacactatgctcatattctcagggaagggtagtggcattattatcccaccttagaaaatgcagactcttgcttgagcccaggaggtcaaggctgcagtgagctagtttatactctatcctgggcaacagagagggaccctgcctcaaaaacaaaatacacacatacacacacgtggagactcattttgggaggccgaggcagaaggatcacttgagccaggagtttgagaccagcctggacaacatagcgagatcctatctctatctctacaaaaaaataatcagccacatgtggtggcatgtgtctgtaatcccagctacctgggaggccaaggcaggaggctcacttgagcccccaggagtttgaggctgcagtgagccagcctgggccacagagcaagaccctatctcttaaaaaaaaaaaaaaaaaattggaaactgaggctaggagaggtgagtcacttacctatggaagagaaggcagagttgggactcaagcacaggactaagtgtcccaaacctcagggtggtggagttgctgcatggttctgtagccctgagggatttctgggcaggatactggatggcttttagcaactaggctcagtcttgatgctgcccaccccagagaatggctgagacgcaccacgtttaaggagagtttgcgaggtgaggaccttcctcacctcaatcccatattaccttgggatggtaataaggtctatgaaataggtcaaagtctgggtaatgcatgggtttaataggtttctctgctgcaggacttctcagagtctttaatggagctaagcagcagcattctctttccacaaatgactgtcctctctcggagaatcctttgcattggctgccaggaagctgagacaaatctgtggcaagagggactcttgtctgtgttgtagcagctgtctcccagctctttctgggtgtctctaacctgactaaaatcatttttggaagaaggcaaggaatttttttttttttaagacagggtctcactctgtcgaccagtctagagtacagtggtgtgatctcagctcactgcaacctctgtctcccaggttcaagtgattctcctgcctcagcttcccaagtaggttaactttttgatactagacagtaagcttggattaagtattttccataataatgctcattcatccatcccggcagcatccacttcaggttctgggctggggtgagggatcagccatccaggacaggatctggaatttgctctgcgccttttcagaccccctccctctcctcctccagtaagaaggtcaacaggacctgcttacgggccccctattactgaaagcaaactgaacctccagttagtgtcctgcccaaggtttcaaaggtaagtaagtggtagagctagggctcttctaaccacctgcagagctaggcccaggctgccagatgcctccttgagggcataggtgtggcagaggcgtggctggtgctggagggtcgactgaggcctgtcccactgctgctgtacaccgatgaatgtgggctcaaaggctctggggaaggtaagaccaccagggagctagtgtggcctgggggttcccgggggtgggcggtctctccccaaggctggtctgggccaagcccttgctgctggggtgtgtcagatgctgccctgtgtcctgccctccagcgtcccaggaggagggggacagccagcaggcctgctcctgttaagagcttccccaccttagaaaaagctcaagctgattcccacagccttgaagccccatggtggcttctgggggctgctgtggcaggctcacctgtgcctcttcctgctctctcaccaggggaggccatgccatcagccttgctctccacgtaggtgtggtcacgccaccagagctctggcctttgactggtgtgtccagccctgccctgccccgacttgcctgtctctgctggatgcctgagggcaaagccagtaacagaccccactcaagctggttatgaggacctggcagggtggggtgtggcccagtacctcggaagactctagaaggaccatcctggccctataaatgtttgtgccaagacaggtcccctgtccctcagcacacagaaggggcagtaggtagcaagacagtttccaggtaacagcatgagggcaagtgaggcctagagaggaagggtctgttgcctccagcccgtcacattccctccaggcgggctgaacagccaggtgggataaagagggatcctcaggtaggcgggagtcagggagagctgcgtgaccccacgaggctggtgtttcatcttcacttctcagatgacgggactgtggctcagagacctttgcagggggactgatcacagcacagggccatttgaagggagcctggaactgcatttccatgtggaccctgggtggatctggaaccaggctggctttcctagctcccccgccctttggctcccttatgttcttagccttcttttcacaacaaactcagaagcagccaagtagttggttgtgttgtctacagttgcactgaagcacgttttatttcggctaagtgacagtcctttgttgtccctgtcttgtaattagttagggtagtatgttggttatattacgtggaatttattgcaggatggtaagggagcatgtgacaaaatggggcaatagttctgtaaggctgagagaagctgggggtgtacccagtggctaggctactcagaggggactgtcatgctgtcagtagtgtagtgggagccaagcaggctttactcaccggcctgttaacagctgtgcgagtcatgcctttcgcttgtgttagctcaccttgtgaaaaaatgagctgaattacagatgacaactaaggcatggagagccgaaccctttgtccagggttgtataggaagtggcagggtcagggctgaatcttaaaacctagagggtagggcccggcgtggtggctcatgcctaaaatcccagcactttgggaggccaaggcaggcggatcacctgatgtcagaagttcgagaccaacctggccaaccaacatggtgaaaccccagctctactaaaaatacaaaaattagctgggtgtggtggcaggtgcctgtaatcccagctactgcggaagctgaggcaggagaatcgcttgaactcaggaggtggaggttgcagtgagccgagattgcgccactgcactccagcatgggcaacagagtgagaatctgtctcaaaaaacaaaaacaaaaacaaaaaaccctagaggataaaagaactataacatctgggataaagttagctgttgaaataaatacaagtcctaccgttggggtagtgtcagagctggcctacgtctttgactttgagattcctagcagccagagcaaagaaagaaatagattattcccactggagccacagtggccataacaaacagaagccatctgtttagatgctgggaatggagaagacttgctccccagaaatagacgctgcaggatgtggtgggtgacagtctactgttcaaaccacaaatacctgaaatgatctggccactttgatcacccaaccacagtagagcctaagcaggtccagggagcagctgttgctggcctggcttgacttttgagggaggtggaatagcgggcatgtgagaggagggaacctaaagcccccacagctgctgacacagcccccaggtttgagcttgtctcccctctcacccatccccccatatagcttaatctgatgggcatctggtggtccttccctgcagtggccagagcctgagctgtccaggctgaggtttcgactgaagcaggggttgtcctgcgcccatgtgcccacacgctgcaacctggctggagcctctggcataggacacccataccaccaggtagctgtggcggaccccggctctgatacttggcaggcttgggttgagattgtggctctaggcctgggcggctctcaagggctgctgtggggagttggggaagaacccctgggttgtgctcagccagcaggcaggtggcagccaggctggctgtgggtgaggaggggaatcctcttttcaccactgcctgcctgctcagcagttcttcagctgctgggggtggagctggcttgcaggggccagagtcagagtgaaaccggcagctctgctggttaatctcagcactgacactggggactaggcctggagcggaactgaaagggagactaggcccgttcccctccaggcctggcctatatcctcccagtgatccttaaggcctgcagctagggggaagggtgggggccaggcagggccaactggaaaagtagcagaaggaagtggccactcgcaccttacccatcttgcagacaggaaatgaaggctctgcagggctggctggctgtaaaaatgggcaagagcgcagaggccccactccctgcacactgcgctgtgtccagtgcccgtgtggatgccatgtgaggcctcactctgcctgcctcatcctggctgctggacctctgggagtaggaggtgaaaatgccctggctggtgctggtcacttcaggctggaattttctagtcatgcagctttctagtgagaggccgcagtgagctgtggccagtgttggtcattcctgcagtcattactctcccccagcctgttgtgtccgccaaccagagcaggcccgggagctcccaggagacctgctggaagggcccaggtggccatcctgctcctgccaggctgccctcttacctcactgttcattgactctcctgcaggtggggaagggggataaaggaggtggccaggccactgggtcatgatccttccgacagaggtacctggcagctctgtgtgtaaagcaaggttaagcatctggttttgggggtcaattcaacagcactagcagctccagtccaaggtatgcccttttgggctgaggtggaggtcagatcacctgaagccacagttgctagaacatcctttgggctgcctctgctttccatccccctgctcccagtttgttaggggttgtagtattttccaggaacacctgaatggagggggcccagtggggccacttctgtccattccttatctcatctctttctccccttttcttctttcggccatcttttcagtcttatcacaagaggaaggggaggggcaaaccccctcctgagcagattcccaaccggaagcagctggctccttggctgcagagtgccccagcacaggaagcatctgcagggtcagttgagacctgggagcaggtttcctgctggcaaaggaacagtggctaactcctatccaccctgcagccctatgtgccgggtgtcctgggaaggtccagggccaagattttgtggttttacagtggctataacttaggctagccatgctaggctctgcccctttgggcttggtgtgatgagaccgtcagcagctgctatcacctggctgggcagggagctgtttgctcaccagtgggaagagaaacggatgtcagacacatggcagagtgggaatgtctccaagtccaggtccaatgggctgggagggctggccttctgccagcacatgcttcttgggatctcagtgtgaatggtgttcaggaggctaggggaaggcaccctggacctcactacaggctcagagcctgcccagcaacaccatggatactctctctaaaagggggactcctggggagactatagacaaactcaggcctggctggaagaaagagcatcaggaacaagccttgagtaccccaacttggtctcgtagagttcaaggcccaagctacaagcagcttgctccagcatccaggaggtccggtggtgcacacggcttgagatgcctgacaacctttacacctttgtgctgaaggtgagtgacaaggcttttcacaccctggggcaatacaaatacatacacatacagcagacccaaccctgttcccttcctccctgccaggtgaaggaccggacagacatcatctttgaggtgggagacgagcagcagctgaattcatggatggctgagctctcggagtgcacaggccgagggtgaggtcctgggccctcgtccctggcaccacctttgctgctaccacccctgacctgcccagatccttaacctcagcctcttctccagcaggctggagagcacagaagcagagatgcatattccctcagccctagagcctagcacgtccagctccccaaggggcagcacagattcccttaaccaaggtgggtaaaccaatagctaggccattgtcttctgggtacgctggaacccagactcagcccaggacataaggtagccccctgcgaccaccatcacccatcttatctaacaggtgcttctcctggggggctgctggacccggcctgccagaagacggaccatttcctgtcctgctacccctggttccacggccccatctccagagtgaaagcagctcagctggttcagctgcagggccctgatgctcatggagtgttcctggtgcggcagagcgagacgcggcgtggggaatacgtgctcactttcaactttcaggggatagccaaggtatggggtggggtggggtggggtggggcaggcaggaccgtgccacccctctccactggagttcagggtcctagagggacagcccgagcccaccatcctctcctcccacagcacctgcgcctgtcgctgacagagcggggccagtgccgtgtgcagcacctccactttccctcggtcgtggacatgctccaccacttccagcgctcgcccatcccactcgagtgcggcgccgcctgtgatgtccggctctccagctacgtggtagtcgtctcccaaccaccaggtctgaccctactgccctttgctgaagggggtggctgacactgggtagagggtagaggcttgctgcagacccaggggtacaggtatcttgttctgtgtcctgtcagcacttgcctcaagactgatggtgtggtctctcttggtcacttgtcctaggttcctgcaacacggtcctcttccctttctcccttcctcactgggattcagagtcccttcctcactggggttcagagttgggccttccccaccttagttcttctggctgtccccgggggctcagcccagagggtctcccagggcgatcctcaccccccgagcagatcttccacctggtgccttcgcccgaagaactggccaacagcctgcagcacctggagcatgagcctgtgaatcgagcccgggactcggactacgaaatggactcatcctcccggagccacctgcgggccatagacaatcagtacacacctctctgaccagtgaggaattccaggcctcaacagctgcccttgaggagcacaggcagaagtgtgaacttgtgaatgtaattgatctttccttccttccagagaaagatttaagggacactgttaactgctcgtgccagtttggaagtgacccttctattaggcctgttgaagggccctcctgtaggtttcatctatccacctggctttctccttattgtttacagatgtagttcttgttagaggatgccgctagctcctgcccggggtccctatgcccagtccccgttactcttagagaaaggagttggggtgagggccagagctggcagtggaaacttgttctctttttcactgacactgtcacagcggatgacagactttctacggggaggagggggggatcatcaggaagcccagaacactaacaagcggttctcccatctaccgtcagtccacatggcaggtctgctgtgtccacaccacagatgaccacatctaatcctgcttctactctcagctttaggacaaaagctctgtcagaggcacaagctgaaggtcaaaaatgatttaaaacattttacctcagactaatttctttaaaggattcaggttcaaaacttaaccactgcttatttcagtgcactgtttcaactaacacccatgctatttttgtagtcagaaacagctatgcaaaccctacctaatttacagtctgagccagcatgctggcttgtctactgcatcctcgggacagtcacctgccactgagtggccactgtccttcctaaatgtcaagaagtgaagtatgtcaccctttcagggaaattcaggcaattactgaaataggagggtggcaagaacagttctatcctggtgccttacgaataaaaaactggattctggtttacagcagctttacagtgatagttaaattaactggggctaggggaagagcaagcaaaaagggaagaaggactcctaggccctttctagtaaatccttcagcaacaaggctggcttggtgccctccaagcatctaatggcttattaaattatcccacaagtgggttttaggctccttttttgagccaaaatggaagctgggaatctggtgccataactaatgagaaactcctttaatagcccacaatcagtgttctgttctagctggctactgcttcactggattgagaatctatctatctccttgcacacatgggcacacacaatctccaccatccagggaggtcctgaagtcaaatctctatctatacaagtgatacaattcatagggggctggctcctcccagaacctgtctggaggctcagaaacgggggcagtgacagtggagtcagctgctcttgggtgccagcagagccattcagtacaacccccaggctcacagcagtggcttctaggaaactgggagtttagatcagctttacagatacatcgatcagaggctaaaatgaaacctcagcctaaaactcataggactgactgcctgggaggagggttaggtctgcttcttccacttatacttagtctctgtgctccaagaggtcaaatttttgcttctagaatttccttggggtctttcagagggtgggggaacaaacccctatgcacttttcttttttttttttttgagatggagtttctcttgtcaaccgggctggagtgcagtggtgcaatcttggctcactgcaacctccaccttcctggttcaagcgattctgcctcgacctctcaagtagctgggattacaagcaccagccaccatgcctggctaattttgtatttttagtagagacagggtttcaccatgttggccaggctggtctcgaatgtctgacctcaggtgatccacccgccttggcctcccaaagtgctgggattacaggcgcgagccaccgcgcccagcctacaccacttttagtaccaacactcttgggtgatttcatggaccctaaagcagacctgacactgatccagatttgcagtccatttttaaggacacctgtctttatttcctcaaagtcaagcagctttctctggaaaatgaatgctaattagtgtgaaccaaaagagtaagtaagagtctgaagtttttttaaaggagaaagcttattatggaaagtcactggtcctcccctccgcacaggaaaggtacccagtagataatgaaccaaattaagttccctccctccagccagaagttaaacatctgggatatgacgtcttcatgccaggggcactcatttcttagcagcctctctacatacatctctcaggtggtgccaagaggcacaccaggtagagcaaacttagcagctctgactaacaggctgcaaagtgcaagttcagattctgtggcagagatttggaaggcacccacctccagactgcttcccgtccaagttaccaggacagctcaaaaacatgctgacagaaaactcccatggctctaggaagaagtgacactaagccaacacctttctttatgtgggagcagaatcagctgatgaaggggtgggcagcagtgtggggcaggcaccccactggctgcagctagcccaccataggcacagcacatcccaccactctccttccagtcctgaccaggccccagccggcaacttctaccgagagccatggctcaacaccaaactggacagtagacatcatgatccctccagttagctctaattacagaccccaccagtacagcttgacagctcccggcaccatcccttccttcatctgacttattgaacttttacaaactaacagtcaccagcaccaaagaattaagtcaactaacctgccttgaattttagaccagcaatccatatggctttatctggtataaatcttctgcctttgatcatttctggaccgtaggaaaaaggaatagcaatcattaaaatcttgggccagagaacactatttttacataacagtttcttaacctaaagtcaaggccttggactcttccctgagggttgcctgagattccttcatgctttctattcaggactaagtcccttactgcaaatgtgttagctctaacatctcccacaagctagaggaacttgcgagtatattaacaaggacacatctgacatcctgtgtttggttagaatatacagcacattgtgataacataaagtggattcatcttgtatcattataggcagaaggtatttggcaaatttttatgtattgttttatgtactgtacaagtaacttattcttgaataatgcaaattttgctataatgtacaaattgctatatgtgaattaaaaagttttcagaatcttgatttgctgtcataatatttaaaggctctattaagaccatggtgtctctacaaaatccttgccctgcccaaatactcgctcttccctttgtcctccccgttgcaatctgggaatactaacaaatgcttatgagtccatccatgtcaataagcagctttgtacatctttgtatcttttcagccttcatgccctctggatttctttattgcaatttttttctgagtgtctcctgccccctactggtaaagtagaaaaatgcccgaattgggaacttccagctaatgacactcattttggttcaggagatattaaaaaggaagcttacagaatcggtgtcagcccgaggatgtggaatttcagtgctgcccaactctggccaaccttcctcctcctgaagcagatctctaatccaccaaagagaatagctcagtcttgtctttttctagagataccttgaaccagaactaagggtgaagaagaaaaatcatttcacagctaccttccgggatattcaaaatgcacccttagcacacctgctttgatattaagtatcctacaaagaagtagcttatacagacacacactaacttgatcagtttttaaaactttttttattttttaaattttttttaagtttttattttatattatctacaaagtaaaagtttttcccttaacttaaaagttgaaccactgtagacagtgatcacctcatcaaacttgatttataaataataatccgtcagtttgacggtaagaatttactgaaactttgtcaagtttagtaaaagggcgttccaagtcttgatttttttttttttttttttttagcagtaatagcagcaagaatcactcttgttacttcttttgctagctgatgtgttcatgactttcaagggttattaaaaaataaataacttccagtttcggcaagcagagctggggtacctgcgggactctgaaacagcatatggaattatggaatagcccccaagttcctaaatgcctctactcggtccaagtatcttccactgcaagtgaactgttagcattcctattggatgttacaagaaatcaacatatatattttaaaaacaaaataaatgaaattctagttttctgtgcttccagttggtagaagcagtagaagggaggagggaatttggcctttcggttcctccagggcagccttacaactgctgttggtggtgggcttgtactgtaaaaagaaaagcgaacattgaaacagaaaactggcaacaccacacatcagcctagtgtctctgcagcacatgattgtaaactatcctcgtgctagctgaacaaaactcaaaattgaattcgcttttccccctcccatctgcaccaaagtggggagggttgggtgggtgggtagaaacaaaccagtcagacgtaaaaccacttcagataaaactcccagaagacttgttcatggggtagaaaaaaaggccttaacaaaccccctccccaaatattagccaagcaccagtattgctttcagaataacaggtcagactgtgaagtatcgccatggcagccatcaagtagtagagcacaatcacagggcgctctcccctgttcaggggctggggctaacgctacactcaaagccagtccatccacagcgctttctcagcagtatcttctccagagctacaatcaaactctgccatggtaataaccccccacatgtcagacttttgggactcaggaaggaaaacactgccctgtccagcctgtcataacaaggaaggccaactgagtcctaggcatgcatcaggctgctgttgctgctgctgctgcttctcatcaagccaaatcctgtataccatcagaacacacacagactcggctcccggaagcctcaggccctgatgctgaactgatcgtcacagtccctcctgtgcacactcctggacgggtcttgctagttctcaaatgcggggcttgaagcactggccctgcctgccattccacctgtg

SEQ ID NO: 818 - DNA, 20937 bp, Human
ccaagtagctgagactacaggcacgcgccaccagtccagctaatttttgtatttttagtagagacggggttttgccatgttggccaggatggtctccatttcttgaccttgtgatctgcccgcctcagcctcccaaagtgccaggactacaggcataagccaccacgcccggcctcatatctcttaataagagtttttctagaaacatttctcaatcaccccaggcataatcatattttatttctctacttctttcttttttttttttttttgagatagagtttcgctcttgttgcccaggctggagtgcaatggcacgatcttggctcaccacaacctccgcctcccaggttcaagcgattctcccgactcagcctcccgagtagctgggatcataggcatgcgccaccacgcctgggtaattgtatttttagtagagacggggtttctccatgttggtcaggctggtctcgaactcgtgacctcaggtgatccgcccgcctgagcctcccaaagtgctgggattacaggcgtgagccaccgcgcccatccttctttttttttttttttttttttttttgagacgtagtcttgctctgtcacccaggctggagtgcaacctccgcctccctggttcaaggaattctctgcctcagcttcccgagtagttgggattacaggcgcccgccaccacgtagggcaaatttttgtatttttagtagaaatggggtttcatcatgttggccaggctggtcttgaactcctgatctcgtgatccacctgcctaggcctcccaaagtgctgggattacaggcgtgagccaccgcgccaggccttatttctctacttctataatatcctgtgcattatctccagcgccttcaaatcatagtcattgaatgatctgttgaatgggtataactctgatgggagcagagagttctagaatcgggtagtaagagacaaaggagggtaacagtactgcatttcacaaaatgaaacccattgttaagaaattacaaattcccaataatttcaaatataaaaatttattcatgaaaattataggttataaaattaaatgtccgtcttagtcgatggttgcccatattttgatgaacgagtcattcctagcctatctttgttcaaatgatttgcatacattatgcaaataggtagaactgcccgaagaatgcctacgctgcgtggtgcggacgaaacgcttcccggggcctttggattggtctgtctagccacctcatttgcatgacgtaatataataactggaaggccccgcccctctggtgcatttccccgctccaaccacctcctcaaactcacggcaaagggatgcgagagctggaactcttaccaggcctgcggaaactcagccctccggcagctaatcccgcccgccagcccccgtcctctctttctccctagctgaaggcgccacgggccgtgtgtcgttgccttccacttttggcgtcccaacgtctctccgctcccatctttctactaacgtccgacgcacgctccgcctctttctcccacattcgtcgtgtaaattctgcgtcccaaccgcccagccgacctgcaccgcattcccgccccctcaacacggctcaacggccgacgctgggggcccgcctccttagccaatcggggtcctagtgcccttaagtccctcctctttatgcaaataacctccgcatgctccgcgcgcccggcccttttttttttttttttaaactaaagacagccctggaagtagagggttagggtataaagtgccccgccctttatgcaaattaaggggcgtgtctaggcgcggagggaggtgggaggtgggagggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggtgagtctgggtgaaccgtgcgctgacgcccttttccggcgcgggagaggtggtggcggtggcggtggcggcggcggcggcggtggtgggccggggggaggagaagctgccattagccgccgccattttgtcctcctgctgccgggcctgcttgcccctccccctccggtacctctactccgggacccgcacctccggcagttcattcaggatccgtagtctgcccctaaccacccaccgtcttggcttcagggggtgacccctgcgcctgggtccgtaactccctaccctccgctgcgctcctggcttttcacccccatttgtgggccccctccccggctgccgccccgtggtgggccgcgcccgacggttctctcggaagggcgcttttcctccatattggaccccctcctatcatccagcgctgtgttcccccctctggacgcccctcttcgtgtcgagccactcccactctagaatcctgcttttatcccagcatctttgctttctatgttgctcagtcgccctatgtctgctttttcatttttcctgttcctcgtctcctttctcccccaaccccgtttttcttcttgggcctctgcccccttacttcgttgtctacatcctttttttttttgccattcctgtttccatatattttccacctgctttcgtattcattattttctgttagttttggtctattcgctacatgactcttgtattcgttttcccttcatatatttatcttcacagattggcctcctcaaacacctacgaagcaacatccatcttatctctagcttgtcataaagttctttctccccaattttagctttcattctgggcctgtctggatttccctgctttcttccccactatttctcatctctttacactgttcccgtccataaacgaatgcctggtcactctggaatggactgagagacctgtcgtccggcttgcttagggagctggaggtatcgagtaaagaaacactggtgatggacatttttaatgaggataggaaaacgaagatggctctggccttggccctctgttttctggcccatggttacagggtgctaaggtggctccataatgctttttctcagttcttcatatggtaaaacagtatttcatctggaggcgattttttccaggagccaatacaggagcaagtttaggaaaagatgggatatttcaaatacttgaggttcctatagcctgggagtatgtacagccctagttgttctatgaggatttctctggtaccaacccccattccggctgagcaagctcataaaatccttaaactcccagcataccttcctgcaaaccttcccagatggacacgaggctgctgggctgggagcctggggtacagggccctgggggcatgattagggagcttgtgtccaataaacagggaatctaaagtgttgtttcttcttctctgatggaattgtatgcttcttttttagttttctcttgcttgaatttgtcctgttgtaagtctctgaaacgattttggtggagagagaagagattattacttgtagggaattactctttgtagacaggcacaaagggcagagtgtttatactaggaggatgctggatttttacttagatttccttgacaaaggtgtctgggggaaaggagggaacatggcatttgagctatgagggagctaagtagatcatggttgcttaagaagagtgggcagtttacatagactggaggaaaagacaccagagggcctcatatctgagtccctaatgataatgcaatggagtttttaagtttctgttatggtctgtacaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctggtgagagtcctgcaaagatgcttctgatggttgaaagctaggcatgcatggggcatacgttttagagctctttaaagggaagtggctgtagtagaaataccaaaagactagaggagatttcccaactttacactgggtcctttaaagggggtgtgggctctgggtgaacaccagttatcctcctacaaaggcgtgtctgtggttccctgtctttggacacgtaagaattggaggaaaataaatgtggatttgggaaactttgaggccagcttgcttcttgcaggctcatgatcaaccaatctcacataaaagtattgaatgttacatatctcagccttcttgatagggatttcatagatttttttttttttttttttttttgagaccaagtttagctcctgttgcccaggctggagtgcaatggtgtgatcttgacttaccacaacctccacctcctgggtttaagcgattatcctgcctcagcctcctgagtagctgggattacaggcatgcgccaccacacccggctaattttgtatttttagtagagacagggtttctccattttggtcaagctggtcttgaactcctgacctcaggtgatccgcctgcctcggcctgccaaagtgctgggattgcaaagtgtgagccaccacaatcagcgcgatttcagagattattaagggcaggggaaggaatcccttctaagagaagtttggaggaagtaggtaataaaatattcaacatgtataaatgtgtcccaggataggaggccatcagatctcccacatgaggcattttcgaccctctctccgtcttgttctccagttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagaggtagacagaggcttgggggacctagagtgatgggtattttaacttgaacttcagggagcattggggcttggtttagtccagccacgtctgagccagagacgaagaggtccctttcttacctattgcaggttccttgttaaatgactaaggaatggtactaaactttagctttttgtcttggagagagagcatgaaaaaatagacaacagcctacaaaggatgacaaaattattttgtccttatatttgtaaatggtagcaatgggcatgatttcagtcctgagtctccaccagttggagaagtcagggaggcatctcaggtgtgaataaccttcccattctgtcccctcagttccgatgcctcaaccgctcagccgccggaatcgcagccactgccggcttcacagacgcctgcctccaaccagccgaaacgacccccagcagcccccgaggtacctggagaactggaggggtggggaggaagaatggttcatagctgccccacccacatcatttatcatctttctgaacacttccccagaacactcctttggttccaagcggggtaaagtcctgggcacaagccagcgtcacccatggagcacatggagatggtgagtgcagcacttaattggggagctgtgtctgggcaccatgggatgcatgaaccctgcactgtattttcagccaagtgaccttggtcctctttggctaaatcaaggaccacccatattcagtttcatggaggcacatgagcaagtttaagtctcagtcttatatgatggagtgtagtggtgccagaactgacctccttggggaataagcagttattctgtaggggggtgagtttgaaggcgggaaacctgatggtctggtacctgtcagagccttccactttttttttttttgagacggagtctcattctgtcacccaggctggagtgcagtggcgcaatctcggctcactgcaacctctgcctcctgggttcaagcgattttcctgcctcagcctccagagtagcgggactacaggcacacgccaacacacccagctaattttttgtgtgtttttagtagagatggggtttcacatgttggccaggatggtctcgatctcttgacctcgtgatccgcccgcctcagcctcccagagtgctgggattacaggcgtgagccaccgcgcccagccagagtcttccacttttatagcatgtcctcaggaaatgtcttctgtctcctgttctgcatccccatcctaataggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaagtgagtggctgccttttggccaagacattacctattgcatctcagagctaggtgctggcttattcaccttcctccccatcactttcagctgtgttcacttgtcctccaatcattgatacctctctctaccttttccaaaatacagattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcgtgagtcttggtgtcttgtcttggaacgattacactggaagctggagagctaggaatcaggacttagtctttgacctatgagatagaagggagggtgggaggatgattgatagcaggcttaaggagctagaagggtatatgactgtccctctgagcagctactgttggacccttttacagatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggtaagtggatattaagggtcaagaatttggatcttgaaaggcaaaacctaatgaggaaaaaaaaatacagggttatgtgggtgaaaggcagacattgaagtgtaggaagaccaggcccaatggctcacatctgtaatcccagtgctttgggagtgttaggtgagaggatcgcttgaagccaggagttcaagaccagcctgggcaacacagcaagaccccccacctctacaaaaaaaaaaaaattttttagttgggtgtggactgtgcatctgtggtcccagctactctggaggttgtggtgggaggatcagttgagcccaggagttggaggtcacagtgagctatgatcgtgccactgaactccatcctgggcaacagagcgagacttttaaaaggaaaaaaaaaaaagagtaggggaggatggatggggaataccaagtccttgcaaagtggtgagaggagtaagaatgacaagacttcattggtggatctagacttcggagggaaggatattggcattggtagtccatcttgttacatagttccagactacctcccaagattggagggcagaatgcttgggttactaatactcatatttcccctcaggggcccatgaagaggttgactacactgaaaagctcaagttcagcgatgaggaagatgggcgagactctgatgaggagggagctgagggccagtgagttagggccatcaggggagaagaggagggggtcttggtttgtattttggtaatatactcttagaggagtatattagttgcagctgattttaatttcactgttgatctgctcacagcagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagtgagtgtctccaataagggattgagagggtcagctgtgggaaattggtgtcagctgagtaattgaagcggttgtgatatagaggaaggggggtgctaaaaatgggctgtgtgaagtgccaggctgcagaacatcctgggaagcttttaaatatctttggtaataggggagtctgggtaagaagtgagaaactgggatgctaatgaggaaagaagaaaaaggagccctgggtgtttgggtttcggaaggagagagggaacagaaaaataaaaagactagggtggctagatagctggatctgttagtatgcatcagtagtccaagctactcagcaggctgaagcagaaggatcacttgagcccaagttcaagaccagcctgggcaacatagcaagacgtggtctcaaagaagaccaggataatgagtttgtcaccacccagagagatcaaccccaaagcctgggtcgttgcatcctgcaagtagcgacagttgatttgttgtaaaagagatgatagaaagcatagtaactgattcccctggccctgctgggtcttgccaattgacaggatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccaggtatggagatggggataggtactaccagatgtcagatcactgcttcaaggtgcttaaaggtgcagggtggtaaggctggggataaatgaagtagaaggcagttgttttggtttattggactatcagtgatagtgttctatcatttgtatatctgaaggagggaaggttttgtctggaatcttaggttgtagtctaataccatttcttggcagagtactgtagctcacgcctataatcccaacacttagggaggcttggggtggaggatcgcttgagcctagggagtttgagaccagcctgggcaacaaagcaagaccctgtcggccaggcatggtggctcacacttgtaatcccagcactctgggaggccgaggcgggcagaacatgaggtcaggagttcaagatcagcctggccaacatagtgaaacccgtctctactaaaaatacaaaaattagccaagtgtggtggcatgtgcttgtagtcccagctgcttgggaggctgaggtagtagaatcgctttaacccgggaggcagagatttctgtgagccaagaccatgccattgcactccagcctgggtgacagagcaagactctgtctcaaaaaaaaatcctgtctcacaagaaatacataaataaaaatgaaaactatttcctataggccaagactgaagaaagtactgttgttctaatggtttcatagaaagttaatgccaccaccataggctcatgagaggccatgaagtgctttaatgggtcttaaatgggaggggcttcaatagaatagatgttgaatagaatattttagtcttaagggagctagagatgagacgtgagattcctggggtgttcatggagtgtctattgttggactagatcactctgttgtgttttttccgatgcagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggtgaaatcaagttgtttaccctctaagggctgcttttcttcctggcttcggtccctaattctcttcataagttaccttctgggtccctttgcttctttgtccagttgtctccattgtcacgccaatttcccctagtccaagttttttctttgctgattcctttgtccatgtgtgctttgagcctctctcatcttgtctttcctcctttcctaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggtaagggggcatgggaggagtgagaaacaggaaagtcccctcagtcttaggcattggatattagggtcttactgtgactctggtacgataggttttgcccatcatagtgatgagggaagggcatatgcttggcactgctgagatagctctgttgcaaaaatgggcttagttaagaaataagcagtggttggccaggcattgtggctcacgcctgtaatcccagcacttagggaggccgaggtgggcagatcaactgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagtgagccgagattgtgccatcgcactccagcttaggcaacgagcgaaactccgtctcaaaaatgaatgaatgaatagcacaactccatctcaaaaatgaatgaatgaatgaaagaagcagtggtccttcatttgccaggatttatttggggtgggttgattctcttgtagggaatctgagtggataaccttgttatataagagcaggcaaggcccggacctactgggaacaagagatggaagagctgacttgaccgcgaggggagatgctttttgggctggagggcttgtgacatgaataggattatttttctttttctttggtttcttcaggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggtgagtcttggtcatgagaaatgggtgagttcacagtgaaaggatctaggcctgggagaaaggtactttgggttagtggtagggatagggatgaacgggaaaggagaggctggatggagtggctcatgcctgtaatcccagcattttgggaggctgaggcaagaagattgcttgagcccagcagttcgagactagcctcggcaactggatgccatctctgccaaaacaaacagaaaaatagtaaaagagagtctgcatcataataaagtgttcttttcccacctagttctggttttcctgagatacttatttccattctttctgtctgtctcttcaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaaggtgggtaggaacaaacaaatttattgtggtttaaaaattggaggagggggaaaaagcctgagggaaagataagtttgggtggagtggagattgtggcctgaggggccatgggctctagaatgtcagtaggatttccatgtctggctaaggcaactggaaagcggttggtagggtgttagagtcaagaacacccacctatgtattcattgctggttctttgctttccagtctgtgcatctgtatgcataggaacccttagaaggactcaaaaacacctggactttaatagggaagagaataggttgtaagcagaagttgggaaacataacttgtgggaaaaagtaacgatttagtggatactggagctaatgctctgttttctccagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctggtaagctggaggggttatgggtgggaatatctccatccccagagaaggtcaagtgctggagggagcgggtggagaacctggcctaggggcccctgctgctgggtgcgtttctgcagggagcaagggtagaagaattgggaggtggagtagagaggaaaagttagggtcagtggcagagccaggcagatgctgaccctttttctctttcccagacccccactttgaggagccggggccaatggtgagaggggtgggtgggactcctcgggactctgccggggttagtccctttccccctaaacgtcgggagcggcctcccagaaaaccagagctgctacaggaggtaagggatgggtttgagattgtgcttcactgcactcttactcgtgaaaattcttctgggttatgttttctctgttttctttcctgtttctttcactgtgtttttactccagaattctcagtattagtctcccatgtgtctcccttgttgtccccacaccctgtgtcaccccactctgtcctggcttcctataattcccaattcccacccaattcatgttttgcttctggcccttctcatctgtaggaatctttgccacctcctcatagctctggattcttgggctctaagcctgagggcccaggccctcaggcagagtccagagatacaggcacagaggccctgacccctcacatctggaaccgtttacatactggtgagtaaagctgagtgaaaggactatggtagaagggttaagaatgagaggggcttctgaactgtcatctcctcacttctcttctggttggtgctcccttctccagccactagccgaaagagttaccggcccagctccatggagccttggatggagcccctgagtccttttgaggatgtggctggcacagaagtgagtgagggtgggagggtgtgtctgagctgggacttttttgagcactggtcataccccccacctgctctgggttgagtctggagctgttctctcacttggctgtcccctttctgcagtttgtatgtgtgcatcagtcaggtattggggtgctttctaccctgacttaactagctccttctccactcctctcagatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggtaaaagaccaaaaaaggataaggggaatgtttccaggaatctgactttggccctacctttttctgctttttctctctgcgtgtgtgttctgggcattccaatttggatttccctttccctcccccaatgcactttactgtgtgcccaatccaggagctgccccgggagcagcctctgccccctggccccattggcacagaacgatcacagcgtacagaccgaggcacagagcctggccccattcggccatcccatcgacctggtcccccagtccagtttggcactagtgacaaggtctgtgtgggctggatctgggtatcctgagttgggtggagagaagggaaggactaaaggtgggacatagaggacacatgtctgtcacgggacaatgtctcctgccttcttgtgatcacaggactcagacttacgcctagtggtaggagacagcttgaaagcagagaaggagctaacagcatcagtcactgaggtaagtgggagtaagagtttggtggaaaggcccaagatttctggggaagattgctgggagtgaccagggcgtccaggatgccagacatccctctccacgaggcctctccttcccaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcaggtaggccccgcttcccattgcatgaccccttcagtgaataataatttttttctgcctggtatgtatttataatcaagcctttctacgttgcagagttgtgagataccactttgtcacatcatttttctccctactttttgcttctatgggtgggatggtgatcttttttcttgaccacagatactaaagctgtttcaaccgtgctcctctcctgcagatctctgggggagccatggactctcaattacatccaaacagtggaggcttccgccctgggacaccctcactgcacccttacaggtaagactcgatgcctgtggatcacagaagtacttggagatgtgtttcggggagagggaaggggaagacacagttctagggtactagaagctagtggacttaaggcattgctaggactctggcttcctaacagcttttctccccacaatttattttcagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtaagaggggggcaggtattagatattgggggatagggtagggagaatgattttgtgggggttgatatatttctccctgtttcccgacaggtacgccaggatctgccatccccttcggatttttattctactcctctgcagcctggtggccaaagtggctttctcccttcaggggctcctgcccagcaggtatattgtatcttcacacttccccttcatttgatttctctgtccagttgctggctttgattttccctggttttctgacattcctccctgcccccaacatgcacacccaaatttcttgttacagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagaggtaaggtacaggaactgaggggctagggagcgccaagacttgggagtagggattctgtatttcaaggtaggcagctcatgatttttttcccctcagctgcatccagtggaactaaagccgttccaggattatcaaaaactgagcagcaaccttgggggacctggatcatcacggactcccccaactggaaggtgaaacggaatagggatgtggactttccaagtgcttccttactttggaaccagggtctggatcctaggcttgccttagacgcccttcttcccttaggtccttctctggcctcaattcccgtctcaaggccacgccttccacctacagtggagtcttccgcacccagcgcgtcgacctttaccagcaggtgaaggagaaacccttgtggccccaactctaaattcgagttgccacctgatttcctgtccttccgtctcatcgctgacctctcactgtgactcactctttaacacatgcctgtcccctaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacttctacaatgatttgggggatgagttgtttgcattgtcttaaagcatggtgctgagtgatctgtagtttcagtcagggaaatattcattacttattccagtgagctgttgaaactaaaaacatgaccatcgtattggatctttaaatttttgtgagtctggaatttgggctgagctcagctggataaatctgcttttttgtgccagtgagcgaggtcaactggttatcagtctgcagctgacacctgggctggtcccaatatggcttcctttgcatatctagggccttggtgggacatctgtaacattactgggttatcaaccagtgtcttcacatggactctccagcaggcctgttaaatgtccgtgagctcatgttccaagaggtctagctggaattttctaagcttatgccatgcttagttgatagagcactaaactagccaaggtaggggatgggggggtttagaagggacttcaactgcatctcaaagggactagcaaagaatttgcagccatgggacttcagttctttatgatgaactaaggggaaatctctgttaaggcctcaatgttggagcacacttaaggggctctttgaattggatagaccaattccagcattgtcaaactaagtgggatttcacatggtaacgctgcatgctagttatgctaaagactatacttaggtctgcagctgctcagaaactttttttgatgggtaatttgagagctctatgctagtgtgcacctggaatatgctcccaactcaaaatacaggttttttatttatatataaagtgctttcgcacaaaaaatacaaacaccaggctgggcgcggtagcccacgcctgtaattccagcactttgggaggccaaggcgggtggatcacaaggtcaggagttcgagaccagcctggccaatatggtgaaaccctgtctctactaaaaatacaaaaattagccgggcgtggtggcggacgcctgtagtcccagctactcaggaggctgaggcatgagtgagaatcacttgaacccgggaggtggaggttgtagtgagccgagctcgagatcgggccactgcactccagcctgggagacagcaatactctgtctcaaaaaaaaaaaaaaacaaacatcaaaactggcttgtacaatttagcgtgctgagtagaacacaacagtgttccaaggaagtattaatttaaaaaagttcacacaagattaagggacacactacctaatggagacaatgtagagagaaagcagccagaaaaatccgacttttatttcttaaatactgtgaaggaagaggggggaaacggtcccctgatgaggaagggccatagagcaaagagctaaggatcatcagcaaaggcccgctgggcattggggaagcgctggggactgtagttggggtcttcctgcagtcgtttttgtatatcagaccggagctaaagagaaaaagtaagcaggttggagaaacgctggccaagtccctatgatcccagcaagcacacaaggccatccctcagaagctaacatttccccccccaagcacactgtcaaatagcccggggtggcactgtcaagccttcccagatgccaaaggggaaaacaaatggtagcaccaggctgaccagttcatcgctgaagggatccagggaagagggaccctagcccaacccctcccactagaccatccctattctgcttcaaggtggcacctgctgcctgtagctctcctgaacctctggtgcctccaggtcccggctcaggctctcggggctcgtcaggggccgagctccggctgccttagctgcccggctcacagcctctgagagaagcagctgggggccctcaccctgcatcgtctgggggacagggggttgggagggaaaagaggatcaacgtcagatccagtgccaccatccggctcaccctttccatgagtcaaccactccactgagtctccatgctagtggagaga

SEQ ID NO: 819 - DNA, 51540 bp, Human
ttgttgtctttatatattaacatatacaaggtctcactctgttgcccaggctggagtacagcagtgcaatcttggcttattaaagccttgacctcctgggctcaagcgatcctcccacctcagcctcctgagtagctgagaccgcaggtgtgtgccaccaaacctggctaattttttgcaccttttgcagagagagggtttcaccatgttgcccaggcttattgtcgtttttgatctctgatgattttcttcatttctcaccacctcagctacacattttaaaagatggtttacaatatttttgtggtgttttgtattaggagaattcttcagcatctgctgtctaccatattgtcagaaatggagtctagccatccttcccggcccatttcaaacgggttcctcttaggaccaggagacctcacattatgtgtgtcctaccttggcctgtggtttggtcacttgtgtgtgtgtgaacttcatcctccttgagggcaggaatatggtttcctctctttcgcttccacagagtcctgtccagagttctgcacaccaagactgtgtaaatgaatggaattgcatctgggagctcgaggcacccatgcaaacctgtgctgccagtgacttccaccagagggcagcggcagcaggtgccggcgctggggcaggactgggaggagtctcactctgggggcgcctggttccccgtggctctaatacttgccgcatcaaatgcatacacccacctttaggaccgaacccaatggaggaggaccgctcctcattccacatgttggggaaatgaagacaagcaaggatgcaggaagtggagggccaggagaggtggacctgggatgggaccaactgaggcagggccaggatttggaaccaaaccccttctggatttgaccacttccagggccctgcttggacaaccaaattatctattccttttctcattcaataaacatttattcacctcctaccatatgctccacagggagtaccatgggaattaaacacgcttggcccctgccttcttcctatagcgtcagtctgctgcagtgcaatggggcaactcggggtttctcaggcagccctgggcttccttccttcagccctttgctcctgctattccttctggcccagaggcctcccatgattgctgtttgtcaaaatcctgctcagccttgtagacccagctcccatgcctgactcccacggaggcatgcccagtctggtacctggagatgggatagctggccccactgtgccatctgacggggcggctcccacaaggccttggcacccttccctgtagaaggacttgtgggatggccatctctcaggcccttcccaatttatatttctctgaggggagacttaggctcttatctccaaaagtgcatcaagaccacaccctccttcccaaccaccattgcacctaaggttaagataaaactcaggatttaatccaagagagccaaattacacagaccgggacaggcaatgggtcattcactccctcttccaatatgtactgattgagcagctactacattatcaattttttcttctgggccaccagaaatgaggcatggctcttccacttcccttcttcttagaagaccctcggggaagtgtgtctgcatggatgcgtgtgcatgcgtgtgtctggctccgtgactcttggggtgcagcctggatgggtgggctcccagcacaggcagctggggctctccccaccagcccctgtaacagcagcccagcttcctgcagaccaaaaccacaagcagaacaagcaggcgtgagacactcacaggttgggtttgatcgcatgcgtgtcggagaggagagagcagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtaggcccccttccctcatctcctgccactggtgctggaggagccgggtccggccctctcagtcccctttctggttgtttccttgtggtcacttttctaggatcttttagccaagactacactcaggtaccagggaggtccagcatctggggctaggagaggacacaggagcccctcgaggggctggggctgtgcctggaagcctcctggagtgacagaatgtgggaagcatgctttgtgccttaccaatgggtccctagggtgtgaggagggaggtgcctctcccatccttaagctcaggaactcccccatttcctatttcttgccaactcttaagaaggaaccgttcaccttccagagaggcgggaccactgatggtggtactttcaacgccaaagctgaggcttggggtccagcaggcgtaggccaatcacaggagagcaccgcccgaaacaggactcagggaagccagggagagttctggacaaccaggcgctgatggcctcagcacaaccagctggggtagtctagggcataagcgagcatgaaggccacccccacgtctcaagctgcccccaagtgtcaaggcacctggccacctgggccagggaatcagatggccagaaggtttggggcactagactgtgctccccagatacttgctggcccctgttgagtgcagggtccaagctggccagagcggggcaggggcctggagatgcaagagatcctgaccccatcgagctctcacattttgggatttgggaagactggtatggaaacagaattcgggccaggggagtctgggtccaccttgcagccagagagccaagtgctttcattttgtgatggaggagacccaggaagacccagtcaggagggggcatcgagctggtttggaggactgggtacatgtcgcgagactctgggcagggagtgctctcctctctgccttgatctccaggcatgtgttccgagcctgtggcctcatactggttcagggaaagccattcggctctgggaactggagtttgtgtgccttcagctctgtgcatgtagctttgccctgctaactctaccaggagtttctggagcagcagctctggaatttcagctgccttctgcccctgagctgaaacagactgtccgagagtggccccctttcctcttccccatgaagccc[450 bp omitted]ccataagtgaaaggtaaagggaaacataaaaacaaatggtggcaaaacccaatttctattacgctttagcaaaaagtgaaaagatcgtgaagacccagagctcatcccctctgtgaaaggggtgatgaggaggggagaggagatggcctcctagctctagcaggtattttcttcttgactttgcagaaggactgaaaacaccgtgggcagggaataatttcctcactctgcgatttcagagcattaaacgcggcttctgtaaactctcctgagggttgccaggggtgtatgtcctactgctgaaaaatatggcctctccaggcaggaggaagactgcaccttcaagcagccccttgcccctctccggggctgatgcaagggacactgagctgctacactccaggcctccctgagcttttcttcctctgtgtccagctcagcaggcccaaatgctagcagaacctgacctcagagggcaaggttgacccacatctgcttgtggggagtttgtgttgggccgaccatattggggaaaggagactaggacctccaaggagaaaaagaaggagaaagaaaaatgatggcaaagagggaggaaatggagctgggataatgaagtgcgtgtggaagtttcaggcctttaccccaagaactatttcagggtggggctgcctggctctgccctgggaccacaggcaggtggaatcctgccctcctttgccctggcagacctggctgaaaccttgctgtgctcgggcagacctcccctctccttcttcccccttttattttttaagacagagtctcgctctgttgccaggcttgagtagctgggatgacaggcatgcgccacgacgcccagctaatttttgtatttttagtagagacgtggtttcgccacgttggccaggatggtctcaatctcctgacctcgtgatccacccacctcagcctcccaaagtgctgggattacaggagtgagccaccgcgcccagcctccttcttccctttctaaccctagcacgaggccctatctcctgggcctctgcccaggtggcccgggtgctgggcctggcttggtttgtgttgctgatttctgttgcttagagattcaagcctccagttctccgcctcagtttcctgatcagccaactaaggatgaaggaacagagagaatgaattaggagcccttgacaggggaggctggggtggcatcatgagaccccaggttctgccctggtcccgtctctaattcaccattgactgtgcttcttttcttctcagccatgttttctcatcagtggaaggggggtgctctgtcagacaatctataagaaagcttttgtccagatctgacactatgacgcagtaacaaagccccaggcctttcccgccagggcagtgctgagctccgtgactctaatgccagctgtgctctggctggcgaggtcctcgagggctgcctttgtgtatgaaaaggctgtttgtggctacttttgaaaaaaatagtaattctttaattaacaattttttaataatttgttttttcttaacttgtgagttcaacatactaatcatattttataagccctgtaattttgattaatgactttcgatgggcctttaatatttgagcaaatgaagttgaacagacctagcatccttaaataataaatacccttacaaatgtagctaatcaaactcccttggttctgtgctattccatagggtagcccctacaatcacgcatttaaaatgtgatggtagtccaaattgagatgtgtaaagtgtaaaatatgcaacaggttttgaagatgagtttcaagaaagaatgtaaaatatttcaacaaattttatgtgatttatatgtcgaacttataatatttttgatatgatgggctaaatgaattctattatcacaattaagtttacatattcctttttactttttaaaaatggggtttctggtctggtgtggtagttcacacctgtaatcccagcactttgggaggccaaggcaggaagatcgcttgaacctaggagttcaagaccagctggggaaacatggcaaaaccccgtatctccaaaaaatacaaaattagcctgaagtggtggtacaagcctgttgtcccagctactcggaaggctgaggtaggaggatggtttgagcccgggagtttgaggctgcaatgaatgagccattattgtgccactgcactccagtctgggcgatgaaggagaccctgtctcaataaaaaagtagggggagggttgtcctggaatatttaaaattacatgcgtaacttgcatcatatttatattggataacactgcttttgatattctaagcacatttataaatatgatgaattccatattttatagagcatgaaacaaaatgttcccaagaattttagaaaatgcttttagaactaaaaaactagcataagtgaagtgaatattaagttatttttaaaatttttatagatatgagggtagaagtgcagttttgttacacggatatattacgtagtggtgaagtctgggattgtagtgtacccagcactggagtgttgtacattgtacccaataagtaattttcattcctcactcccctcccatcttcccaccttttggaatctctgatgtctgttactccattctgtatgtccatgtgtgcacgttgtttggctcctacttataagtgagaatgtggtgtttgactttctgtttctgagttattaaagcgaatatcaagttctcttaaatattctaatgtttacagatattgtcaaattctcttaaattttctacttcaaaattgaaccgaagtcaattacctgctcacattcatgaggaactcaatggccaaatgtttttaaatatcacaaatataggactttatgcaactcacggagcttgacccaacttacatttaacaccattggatatatactatgagtgtttgtttatttaatcatctctattttctaaattctaatcttcctgggtttaaaagccacttaccaaggaggaaacaatggcgccattgcaggtaacttgggttatgccaagcaggttgaagtttttccatctcagtggactgagctgaggtcggtgtttttgttgttttgccaaaacataagatatggttcccctgtgttgctgatggatgcgcttgtgccctttttgatagtccgtgccctctaactgggctggctccttgacctatgaactctgaatccaagttatacaaacctaatcccctacatctgccgtgcatctggccttattgtttgattggactgaattaaacacacatgtttacttttctattctgacctcttttcacattcttcctgcctggcaagacttcatctcatagatacataaataatttatgacaggcttctgcatctttctcccggcttagcttggctctctggccacaggtcaatgactgatgacagttagcgtggccttcaccgtattggggccatggaacggggtagctcctagggtgctggagctcgaactttacagagggatctagaatgagtgagaaatgctgcccatggccctcctcattcagaccacatttattaaggctttatttattatatttatagaacactcaagaattaaattcagtacccagctgttagattctgagttaaggaatcagacttctccctggggcaaggaggaataaacaggtggccccaactgtcctttaggacaggagcttggagtgtagacctcccaggtgcgtggccatcctctccctgcctggaccacagatgggacaccatgagctttaacatccatgccatgtgctcaggcctgccctgagcagccccctggtagggctgggatccccaggctgtatctacttcctcagctagcaagacctccaggccctccatcctgtcctcggcactggcccttctccagactcagagcatggtaagttatccagcatagctcttcccggagcactttattccagcccaccttcccagtgttggccaaggtgtcatccagctgacaatttacttaacgtaatttccctcctttttctttctttcttttctttttttttagatggagtctcgctctgtcgcccaggctagaatgcagtggtgcagctcactgcagcttcaaactcctgggctcaagggatcctcccacctcagcctcccaaatagctgggattacaggcgcctgacaccatgcctggctactctttcttaattgatgttttaaaatgcaaatacatttattttgagaagaaactttatatatcactcccttaaatggaaagccattcattataaatcaccatcatgattataatggtgaaaataaacataatggaaataaaacaatgttactaaattctagccagatgcatttgctgctttccctttcctcaaaagggagggctgtagatgtcagagagactttaaagactaaccccatgggagatttcctcctccaagtctgtaattagaaaggctgaaagggaaataaagagtatgcataacttcctcatcatgtaatatagtggtatataatgccaagtcaatgaccacctaaatcaattttgcatagttttgtgtatgtgccctagactttgaaaacactgatccagagaaaggacaaagggggtgggcatggtgtcccctgacaagactgagcctggggacgctgactgctctgcagcctggggttacgtcctacacatgagacccccatttcaggggctccccagtaccctgagaagtccctggattttcccagtgagccctgaggttggggggcacccgagttcacctcccttgattccgctctgggaatctaggcccctgcagcctggggaggagaaggaaccttgaggaggggtgaggtgggtgtggactttgagaactagctctggtcctaacttgctggggaatcttggtcaagttccttcctttctctggccctagtttcctttctggaaaactgggtaaattgaacactaaggacccagcctaaacatgcttgtactttatgtatgttccttgaggctttacaggttatggagcagggcatctggctgtacgcagcagagacccagccactagacacttagccctaggaagggcactgtatcaaccccagccggcatcctgtcgtatagaatcatggaccccggagtcaggcagacgcgggttctgaattgcatctctgcatggccccagggtggtttctttgcctgcatgctagagataaaaatccccaactcaccaaagtgtacaagttaatgtagatgatgcatctgaaaatagccgaacaaaatgcagtgctcagaaatgttagcttataaatgctctacagcaagaccaaagataatcccttgcctatgtgaatacaggactcggtggttaacatagtgctgtttgcacaatgagctccatcacccacatggtgacctcattttatagatgaggaaactgaggtttagcgaggctaagagacttgtcaggacctgagcttgggtctcccagccagcaggctggtgctttttccattgtgtgggagttgcctggcttgtttccagccagctgtcctgtgggctctattctagcatagggtttctcccctaaatgcaaactcctagccttgcagcctcaccactgaatctaggaacagccctgagggacctctgaggtcctagggaccctggaagtcttcttagcaacagatggggtcaagtgtggctgcctccctcatcatggcacgccctcatggggtttgcctgggggttgccctgcaccttggggccagcaggaaggcaaaattaaagaggcaccatgagccaggggagagcttgctgggcagcaggctccatattttgttttgttttcttttttttttttttctttttgagacggagtctcagtctgttacccaagctggagtgcaatgctgcgatctcagctcactgcaacctccgcctcccaggttcaagcaattctcctgcctcagcctcccgagtaaggggaccataggcacccaccaccatgcccagctaatttttttgtatttttagtagagacggggtttcaccattttggcaaggctggtcttgaattcctgacctcaggtgatccacccgcccgcctcagcctcccaaagtgctgggattacaggtgtgagccactgtacctggcctaggctccatattttcatattcattcagtacctgctgagtaccaggccctgtgctggcactgccataggacatgaaggtttgcccttgaacagtttatagtgttgtggtaagacacaccagcaccaccccgggataggtgtggcaacaggcacaatccagtgacagctgcaaccaccacccattaccagggacttaatattctccaagcaccagctatgcatatgctgttccaccctgacaacaccaggacaatcaccccttttttatgggtggagaaactgaggctcagaaagttatgtattttgtcccaggttggtggctaatgctgaatttaaatccatgtcatgatatgtcaccactgggggaagctgactgatgggtacacaggatttctcttcactattttggcaacttcttatgagtccatagtttgaaaataagaagttaagggggaaaaaaggatttcagccctttctggtggctcacacctgtaattcagcacgttgggaggccgaagtccaagagttccagaccagcataggcaacatagtgtgaccccccacgtttacaaaaaattaaaaagttagccggatgtgagattcatgcctgtagtcccagctactcgggaggctgaggcagagaatgacttgagcccaggaggttgaggctgcagtgagccatgatctcaccactgcactccagcctggacaacggagcaagaccttgtctcaaaaaagaaaaaaaaaagtatttcagaaagaaggacccatttgaaggccgggtgcagtggctcacgcctgtaatcccaacactttgggaggtcaagtagggcggatcacttgaggtcaggagtccgagaccagcctggccaatatggcgaaaccccgtccctagtaaagaaatacaaaaattagccgggtgtggttcgggggatggggggcacctgtaatcccagctacccgcaaggctgagggaagagaatcgcttgaaaccgggaggcggaagttacagtgacccaagatcgcaccactgcacttcagcctatgcaacagagtgagactctgtttcaaaataattaattaattaattaaattgaaagaaagacccatttgagcagaaacctggaggtgggacagcctacgagggcccggctgaggggaggtgctgaccagccagtccggctggtcctgttgggtcatgttgggtaggcaggactgaaattcccaaaggagctgaggtccaggctcttttctgcctcctgacccagactggtgtgccatgaggattcaatgagcgccaagcacagggactggcccacggaaggtgcgccacaaaatgtacatttacaagtgttaggcaggcagtacaaggatcacgtcctccagtgcagcactctgcaaatacgtaaacctgccttctcctcgtcacagccctaaggaggtatgcgctactatttaatacttccattttactgagtaagtgacaggctcagagagataaagtgacttttcctagatcgcaccactaatagatgacagatacttggttttacctcatgactccaaatccgttgctttttcccagccctggaattgggtagggtttgggccggggacccctccccactcaagactcctgcaggaaaggtccgcccttcccccagggacttttcacctcacccaccatcagctgggctgtcatggaactttatggagcctgagctctcctccttcaggctgagtggccatgcccagccttcgtttccccggctgtaaagcagggccaacgggagctcagagctgtgtggggctccccagatgttggcggtgacatgcttggagaaatgccaggctccttagggtgttaggagagacctgtggccacagctgctgctccgactgggaccgggcaggcgctcccagggacaacagagggaggcagagggaagcccaggttcccaccctccattttgtaggctcctgcagcccgaacgccttctgcctgaaaatggcggctgagagaggccaggaggcaggatgcagggctgaggaggaagctccggggctgggtctctggtccctgggagatgctgagagatagggagatggccctgtcataggaatgtggtcccctgttttcccttgtatggaagggtgcccctgggtctccaccgtgtgctagggggtgggggcacactcaaaagtccggccaataagtgtccaggccacccccaatctccatcaggaccctgagctgggctgaggtctccgggaggtgccagcagatgccagggtggcggggggggggttctgtgcatggggctggggacagcagatgcccgggtggggggcggtctgtgcatggggctggggacagcagatgcccgagttggcgggggggggggtctgtgcatggggctggggaccagggtcatgtggggacacaggctgtaagagtgacgaggggccttggggctaggggcttcttgggggtcccatctgaggacctcacttctgacttggagtcatgtactgagccctgtggcagggagaaggcagaaatgaagtcactgtgtcctcggagtcagatgcaaagccaagcgtgactctgttcattttacagaaggacagactgaagcccaagagcttaagtaacgccgccagtggctgacagagctgggagcagagtcacttctggtcactggggtttggagggaggatgtttatctgcacttcagtaccctttttgctagggtgttcacctctttcaggaggggtgcctgggagcaggcgggcgcggggagacagagctgaggaagccccccaggcctggaggaggcccgttccccactccacttggtgtgctctcgttttgcctccctccctccttcaaccaaactaaaggatgcacagttgccaaatggattcagctccttggagaaatatgttgctttgccgggatgggattctagaagtatgacaatgtctgagctggaagaaaccccagcgagctgccagccatctcctgtttgtcagaggaggaaagcaaggtgcgaagtggggaacgacatgccccagggtcttggagcagggctgagaagcccagtctttccagggcctcttcccacgctgcccagcagggcatggcggggcctgtgtgaaccaggcacaggcttaactaactccccacccccacccctagagagaatgcgggggactgctatggcccagtgtggcctgacatggtctgacatgaacacaggtgaccctgggcagtgacatgctggcttcatgtagctactctgcccagcccctccaacggctcctccagtcctcaggctctgcctcctctttgtttttttacttcactttttttttttttttgacggagtctcactcttgttgcccaggttggagtgcagtgttgtgatctcggctcactgcaacctccacctcccaggttcaagcgattctcgtgcctcagcctcccgagtagctgggactacagtcccgcaccaccacgctagtttttgtatttttagtagagacggggtttcaccatgttggtcaggctggtctttaactcctgacctcaagcgatcctcctgcctcagcttcccaaagtgctgggattacagacgcgagccactgcacctggcctgttttttcacttaacttttaatttcaggctaatttcagacttactgagaagttgcaagaacaatacaaagaatttccccatgctcttccctcagactctccaactgctaacaattttccacatttgctttattatttcctctcaatgtgtctgtttttctattgctttccccctaaactgtttgagagaaggttgtaatgtccctttctcctaaataccccaacgtgtgtttttgttgttgttttttttttttacatacggacattttcttacataaccacagtgtacttatcaaaaccagataattaatgctgatacaattctattggataatcgacagaatttattcagattttgccaatggttccaataatatcttctaagacaaaagaaattttgttcagtatgctgcatttaattctcgtctctctattctccttgaatctggaatgatttctcagattttctttctctttcatgtcattgatctttttgaagcatagagcagttattctgtaaaatggccctcatctgggttgtctgatggttcttcatggttccatttaagtcatgcctgtttggcaggaatatcacagaagcacgttttgtccttcccagtgaatcatatcaggaggcacatgggctctccatgtcccctctccggtggtctaacttgcttggctaaggtgttgtctgctagatttctctgctgtaaagataatttcctcctttgtaattaacatgtatcttgtgggtagattctttgagaatatgtaaatatcttactcttcctcaaacctttgcccactagttgtaacattattgttgattcttgccggaatcagttattataaggatggttacctggtggtgatattataattccaccattccttcttcattaatagttgctgactcggctctctttgctgcctccgtgggagggaggcaggtggctcagtgcatggcaggctggtactaatgaggccaaggtttgagctccctttccactgtgcctctggtggctgctgtcttgccccgcctcggatattggagtctgggtcagcacctctccaccttagggctagttctccctccatctttacaattttgccattcatttgttgagctactagtatgtgttaggcactttttttcagccactgaggatacgggacaaagtcccggtcttcaagaagcttctattctaatagggaaaatagaccaaaaacataaacacatttttaaaatagtatcatttcagagagggatatgtgcaccaagggaaatcaggcaaagtaaggggactgagagcggttgcactggagacacaggcagaacctcggaggggatatagacctgagtgatgagatgagctgggaatgctgagatcagggagaggacattcccgtcagggggaggagcaggggcggaggccctgaggcaggaatgagattgatttcagactgatggaggagtgaaggagatggagttggagaggctggcagggcttgagggcatagataatagggtttggaattaatccaagggaaatgggagctcatcagagagttttaggtgtagaaggatgtgatttcatttgcccttcatgcatatacaattacttaagaattttgtacatcaactcctttttttctttttttaaacaaagatatagaacgcttcacgaattcacgtgtcatacctgtacaggggtcattctaatcttctctgtattgttccagttttcgtatatgtaccgccgaagcttgcacccactcctttttttttttttttttttttttttgagactgagtttcgctcttgtcgctcaggctggagtgcaatggtgccatcttggctcactgcaacctctgcctcccgggttcaagtgattctcctgcctcagcctcccaagtagctgggattacaggcatgcaccaccattgcctggctaatttttgtatttttagtagagacggggtttcgccatgttagccaggctggtctcaaactcctggcctcaggtgatctgcccgtctcagcctcccagagtgctgggattacaggtataagccaccgcacccggccaccctctccttttataaacttaagtttatttgaacttagaaatctgtcactatcatgtatctcaaaccaatactacttaagtaaatagaatatatatatatataaacaaagaaaacactgaaaccaaaagtgtcattaaatagcctgccgtccaagcatgagctgtctctccattcattaagaagtgttaggtggccaggcacagtggctgatgcctgtcatgccagcactttgggaggccaagacaggcaggttgcttgagcccaggagttcaagagcatcctgggcaacattgcatgtccccatctctgcaaaaataaaatttaacaaaaagtgttaggtgttaaagactaagtagcagcacaatgagactttctccttaatgcagtcggacagaaaaattggaaaaggaataatttgtttactgcatgattcagttccatttaatcttatatgttaaactgtctttctgactcagacctgatttgagaagcattttgctaactggtggaaggatttgacaggcccagcccacccatttaaccatggagaaactgaggccttggaacggggcaaggacttacccaaggtcctggtaatagctgctctccattctactcaccctcggtatcactcccacccaatgctagctgaaaattcagatgtgatgtaaacattagtcatccttattgtaaaaacgttataacaaccacattagaaggaatgcaaagagagaaaagaagtctcagccagcaccttcacacaacccggctgtttgttcttgaaggaggaagtttttgagtctgtggagcgtcatgggccttcagtctcaccagcaggaaggtgggtggctgatgggtgccgggctggtgttgatccacacttgtcaggtggctctgagaccagccttgactccaggctccaccacttccgccatgaccttgggcaagttcccaaagctctctgaggtaaaatgggtgtggccatgtcactcttcagcttttgcgctctaggtagatgctaaagccttccctgaagatctctatggaacttttagtcacctgcatctgtgggggctgcctcagccctaaccatgtcaacatagtgttgaaattcagttccgagaaacacttgtgggtttgtagactctatggcatctggaagtgaaagagggacacatctctccctcttacgggttccttcccccgctctcaacgcccctaatccagaatgccctagaagctcttctcagctcccaccttctgccccggaggcagcttttgttgcaggtacacctgtggtttagtttactagagttgctgcaacaaactgagtggccagggcaacagaaatgtattgtctctccctggcgccgtggcgcacagctgtaatccctgcactttgggaggctgaggcgggcagatcacctgaggtcaggagttcaagaccagcctggccaacgtggtgaaaccccgtctctactaaaaatacaaaaactagttgggtgaggtggcacgcgcctgtaatcccggctactcaggaggctcaggcaagggaatcgcttgaacctgggaggcagaggttgcagtgagccgagatggcaccacagtgcgagactccatctcaaaaaaacaaaaacaaaaacaaaaaaaccagaaatgtattgtctcacagttctggaggctcaaagtccaagatcaaagagtcagtgggactggttccttctgagaagctgttctcttctgagcttctggtggcttgctggcaatcttgggcatttcttgacttatagaaacattgccccaatctccgccttatcttaaaatggtgttcttatgtgcatgtgcctgtgtccaaatttcccacttctgtgaggacaacagtcatattgaattggggcctgccctgatggcctcatgctaacttgattgcccctataaagaccctatttccaaataagctcacattctggggtactggaaattaggactgttttaagaggaggggaacaattcaacaactcgtagcaatgtatgtagtgtgtatagggtgtgtgtgtagggtgtgtgtgtgtacatgtatgtatgtgtgtgtggtgtgtgtgtatggtgggggggtatggagaaagaggtgggtcactgccctacttaatctctcctcctagcccactcatcctctggagagatgcaagttagatatctcaggttatttggcaaaggcctggaaagaggtatctttccagaggagaggagttacccctgagaactcctactcatcctctaaaacccttcccaattgtcccctgtttcttggagtcagttattccctcctaactctgttttttttccagagtacttagttccaagcccaaggatagcatttataactgatcgtaatcaaccacgagtgcatctgtatcctccaccagggcatggggcctggcccagagcctagctgagagaatggaatgaatgagtggcatctccctgaccaagggttaagatagatgggaactcagaaggactttgagccgcctcagaagcatcctgtaagtgacttgtgaagaggagtaggggacagccgtgtgggctgagagctgagagtgtgagatcagattagagagactggaagtctggctccgcctcttagtaactgtggccttgggcaagtcatttcatgctgcggagcctcagttttctcatctggaacactgagccttcacaggctcctcatggagatgaataagacggtgcgtgctgtatacataaagctggggcacacagtgggcattcagatgttaccttccttccaaggaacccatatttttttcctgaatttgaattcctgaatccactggcactctgagccacgtagatccacatggccattggccgctgtcagcccccagctgttaaggacgcaaggtggccacaaagcattagtctgaacatccctggtgcctcccccaggttctctttgaatctggatttatttaaagagaggaggtgagtggtaggtgaggagggggctgttgttaggacatggatgggcacaggacatgtgtctggtgagcgtagctgccagggccggtccctgacaccccaaggagactttctggtcccagcccagcctacactcccacctgctctggagaggctgtgtttccttccaaggatggatgctgatgatgtctgatggcttctggatgtctgatctcaaggggaccttctcttagggggctttaggccaccctggaaaggtctcagcatcaccccttggagcggggaggattttcaccccttgcccacacacaagctaaaactgcttctgctgcagctctgggagacctagaaccagggcccctcctgagagccagtgggtgggggcaggccccctggaaaatcgctgagagctcagcagtttcagccttcactcccctcctcactcccctcctccagcctgcagaaacctagcccagcctttgcacagagggtcttgctctggggaattctattcttgaatttaataccttgagtgtctagcctggcccaccagcttctgtcccacctccaggtgtttgctcgagctgtgccctctccctagaatgccttcttaactcttgctacttgttgagggtgcctgaagagtagaaagagtgaatctggggaacaaattcaaatttggatttgaattctggctctatcaatgccaggctatgtgaccgtgggctaggaacttaatttccctgagcctctttgtaaaatgggtttcataatagtgtctcctcacaaggtagccatgaggcaacgtctgtaaagcactcagcacagaggaagcactcggcacagaggaagtcctcgggaaatgtggatctgcttcccttgcctcagcgaaatgctccttgactttgaagtcctggcccaaagggcacctccccggcaataccttcctggactcactcaccagccccaccacttgcagagcagccctgtccctcctccaggttcctcaagcatgtctcctgcctctgcacctacctcagagagacaacattcgagtcagctcttaacatctggcctccaggctggaccacgggctctattacctttactttccacggcagagcgcagcatggctcaagaaatgctgcgggaggtgaagtgagttctagggacttccattaataataagagtaactagaatttgttgagcattcacagcacaccctgaggtgtttatcagagcccaggaaaccctctttctgggttcaaatccctgctctgcctcttaggggctctattgtcccagaaagttccttgtctcttgaatcctacatttccccgcctgcacgatagtgataataacagtgcttacttctgagcattgttaaggagattcaagaatttaaaactataaaaacccatggctttcttacccagagaagggcagaaaaatcgttggcagggtgcattgatatgactcggacaatttacaaaggtttttcatatatgcttttattttaaaatttttttgtttttattttgttttattttattttactaaaattttatttagtaaaaatagtacagaatttagaaaatacaaaaacagaaaaatttaaaaatttatcaatagctaccttcaaagataactgttgttactagcctcttgtagaatcttccagacatttcgttagagaggaatattgcaaacatacagaaatgcattgagaatgacatttgtttatttgtttatttgcttttgagatggtgtctcgcactgtcacccaggctggagtgcagtggtgcaatctcggctcactgcaacctttgcctcctgggttcaagtgattctcctgtctcagcctcccaagtagctgggactacaggcacacaccaccacacctggctaatttttgtatttcagtagagatggggtttcaccatgttggtcacactggtcttgaactcctgatctcaagtgatccacttgcctcggccttccaaagtgctgggattacaggcgtgagccaccgcgcctggcctgagaatgttttaatgaacccaatgcgtcctcaccacccagacttagaaaatgtttacacttttgccgtatttgctcagatctatattaataagaaagaaaaccatacagatactgttgaaataattcttatcctttcctccctagaacacacactccaaagtgtggtgtgtgtacccttttctcccacatttttatactcctattacacaaaaagtgtctccatacacaatggatggtattgagacatgtactatattttatataaattgtaccctactggacatattgttctgaaacttattatacttttctccttgttttcaaaatctaaccaagtggatagatatgcatctagttcattcctgcaatggaataatccagcctatgatacaatacagtctgtttatttccagctgatggatggttagagtacttctaattttcttctgttacaaacagttccgcagaaagtatccctgcacacatctgcatgtgaacaattttttctataatttatacaaaagggtatagctttcagatcaaggtatgagcctcttgaaatctatgaggtatcatcagccatttccttttctttctttctttcttttcttttctttttctttctttttttttttttttttttgagacggagtttcactcttgttgtccaggctggagtgcaatggctaaatctcggctcaccgcaacctccacctcctgggttcaagcgattctcctgcctcagcctctcgagtagctaggattgcaggcatgcgccaccatgcctggctaattgttttgtatttttagtagagacagggcttctccatgttggtcaggctgatcttgaactcccaacctcaggtgatacacccgcctcagcctcccaaagtgctgtgattacaggcgtgagccccgcgtttggcctcatcagccatttttctctgcacaatatccataaggctatgatcatcctgaatatgttgtttttcatctgttttttccatctacgatacatatatgcacacatattcatctttcacgtatttgcaggtatagtcattgattccacaagatcttgggcatttgccatgggccaggtattgggggtttttatggtaatctttccttagccctgtgaggtttttgtttcgttttcattttagaggtggaatctcaccctgttgcccaggctggagtgcagtgatgatcatagcttactgcaacctcgaactcctgggctcaagtgatcctcctgcctcagcctcctcagtagctagaattacaagcatgtgtccagctaatttacttatttatttattcatatatatctatatatatgtatatatatatgtatatatatctatagagagagacaaaggatctcactctgttgcccaggctggagtgcagtggcaccatcttggctcactgcagcctcaaactcctcggcccaagtgatccaacctcagcctctcgactagctgggaccacaggtgcacaccaccatgtccagctaattttttgaattttggtagagacaaggttttgccttgttgcttaagctggtctcaaattcctgcgctcaagcaatccacccaccttggcctcccaaagtgctgggattacagcgtgagccacagcacccagcctcatttttttatttttaaatttattttgtagagatagggtctcactgtgttgcccaggctgttctcaaactcctggcctcaagcaatcctcctgcctcagccactgaaagtgctgggattacaagtgtgaaccactgtgcccagcttgtgaggcttttttttttttatatataactatgaggtgagggaggcaaggggggcatgtgaagagattcgcccagggtcacactatagtaaggaggaagctgggtttctaacccaggcatgtttaatttcaatccagtgttctttctgatgcctatgatgtggtagatggttttttcccaaccaagacctactgaatgggaattctaaaagagggacctgagggccgggcgctgtggctcacacctgtaatcccagcactttgggaggccaaggtgagcagactacctgaggtcaggagttcaagaccagcctggccaacatggtgaaacccggtctctactaaaaatacaaaaattagccgagcatggtggcgtgcacctgtaatcccagctattagggagactgaggcaggagaatcactagaacttgggaggcagaggttgcagtgaaccaagatcgtgccactacactccagcctcggcgacagtgtgagactccgtctccaaaaataaaaaaaaataaaaaaattaaaattaaaataaataaataaataaaagaagcacctgaatattcttctcctcctctcagtggtctaaagtctggcgggggatcaagaagatggggctggtgacatgccagtgtttctggcctgctgtgctctcttggagccaaatccctactcttatcccttgggattttactgagctgcttgcaaccctccatgggaccttctcattttaccacctggtagctggaaagaaggcacggtctggcacgggagcctgagccagccttggagccaggaccccaggagacttttcttttagaggaactcctgttaccacagcaactacagcccacatctcctccctaggaacactggatgtttgcagagccggggaagggtgcagccaagttgagagtctgcagcagctcagataaggttcacaagaaaggcgaggagtgaggaggagagaatgcagccttcagagaaccagaatcacccccttgcagaaaagaaggctaaggagctgtcagagtcatctttctgcctggtatggaatgtagaatcaatagccagctgccgtcccatagctaccaagggccaaacgagagaaaagggatgaaagcctcaggttggaggataataacaacaacagctaccatataccgcgtcctaagcgttttacgaagatcacccacccgtgcactcttcttctgtttggctcatttatcatgcccagtgccaggttaaagatgaaacctagctgggctcagtgactttccctaggtcacacagccagtaatcagcagagatgggtttagatcactgttctatctgtccccagagtccctgtctaagtcatgaaagacgaatttcccgagaatggaggctgtttcccagatgaattggtgcctgggatctcctgctccctcgatcatcccgctcacactcatctccctcatatcatacctgccccagttcccagcatatgcaacaagttcagcagatgttcatggaactgaatgcaggctggcaacagactcatttctcagctttcaggagaacatggctcacgccctctcactttcttgggagaggagggggagtcccagcaattgaacgtacctcaaagcctgttaagtcatgttgatcttatcttttaagttttttacagaggcgagtaggaaacgttgtcttttacttccccttggatttggtgacagagaggaggggagatgaaacctgggcatgcatggaaggtatcacgcaggtgaacatcatctgtcctgtgacataggggcaaaagaaaggtaaaaaggctgaatttctggccgggcgcggtggctcatgcctgtaatcccagcactttgggaggctgaggcagggggattgcttgagcttaggagtttgcgaccagcctgggcaacacggtgaaaccctgtctctagtaaaatacaaaaaattagccaggcgtggtggcacacacctgtagtcccagctactcaggaggctgaggcaggagaattgcttgaacctgggaggcggaggttgcagtaagccgagatcgtgccactgcagtccagcctgggcaacagagtgagactcatcccctccccaacacccccgccaaaaaaaaaaaaaaaaaaaaaaagctgaatttctttgacctgagtgactgcagtcctctggggctgggactctttgagccttaacttccatccgtctctgtcaattgagtaaattgttttatttgtgtccccaagccctgctgtggtataactggggagtgtgaaaacaaaccaaaatcctgtaacataataccaaataatactcactctctttctctttctctctcaagaaaatgaaagcacatgagccaagttctcctgaaagctgagaaatgagtttattaccgatctatgttccgtttcattaacacttgctgaacttgttccacgtgctaggaactgggacaggtattcgggagataagtgtacatgtaaaataataccaaagcaccaaactgctgactttcctctgggcgccaggggagagaagtcactctagccttcctggccttggagagccaagtgggtataagctggtctagtcacagcagccagtcacctctgcaggctaggacagcactgtgtgactgagcctgtgacagcttcagtttcttgacaaagtaaactcagcccaaccgggtgtcacaggctcttcaagtccaagtcccctcaaaggttgaacacatttatcccctcccaattgaattatattatttgtatgagccagcgcatgcgtctttttttttttctttttctttctttctttttttttttgaaatgaagtcttgctctgtcacccagcctagaatgcagtgctgcaatctcagcacactgcaacctccccctcccggattcaagcgattctcctacctcagcctcctgagtagctgggactacaggcatgcactaccacatccagctaatttttgtatttttagtagaggctggatttcgccatgttggccaggctgatctcgaactcccgaccttagctagtccacccacctcagcctctcaaagtgctgggattacagatgtgagccaccaggcccagcccgcatctttctaattttaatggaattacaggcgttcccttctttctagttgttttattaattgctcaccattaacaataccaagggcatttctaaaaagaaaatagttaggacagttccagcaccctctcactcagagcttcctcccctaaattcattggccctcctcttccaattggccgatgcatcctcaggccctagacagtgctggagtgagccccatatttgagagcaagtggggaaggggtgggggcagtgcgaggtgagactattaagtctcatcttttccctgctgtgaggtctgtgggatgacacatgccacccaggaccccctgccccggagaaggaaggtttcctagttgttgcttatctttggagtctgggatcttttgggaaatgagtccctggatcttgggttctgagttgtgtcaccattgcgggggaagggtgggttatcatttctaaactcagtgctggttgacacttgcagaggagaaaggagtttggaaagcctccagggttgtcaaaacttcctgcctctcgcccttggcatgatcaccaaagcagaaatcaggatgttggattccaacccgggggagtggtgtggttacgaatgtggcctctgcaagcagacagcctgggttcaattcccagcttggccattttctagccgtgtaatcttaggcaagatactaaaccgctctgtgcctcagtttccccatctcgtggtcttgctttgacaattaaatcatactgaataaatgtcagccattactgctgagctgtgccagatttgtgacgggtgctcgacgtgccttggggcctcccctttccctatcagagcagtgggaagcatcacaacatccttcccttatccccctgcactctggaccccagatgcccgagataagtagctactcccatcagtgtgggttgggagtagaaaactaggagtccatctggctgcttcccaaacctgcaaaccaggaatcccagtccagcttcccggccactgggcaaggggcaggtgagtgtttccggacagctccctgaaccagtcctgctccacttgaatacctggagtctgagccagggcctcgggaggtgggcccaccagggttcacgtagcatttgtcatcactgctcgggacaaaaggccagtcttcatacacaagatgcacggtggtctgcaggttagcagggagcacgcctctcccaaggttcggggacactagtcacaagggcctggtgccagtcttgcagagaggcacaccctgccctgtcctggcagtgctccagagcagcagctggactatccgggagatcactgcgctgcactgggagcctgacctccccgtgggccttggggatactcttcctttgggccgcagattttgcaatatttctgacaaaatacttgctgacaaaaagccttctgagagaagcattattaactccagttcatggatgacagtctaaggctcagactggcaaagtgactggccaaaggtcactccactaataaggaacagagctggactccagcccaagcctttgaactcaaggccttgtaaggtacataggtaccttccccccatacagcactgtctgatgtcaatatgtgagtcacatttataattttaaatttttggctgggcatggtggctcatgcctgtaatcccagcactttgggaggccaaagcaggtggatcacctgaggtcagaagttcaagaccagcctggccaacgtggtgaaaccccatctctactaaaagtataaaaaaagtagccaggcatggtggtgcgtgcctatagtcccagctactcagggcgctgaggcaggagaatcgcttgaacctgggagatggaggttgcggtgagcccaagatcataccactgccctccagcctgggtgatagggcgagactccgtctcaaaaaaaaaaaaaataaaataaaataaaataaaaataataaataaataaatttttagcagctgcattttttcaaaaaagtaaaaagaaacagatgaaatttctttaataatatatgttatttaactgaatatatccaaaatatcatttctacacatcaataaaaaaattcttaataagatactttacattctttattcttaccaagtctttgacacacaacctgtacttcacacttaaagcatgtctcaatttggacactcaagtttcaccagaaacattcaatctgtatttagatttcatactagttacaattgaaaaaggagaatcacatatctaacttactctggccatttgaaaaggttttccaatgattgaattgattatgcctttaaaattaaatggaaaacattttgtaaattaaatagaaatgaattgaattaaataaaatgaaattttgagtttctcattggcacgaacccatttcaagtgctcagtagccacacgtggctggtggctattgtactggacaacacagcaccatatgattttccctccgagtggggctgagtgatctctaagcccttcaaatgtatgctcctcccctgcgtttatacagatgagtgctttgtgtaccatgggcccacttccgtgatgataaatggacggtgtaggacagatttcccatctatattgacagcatactgaaaacagtatgctgtagtagttaaaagggtgatttctagagccagactgtccaggttcaaattttgctttgattactgaccagctgggtggccttgggtgatttacttaagctctctatgtcccagttttctcagtgatgacactgggatgatgatattaatagtatgcacctcacagggtggttgtaaggatttgctagtacatgtaatgcacacagataaccgctatcatctatggggcatacagtaagtgctcaagagatgttgcctttcattacatattttatctaattataatcaaagaatgtaaggactggacaagatcaaaatctcatcaatctgtcattatgcaagtgacaaaacggggccagaaagtgaaagaactcattcaaggtcatgtagcaagttaatgatagaaatcaactgtcagctcctgacgcccaacccagtgaccctctccactgtgcccccaacaatgctgacattgccgagaagagacaccctgacctgccagccacatgagctcttcaattcttccctgggaatgagtatggctttagctggcgtggccacactgtctgcccaggtgctctctgcaggctcattggagcagggtgactgggtagtcagtatgaaagctcactgtattagtacttcaagctagcccacatgtccccccaggaaaaaagccctgtgtatttatttggggacttttaatttttatttgatatagaacatttgaaaaaattagaacaacacaaggcagaaaaaaaaaaaaaaaaaaggaaaacaggccaggcacagtggcttatgcctgtaatcccagcattttgggaggccaaggcaggcggatcacctgaggtcaggagttcgagaccagcctggccaacatcgtgaaacccagtctctactaatatatataaattaggcgggcatggtggcacatgcctgtagtcccagctattcaggaggctgaggcaggagaattgcttgaactcaggaggcggaggttgcagtgagttgagatggcaccactgcactccagcctgggtgacagagcaagatagaaaggaaagaaagaaagagcaagaaggaaggaaggaaaacttattaataccatgtgggcatgtattttcttttcctatagtagagattaaatttaatttactgatattcttttagcatctctcctgggcaaggcactgcgcaaggtcctggatatatgggggtgatgcttagaatctagtgagccgatggttgtcagttcatgaccaggatagctatgtaattaaatgtggctgggcccacatgaaaaaaaatctcaggatgcagtgagaggacagaatgggagattgtactcgggctctctgtgggtcctggaaaaccttcagaagcttaaaacatggcggggggtgaggacggggactgaaggggagagtacaaccatacttataacataaccctgtattctgcttctgccacttaacattgtggcataaacttatccccacatcattaaatactccctgtaaatttttttttggcaaatatttttaatgtgctatatttttctaaccaaccccccaatcacttttagacaatccagttgtctccggtttgaatttttttttggtgggtttttatttgtttgtttttattatgctatcagaaacagcacagggtcgggttctgtggctcacgcctgtaatcccagcactttgggagcctgaggtgggcggatcacttgaagccaggcgttcgagatcagcatggccaacatagtgaaaccccatctctactaaaaatataaataaaaaaattagccaggcatggtggcaggcgcctgtaaccccagctactcagtagctgcggcaggagaatcgcttgaatcaggagggtggaggtggcagtgaaccgagatcgcatcactgcactccagcctgggcaacagagggagagtgagactctatggcaaaataaaaataaaaataaatataaatataaatataaaaaaccagcacatcacagcattctggggctccagtggatggaaaagggaatctagaaccatctagttccaaagcatggactttagtctccaggcagtatggtacttgagatagttttatttaggataggttcccagatgtggaattactggattgaaagagcttggtttgctgttgttgttaaggctgttggcatctgtgtttgcaaacactttctgttgatttttttttttaactatacttctagcaggtgacacatgcacctggctgcaccacttgtagattccacctccatgtttccatcgtccctttccaccctgcctctggctctgtacagcatctcttcatccatcatccactcaacgagcattcaggatgcaaccgtgttttcctcagcacctctgacagtgccggaggacagaaagtaacctcaggtgtagctggtgttgacctgacactggtcactgggcacggccagagcggcattctggggagtgccttgtttccccaccaggcttgctctgacactgggctggccagcgggaggctcagctttccctcgatgtctatgcctcctttctccacaagtccctcacctctcagatgcccatgggacatctcaggagcctgggtgacacaacaggagtatcagtgtcccgttccgttttctcaaattccaggcaacaaggctctttcgtgccttcattcttcctgtgcttacagtctcctccgcagcccgttccactggagtcttcttcccactaccccattggaggttctgtcccactcggggacttctgcatgggactggcctgaaaaagccgcctccttcctgggctggggtcggcactcccaacctctttcttctcctattctgaaaccagccgctcccctccatcccttccctgtcttgttccatcactttccagaatttgggacacaactagagatgattttcaggggcacacagtataacttcaggtggtaaatgaacttagcattaaataacactgaatcatgtggcaataaaagtttaaataattattatttttcaatgttttgtcattccttctgattctatcagatagtctgatgatgatgtgtctttttttttttttttttttgagacggagtcttgctctgtcgcccaggctagagcgtagtagtggcgtgatctcagctcactgcaacctctgcctcctgggttcaagcgattctctgcctcagcctcccgagtagctggaactacaggcacctgccaccacgcctggctaacttttgtatttttagtagagacagggtttcaccatattggccaggctggtctcgaactctggaccttgtgatccacccaccttggcctcccaaagtgctgggattacaggcatgagccaccgtgcctggccgatgatgtgtcttttaacatctctaacatggctttatttttagtatgcttgtttttacaattaccttctattttaagcaagtcatataaatcgtccctttaggttttaatatcttcttatttttttcatatcaacatacatacctaattttacatacatagaatcatatcatacatgatttttaaagtacagccttttaccttcattgcttgcttttcctccccctatcttccatggctgtgactgtgtcccacgaccagctgcatagtttgcagggcccagtgcaaaacggagatgcagggcctttggttcaacaaatgatgaggaatttcaagatggcaacagcagaggattcaagcaaaggccgggtccttctaagcacggggccctgtgcacagtccaccagcctgtggagctggccctgcttggccccttcccctgaagcccactcttaatttttccattttgattatctgctgtgtgttctcccacacttatcttcatgttcctgcaatcataccagttcacagagggggttttttggccttgcttcacaaaaaatgtatcatattatattctcttctctgcatcttgcttttcctactcaacacagcttggaaatcctgccaacccatctgggtctatttcattctttataaaggctgcataagatgccatgctgtaaatggaccgtaattgattcagccgtttcccctgtgaatgggcattcactctgtttctaacattttgccattcaaaaatctgcagtggactgggtgcggtggctcacacctgtatgcccagcagtttgggaggctgaggcaggcagatcacttgaggtcaggtgttcaagacccaacctggccaacatggagaaaccccatctctaccaaaaatacaaaaaaatttagcagggtgtggtggtgggtgcctgtaatcccagcaacttgggaggctgaggcaggagaattgcttgaacccaggaggtgaaggttgcaatgagccgagatcacgccactgcactccagcctgggtgacagagcaagacactgtttcaaaaaaaaaaatctgcagtgaacatttttatgatcaggtgtctttaatgatgtaaaaaagcaaattcacaggaaagggtaaaagtttgctcttactctgttttgtgttgctataacaaagtaccacagagtgagtaatttaaaacaaaaagaaactttattgtctcatagttctgcaggcgtggaaagcccatagatctaggggccacatctgatgagggccttctctctgcatcataacacaatggaaggcgtcacatggccagagagtgcacgagagacagagcgagggacggtggaactctcacttttacgacaaaaccacttctgcaataaccaacacacccctgtgataacagcattaatccgttcatgaaggcagactcctcatgacctaatcaactcttttcttttcttttcttttcttttcttttcttttcttttttgagacacagtctcgctctgttggccaggctggagggcagtggcgcaatctcagctcactgcaacctccacctcccaggctcaagcaattctcctgcctcagcctccggagtagctgggattacaggcatgtgccaccacacccgaccaatttttgtatttgtagtagagacagggtttcaccatgttggccaggctggtctcggactcctgacctcaggtaatccacatgccttggcctcccaaagtgttgggcttacaggcgtgagccaccacgcccagccctaatcaattcttaaacatccaacttctcaacacaggtcattgggggattaaatttccaacacatgaaccttggaacacattcaaaccatagcaggctccttttcaaataaatttattgcagcaaaaaagtgaaccaatttaaagaaaagtgtgaggcacagggccaggcaaaagtggtaacaatgggccgggtgtggtggctcacgcctgtaatcccaacaatttgggaggctgaggtgggcagatcacttgagctcaggaatttgagaccagcctgggcaacatgggaaaaccccgtctctacaaaaaatatacaaaaattagccagcatcgtggcaagcgcctgtagtcctagctactcgggaaactgaggcacgagaatcgcttgaacccaggaggtggaggttgcagtgagccgagattgtgccactgcactccagcctgggcgacagagcgagacactgtctcaaaacaaaaaaggtgataatgatgtctgagaaacgctgatcttccattcggccctctgtgaaatgaggcctggatggaaagacggttccaggtaatttctgcttttgttcctgtagcacagaagtcagagaacagagaagccaggttcccttcttgggataggggatgggagaatgcttgacacaaaaataaagccctcgaggttatccgctttcaaccagctgccttggagctggcagctgctgctcactcattcattcagtcaatcaacaaacattgccttggacactgtgggggacacagggctgacccagccatgggccctgccctctagggttttctgatctaggagaacacatttttgtctttatgcatgagaaagtggttttccagacccagagagagagatgatacagagcagagctaaagcccccctgccccacacacatcacattcacacacacagtcgtaatcacatatgcacacagtccctcacacacactcatatgcacacacctcacagtcatacacactgcagccatcattcaatccccctcccccaccccatgtagtaacattgaaaactacgcaggagcactgggacggttgctgtgggaaccgggattctgaaatcctaacttgtgggcatctgaattcttgcgctgaacattctaatacatcagccacagagtttatgctctgaatttggagtcatttctcctccaggggctcaggctgggcagacagccagggagttagcgaggacggcaattagagggctgaagactttctgcctgatgatgaagaggcccacacggtttcctggagagggctgtctgccagggtgtgcacgcgcacatgcacaagctcaggctcagggggtatgtctgtggaatctgctcaggtgaagctccaggaatgtgtagtggtcatgtccgagtcttcaggctctgtatcggtcaggccggactaggcaaggctgtagcaacaaggacacccccaaatcttcatggtttaacatgataagggcttactccttactcacacaaaatccaagctgggtcaacatccccttccctcttgcagttcctccgcaacccagggcctctaatatccttcaacagggaagacgtaaatggaaatggctcactgcctcttccctgctttggctcaaaagcaggcagacgtcttctgcctaggcttcaaccagcccaacctaagtgcaagagaaaccaggaaatgcagaggagttcataggcaaccacaacagtccctgccccagagcctccctttgtgctttgcaagcccaaacatcccagcccagaggggaggcaagtccttggagacagtttaaatccgggctctgcagcttgctcactgggtggcctcaggcccacgcatcagttgggttcccaccaggaaacctagaataggaatttaaaggggacttatttacagaagaactatttacaaagggtaatgcagtaagtagaatctaagagcaacttctggccaaaggagacacaaccagggagtggtcagtgagtccgagtaggagacagtcaaggagaggtcaccttgaataagcaatgtccttcacatgagggacacagcctacccgagggacctcacagggggggccagaggaataagtgtcacatcttcgctctcctcacttctgcctagctctgctaaggctccccattggctgaatctgacagaagccataaggcccaggaagacaggggttaatccaaacagatcagcctcccagggcagaatggatagtagctctggtggaataaatggaccctatctggcagggacaactgatttttgcttttggagcctccttttcctaatctgtaaaataagaatgctaacacctgcctcattgcattgttgaaagtaaatggaataggccggatgcagtggctcatgcctgtaatcccggcactttgggaggctgaggcaggcagatcacctgaggtcaggagttcgagaccagcctgaccaacatggagaaaccccgtctctactaaaaatacaaaattagccaggcgtggtggcgcatgcctgtaatcccagctactcaggaggctgagacaggagaatcgcttgaatccgggaggtggaggttgcggtgagccgagatcaagccattgcactccagcctgggcaacaagagcgaaactctgtctcaaaaaaaaaaaaagaaagaaagaaagaaagtaaatggaacaatatatgcaaatatgcaaatacctgtccttcatgaatgctagtttcttagtgtctgaaggcactttgcaatccagtggttcccagtccaggatgtgtcaattattctaaagtctgatatgaaattctcaaacaaattctataaacaaaattttctttttctaaatcactcccactttcgagctttttctatatgtcaagtatttcataggctgtctcatttcagtctcacaatattttcctaagaatcatagctgaaaaattgggactggcacagaaagattaagtcacccattcatggtcacgaagccactttgtgtgtctggccccagtgcccactgcctttcctccctgttctactccgatttctgaagctgtgtgtgcaatgaataggtaaagcggaggatcctgaaatgccaatgtttgagaactttccctaccttgaagggaggccaatgcacccaaagttgaggaccacgtcttttccaaaggcctcatgtagccaccacaggctccaggaagtgccccctgctcatcagggtgtctctgtggtctccaggcctgagctcactcacccaccatgctgctgctggttcatttcaggtcatccatctccagccccacctgaccagctcaacaccagcagtgcagagagtgagctctgggagccaggtgagcaaacattccctctgggggtccatgatcagctttctgtaggtggtcccccagggtaataaagaagggaaatggacatttaggataccagggaggctccctgacttcagacaacacttcttcctgacccatcacctgaagttccactatcaattcactttgaggtcgtagaactaccatttttgagaggacactgataagtcacatacaggtgggcaggtatgcctggagcattttaaggggatttgttgagaacaggctagagttcttggtgggggaggcagggtccttgatttactcagcagacgtttattaaggacctactgtatgcaaagatgcatgctagcactgggggtacaatcctgggctaaaaggggcaggtggttcccatagaaggggttctggggaagtgaggaccaccatcagctgaagcagcccatcatcaaccccatggccagccgcttcacaatcctccaaggttccctagtcactgtgacagcctctaggacagtaccctcagaggagcagaggggccttcaggggaagcatgcgcccactggaccagggcccctgaactcacaactctgcctttctttcacaaacgggtgcccctggagacaggagcaagtgaggagggtttctagggggctggacccctagttgtctgtcacccatcttaacctctagagtcactcccaagccccaccttcggctgactctaaggagaaccacagggtcaggcctcaaggtgggctcagggatgagccagcccggctccattttgcagactggaaagctgagacccctagccaggcagggcgttgtcaaagttcacgcacagagtcagtggcagagcctgggcaaccctctgcccaggccccaccggtcttagctctctggtctgacacttccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcaggtacgagcgcaccccctacacgggcccccacctgccccactccccaggccttcagccactgcccctggctccagaccctggacgcaagcctcgccctccagacctccacccccaccgcctaccagtgcaaacgcaccgggttcccacaccggaggacgacctcgagtcatttccagatctgagcgtttccttggatctggcctccagactccacccccacacttggttcctagtcccacccctgggttcccaaagctaacccggtctctaaccccacttactgggcccgccgcttccctgtccccgcccgctctgggtctctcctcccctttcgccatatacataaacatgccaggttcacagggtccctaagcgctgtggctcccaggctcccaaacctgccctccaggccccgcccaccaggtctctggtccctcccaccagcctgcggctctacctaacccatctgcagtcctggggggattcccagtcttgcctaccgggctacagccctctcactgggtccacaacacgctcacaactctccggccagtccaaccatcaccccaaccctcccttcctggtcgggtgccccagcatccacaaccccctcccacccctagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgcggtgtgctcaggtcagtgggcggagtcgctgaagcccggtcactaccaacactcaccataggcctactgggcgccaagcctggagttagtgccggagaggtggtccctgcccttgagatgtcacagttcaggaggggagatgagactgagacaaacataattcaggagagaaagtggcaaatgcccccaagaaaggcagtcaggtggagtctagaggcagcagaccatgcggagctgtaggctaaggctgaccacctcccggaagaggtgacattaaaagtgagactcttcccgagtgggagttggccacctgcattcaagcagcaaggggagactgaagggagggaggcctctgaggaggctgttggtctgtccaggtggggccagaaggttctggaccagccagtgcctctctttgataagcaggagatgggggaggtgggggtgttaaaatgtagattctgattcagtaggtctgaggcagagctccagagtctgcgtttctaacaagatcccaggcaatgccgatgctgctgctccacagaccacacttatcacagcagggttggccagagcaaatggggcaggtgacagggggacacagacacaggagggagaagacacaagatctggagaccaaatggctgcattggtgcctgcactggtgggtctgggctggcgggaatttctgcccaaaggattctgacctgactctgtcccctgccccttccctgcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcaggtaccccatcctactccacccccccagatttgagccagaattctacctgaatccatgtcctaaaaacttacagtccaaggaccacaataggcaccagatcggcaatggcacatatggcataagaaggactgttgtccttacggtgcccaggcagacagtgctaattcatcgaggtattttcagatgctccactcagccccagaatgatgaatcatatatgaagacattatatgctaagcaatggttcctcttgactgggattgactcaagagttgacaccaatttgccatcccaggcctggtgatgatagtaaaaataatattagcaggccctagtaataatatcggtgacagcttctggaaccctgatcatatgctaggcattgttaagcactaagtagctcttatttcagctgagcctcatacccactctatgagttgggttccaccatatctcgccaaatctaagatggcattgtttatgtcacaccattattattttatgtaccataaagaagaacgaacactgccaaaataaaccaccaaacgtaatgactgaggccattatcccaatttcagacgtgttaaagtttgaaaaaacgtgagtgttagatagatctgaagaaacatggtatttgcattcttacggcattcagacaccagattacaaattccagctctgccatttacgagcaaggaggcttccgacagtcccttaacctccatgtgtggatgctgatactaggcacttcgcaggatagctgggaaacctgatagtatctgctgagggacttctaagctcatttctttgtgagcctacctgcccaacgggaatgccgattatgataatgaagataatgtccgctcttcatctccctaggctgattaagaacaaactgaaactgaatggaaaacggatttgtggtctgtagcagcttacacagaaagaagggataattctattagccctttattttaaccaaagagccttcccagcatttaatccatgagttcctccttactgtggggggtggggtaggggagggaggtaagtttccttagccacgtgtccctgatgggagcacaaccctagttctgggtcacttgtctgtcccattcagtttctaacccaaggcctggcacacagtaggtgctcagtaacatgcattgagtgactgggcggtgctttctgacagcttcccggagtttgcacaatctgtccactcccgaagtccctgcaagtgttcagacagtcactataggtaagtgttgctgggtactacgcggtttctcagaagcttggacgtgtgtgtgtgtgtgtgtgtgtgtgtgtgtgtgtgtgtgttcctgtgcacacctgtgttggggtggaggatggtttggtcctcatcctccacctccagccaatggacttgcctccccggggctctctgggtggcatttctgctccttctacatcccctccttgccaagtcagcccatagatcactgagtcctgatacttcctggacagaagtccattcccccactttcctgtgagctgctggagggcagaaggaaagagctggagagagctgataccacctcaagcaggggtcagggtcggggcagcagggggagggtgatcttggcccagctgggtagcgggaatgccggcacacagccctgtgttcataaccggccagacactgggcctagggctttatagccattatttcccaaccctttaatcctcttggtagccaaatgggagaggtcttattataacccttacatcaagaaaggagctgaggctccgaggctgaagtcacagctagagattgctggccagaactgacaaccaaggctctgaattccagatccattcttggtctacccaccagctgcgtgtagcttggctggcatcagagcagactcccaggactcaactcccagctgtgcctcttgctagctgtgccctgttgggcaactcggaacctctctgagcctcagacacctcaattataaaatgggggtgataagcatatagtactttctcctagcattgctgtgaggctccagtgaattaatttttgtaaagcacttagaacagagcctcaaagacagtaagaactgtccgaaagtctgctgttgctatgagtatttagttcaggcattgagcccctttgcagtcctgggatacccacaggactcccttgctctgcctcctagctctctgtcatcttctctcagacacccagaagcagtgaacaggggtttggggagagggcacagaggccttagccatagatgacagcacagagaggaaatgaaatgtacaactgcacaggctgccgggcaagctcctgccaggccccgcaggcaacctgcacacgctttctcttcctgaggttggagtggggatccacgccatcctggaagggcaaagagtgaagcacaaagagagatccagggaccacaccccggcccttggtccatcagcccctccctcggccaaggccctctgtacccacattcacgggtctccccatggccgcaacacccagcctcactctcacatctgcttcctgctgccagatccagctcccatcctggcccaaacttccccatttgcagacagagaggggagaggagaaaatgaagacggggagaggagaaaatgaagacagggagagggttctctcccaggggaagcagactctgcccccagcaaagaggtctggatgatctcatctccctccccgttgctgtcactactagtcatctagccctgtggtctgctcactccaggaaccctcctcactgacccctgtatccattcttgtgcttcacattcttttaagcagaggggaggctgagggagggggagggcaagaagtcacccctgagtggggctgcagaggtgggagaccctgaatcccagaccccactcccgtcctcatggaggggatgtctggtgggaaggaggggggactcaggcacagctcttctgatggtctgttcactgccagaggtggctcagagtcactgtctctgggaagtcagcgttggtcttccctcacagagaatgaagtgccttttgtagggcctcatgcccccagtgtcgctgttcaaacctccatcacagcgggtgcctcatcatactggactgggttacttattgatctctccgctagacaaagcccctcaaggcctgtgatactgttgtcttatgtgtagccccagggtctagggccaggcacacagcgggtactcaatagttgtctattgaacaaagactacatactgaagagctagcagacagatagatctctgcagcctggtggccagagttctatttcaggcagtaattcatttaatcaattgctcatgcattcaatatgcatttattgagcgcctaatatacaccacacacttaaaagcaatgagaaaattggaaaaaggaagcaaggaggaagataacataaaaagggaagcaggtcagctttacagagaatggaaaggcaagaagaagggtgagtgcccattcctctttcttcctgaattggaattcttgtttccagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatggtaagtgcaaggttctgggagccatggccatcccagggggatgtgagccttggcagaaccccagcagcagtggcgtggtccagcaatgaccacccggccctggccctggggagatccccaaggtggaaaggattttcccagcatgcccagcagtcatggacgcaccagcggggagaaccagactgtgcatgtgtgtgtgtgcctgtgtttgtgtgtgtgtttgtgcgcgcgcacatgtgcctgcaagtgttgggggaatgaggagggtggtgtgtcgatgagaacagaacggaaccaggtagactgggagagggcaaaaaaatgacttgtagaatttctgcctcccctccctcagccctccccgtaatggtgaaccaccagcacctacccaccaccatcccggcagggagcaatagctatcaaccggtccccatcaccatccccaaagaaggtaggatgtcccccatcctgggtgtgggagggctggggaggacaagaagggtgagctttctggaaggtcagcaccacttaggtccaagacgtacacacagctggagatgagatctgggccagcccactcccggccctgggaccttgagcaggctcaagtcgtccctggacattgaagggcagatgaccttccagttcagtcatgctaggactctatagagttttgagttctggacaaatacaggcaaagcacgttttagatcttggttctcagaggaaagctctgttctgctttgctctgctagttggctagtaggcttgtgatatcatcatccctatcaatgtcctgcccaattggccttgcgaagccccatcaagattctcctagaatgtggttttatttcatagttcatattttctaaacaaaaaaacaaattggggctgggtacagtggctcacgcctgtaatcccagcactttgggaacctgaggtgggcagatcacttgaggtcaggagttggagaccagcctggccaacatggtgaaaccctgtctctacaaaaaatgcaaaaattagacaggtgtggtggcgtgcacctgtaatcccagctacttgggaagctgaggcaggagaatcgcttgaacctgggaggcggaggttgcagtgagccgagatcacgccactgcactccagcctgggcgacagagcaagactctgtctcaaaaaaaaaaaaaaagaaaagggtcagtcattcatcctttatgatatatggatttatacctcttgcagaggaatttgagcttaatcaccttgcattatgaatgtattcaatcacctttatcggaaagagttcaatgacataaaaaccaatacaaaactcagccaaatattataaatatcctttgcacagagagtccatatatatgaaaagagaatgtgaatacagcatctagcataaggcttagcataaggcagctgctcactgaatagcacagtctagaggtttagagccagactgccggctctgggccaggtaagaacctgtctgtgcctcagttccctccaaggcaaaatggggataataatgtacccacttcacagagttatcatgagggttaaatgaggtaatacttgtaagtgttagaatagtgcctcacatatagtaagtgctgtgttaagcgtttgctaaataaatgtttagttctccatattggaaatgaacgaaggcagcctagaaacttcagactgggtggcttgtacaagatgggctacccaggttgggcacactggtggatgcctgtagtccccgcattttgggaggccgagggggatggatcgcttgagcccaggagtttgagaccagcctgggcaacatggtgaaaacctgtctctacaaaaaattcaaaaattagctgggcgtgatggtgcatgcctgtggtcccagctactcgggaggctgaggtgggaggatcgcctgagcccaggaggtcaatgctgcagtgagctgtgatggcaccactgtactccagcctggacaacagagtgagaccctgtcccagaaaagaaagaaaaaaaaagggggctacttggtgctcccctgctactctgcctctcacctctgctgttcatactctaccatctctccctacgcctttccgcccaccactttgccatgccctcgactctgttctctccccagttttcatgctgcccatccaggtccaggccccgccccctgaggactcagactctggctcggactcagactatgagcactatgacttcagcgcccagcctcctgtggccctgaccaccttctacagtgagtgcctggccgggctcccgagggcccacctacctgaatctgggagggggccccgaggggaccgtcaggtcagtagtcccacctagtaacccctgcatgatgcagacagaatccccctggttacccactggattgactgtaaatggtcctacactgacgtttgcaccgtgctttgtgaccctggggtcatctcgatgtctcaggacatctccactctgacctctgtctctcccatgtttgtctctggccacgtaaggtcttaagaccaggcctttgacattcacctgaagatggctctctgtgtgagagcgggggagtgcggatgagagacacagttggcaggggttctcgcatgccatatccctccgtgtcccatcctgccctgtctgaccccatcagccccactcacttcctcacctccacgctcttgccagcttgtgcctcatagccagctcttttcattgccttctggggataggaagaggaaagataacgctgaaggcagttccctggcaatgctgggaggttggaatagaccagagcgtcccacaccttattgtggaatcacttgggagcttgtcaaaaattcctgagcccctccccacacctaatgttatcagtcaggatgagaatttggctgtgtgtgacagaaagctccaaatgacagtgtcttgagaggttggcaggggcccaggccccttctttcttgctgctgtgcagtccctaagatgttgccttcatctacatggtccagaatggctcacctccatgtccacattccaggcaagggcaagggaacgatgggatgctggagatggccacagattcccgctcacaacccagcacccagaacgaaaacccactagctgcaagagaggcagggaaacgaaggctctgtcctgggcagctgtgtccagataaaagccagaatggatattggggaacagacagccgtccctgccccacctgctaacccagggcttctgggggtgggacacggatgattccacttcttctggcctgtggaccagtgtttgggcgccacagggatgaagtgtctgtcgaacctgagattccgagcccaggcatataagatgcaagactgagagtccacagtgctataacattgaaattaaaagtcagtggtacccggttcaaaagagctgactccaagatcccagacactcatatcctcaagactctataaatctctgattctgaaacgtgaaggtgccacagagcctgtgatgcagtgattccagaccatctgggtttcactctaggaaggcttcttgaaggagcaaacatctgtccttctcctgcccagagctgccaggtcacaaggacagaaccaagactcttgatacctctctaagtagcaggagggacagctggggctgggggctggggggttgtagggcactagagtttctgtccccaggctagattaaggcgaaggctctgctggattgggatatgaacctggaatttgatgggaaatgctaagccctctctgcctccggagttgtcctcccaccctattcagcctacccaggccccgggaaatccagcctcttctccaggctcctaaatgatgaggttgagccttcacccctccccaccaccgcctctgcttgcagattcccagcggcatcgggtcacagatgaggaggtccagcaaagcaggttccagatgccacccttggaggaaggtgagtcaggatgggaaggggtgtgaatggcagtcccacctccagagagtagctcagctcagcttgagaccttccagcaggaacctccctcaatgagtctttcctgactttcacaaatcctataggcagtaagtgctttctgaagtctgacttaaagccctcttgctgcactgcttctttcgtcaccattctccctttcctgccttaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcaggtaagctgtgcctcccccaaacccccatcccatagccagcctggctggaggaggcataaagctgggagccctgagtcaggctgaggtcaggattctacccagttccgcagccattcgctgtgtgcccttggacacatctcccatctctgggccttcactttgtcatttgccaagctagggacttggctctcgtgagtcacgtgggccccccagctctggcaacttgagaagtggctgtgtgctggcagagggtgactggttctgggggtttccagcagggcccccggctgatgacagctccagcacctcatccggggagtggtaccagaacttccagccaccaccccagcccccttcggaggagcagtttggctgtccaggtgccaatatctggggaagggatgtgggagggggacagagagggactggggagtaaatgagtggggaactattggatgcattcgctcaaggggaaaaggagaaaggaagggtaaaagaagagagggaaagtaactttttaaaaaacaaagcaaggccaggcatggtagctcaagcctgtaatcccagcacaaggcaggaggattgcttgaggccaggaatttacgactagccccgggaacatagcaagaccagtctctacaaaactaaaaactaaatattagccaagggtagcacgtgcctatagtcccagctcctcaggaggctgaggtgggaggatcgtgtgagcccaggagatccaggctgcagtgagctatgatcgtatcactgtgtatcatgcccctgcagggtcagagcaagaccctctttctacaagaaaacaaacacaagcacaacaagaatatgaagaggtggggaaaatggatgtggacgggatggagaaatagtcaaacaggttgctttgataagaagtgagctccctgtcagtggaggcattcaagcagaagcagctggttggctccttgggggagactgtggtagcagaggggcttccaacattcaatcgtccaccgtgtcgtgcagtgtgccattgtggagaccatagccctgaaccagacagacgaggctattccctcagtgctgatgttctagtcagggacatggccggaagcaagatgatcagatggcttcatgcagcatcccacggggatagtgatgtggagccagaaccactcagctccgtcctgtggggcagcagggcaatgactgggtctcccactaatctgggcctctctgcccacagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatgaaaccagggcgtggaatgacaatttcttaaacctcatagaacccaggctgcatgtgtgtgtgcacgtgtgtgtggcatgtatgtgcatgtgtgtgtgtgtgtgtgtgtggcatatgttggatacaaatgagacaaagagttgagctcaaatcttttatttgggaagtaatcccagggagcagcagtaagaaaatgaggaagaaagagggggaaggaaggaagacaatgttcatgaacaggttgctattatgggcagccagagctcaatggtgctggggacctctgggagacacacctcagaattgtcccaccaagggggcagggagctgggatattgacccaccctctctgcctgtcattggttgaggagacattaacccccagccccagcactaccgagcggcctgtgagtgagctgggcacacgctgtgtcgggagaagccacaggcagagggtcagaggcacatgctataaggaaccatcttccatgggaatggtccaggaaaagcaccaacagcaactgctccatgttcagagtgtgtgtgtgtgtgtgtgcatgtgtgtgtgtgcgtgtcagggagaagtcaggttgtggcaatggtgggggcaactctatctgtttaggaggaaatgctagggaactggaaaacccacggtggctcagcaccataaaaaacactggggaggccgggcaccgtggctcacgcctgtaatctcagcattttgggaggccaaggcaggaggatcactttagcccagaagttcaagaccagcctggacaacatagtgagaccctgtctctaccgaaaaaaaaaattgaaaatcatccagtatggtggtgcacacctgtagtcccagctacttgggaggctgaagcagggaggtcgcttgagcccaggaatttgaggctgcagtgagccatgaatgatcacatcactgcactccagc

SEQ ID NO: 820 - DNA, 26721 bp, Human
aaggaggtaaaaaccagtcattgaactgttacaatagccctgaggcaacacagagttgtattcattgcttgcccaggtcagactgtcccaagcactgtacaggatgtcccaagcactgtacactgtgctaggacgaagtgttttgcttgttttgagaaaagggttgaagagaccattctttccattgtccttcctctagaagtgtttccccaaaacattctagactcgttattcctatcctataaattatgcaggaaaggaggttctgcaccatgctaggttgggaagttcatcctttcatctaattcacagctgtccctctgtgtttctgagaaagcaaagagaggggggatacttagagggaatttggcagcactttcccctgggcaagagcctcctctttggaggtaacaagccctgagagtctcagatgcatgctgaaccaccacactgcaggaaggggtcagatgggctgaaaagaatcagcgatgacctcgactgtcaacatccccagcataagcacagagctgggtacctgggggcaggtgaattggcaaaggatttaaaggccctgatcccagcggttcctaatgcatcacccacattgacaactcagagaaaggcacagttggtggatgagtctagagtttgtaggtagagaacagggccctccacccaatccagacctgtgtcattgagactgggatgggatgcagttttgtggtcttgagaccatgtcatccctctcttcctgaatactacccccttccctagggggcagtggtgacatgggacagaataaattcacctcatacacatttgttcctggggctgtggcaacgcagtgaaagggcctgccaccttacttgaagtcccgggcaactagcagtatccagaagagaagacctttttcagggactggaggtctgtttccctcttggggaaatgctaacttccaacctcagtgctggtaacttaccactgtgctggcctctgccccacctgccctctaacaggacagtgagagtccctcttagggttaaccaggtgggttgttttttgttttgtttttgttttccccatcttcagtttggagtgaaagttaggaaggctgtgcagtagtgatgagaggagggcatgattttagcatgaccttttcctcctctccctttatgctttacaatgaaaagctcaggaaccttctccccacacagtcggatctccggaggcatctgcagggatcccaacagtgtcgggctctgcagtcggactctgcagggatccgaacagggtcgctgagaccagtgcacgagcctcttcggaagatgcatcctggactcttggccgcagaggagaaagcggttggggtctcccagggactctttctaaagggtcagtccagcatggtaggggttaacgtgggtccacgcgtagagggaaaggaaagaagttgtagttgacacttcaggggggcgggtggcggacgggtctcgctgcctgattggttttgcatttcatcccaatttttttttctccactctctctccctcttttcagtttctctctctgatcccaggggaggggaaacgggaatagtgagagatcaaaaataaacctcttatgtcaagccgggaaggaagtataaataagaagggctcggcagcccactcggtgcttcccggggtggggaggaggcaggaggcggctgcgcggggctggcgcgggcaggggcggaggacgggcgcacgcgggccggggccagctgctcgcgctcggctcgggggcggcggcgcgggaggagcgggctgcgccagccagaggggccgccgggggagcgctcccgccgccgggccccgcgggccgagtcggccttgcacccgattgattccgcttttcctggagagagcggccgggccgcgctcgggccgccagcacctgcccgcgcctggcgggcttcttccctctcctgcgcgcagccaccgccgcagcccccatgctccccgccccccgccgccccccggtggcctccgctcctgctgctgctgctgctgctgctgccgctggcccgcggcgccccggcccggcccgcagccggggggcaggcctcggagctggtggtgcccacgcggttgcccggcagcgcgggcgagctcgcgctccacctgtccgccttcggcaagggcttcgtgctgcgcctggcgcccgacgacagcttcctagcgcccgagttcaagatcgagcgcctcgggggctccggccgggcgaccgggggcgagcgggggctgcgcggctgcttcttctccggcaccgtgaatggggagcccgagtcgctggcggcggtcagcctgtgccgcgggctgagcggctccttcctgctggacggcgaggagttcaccatccagccgcagggcgcggggggctccctggctcagccgcaccgcctgcagcgctggggtcccgccggagcccgccccctcccgcgaggacccgagtgggaggtggagacgggagagggtcagaggcaggagagaggagaccaccaggaggacagcgaggaggagagccaagaagaggaggcagaaggcgctagcgagccgccaccgcccctgggggccacgagtaggaccaagcggtttgtgtctgaggcgcgcttcgtggagacgctgctggtggccgatgcgtccatggctgccttctacggggccgacctgcaggtaggactgagagcctcctccagccgccgtgcccggaggccccccagacgcctcccagcgtctctaaaatctccccttccaatccctctgagaaaaaaaaaaaaaaaaaaaaaagccctccccactcatcttctccagccttaccccaaacgagattctctcctgtctgagaaagagcagtaactcttttctgaacttctgccaccctggatccctgcgcccccacccccaggtcccttccagtttagagtggggctgccgacgcccatccctctcatccgaatctcccgcggcacgtggcgcactgacccgaaagtgggtatcaacgcattccccggcacctgcctctcccagcagagatgaaaattgagcgtttacgaatagctcccactcccacccctcagccctctactgcctccagatctgagaggctcccagggaaaggcagatgggatggagagagatggctgtctgattcccttgggtatggaggtcgccataagcaaaagacattgtttgaaaggagctgaacctggagaggggctgcccaacttctgtgcagccagctggttgtgatcaatggggcatggactaccttgccaacctggcgctcagccccggcagaacttggcaatgccagcagccagcacaagagggaggggcagagaacttctgcctgggggctcagcccaggagctgaagctttggtggaaacgcgaggggcgcaggggctggaacgagctctttgggtgaatgtctctagtaaagccagacccacacttggtccacccagctgcccttagcccagacacagctcttacctaaacaggggagaaaaacagagtccaggggatggctacctaaccagaccatttctaactagatgcaaagatggtgctgactcagcaggaggtgtctgtgttgccctaaaccccaatttctcccctaaagaccaggtgaaggcttttccaggaggaaaagagggtaaggcttccagaagaggggtgctctttgcccctagggagcacagaaccagagatgtgccagggaaggaagaactgacctgcccagacgtcatagttccctgaaacagggatcctggcaatgcagcagctaagctgacactttgtggtgatggcatccttggccgggacccaatactaggctcagtctgtgcccgactgctgggggccccaagggcataggcattgcctgtgcagaatagtccagacaaggaggcgatcagccttctgtttctcaccccatctttcccaccctctatcactgggaaaggcagggtaggaaagacccagggagaaacagatgattaggatgggaactgctgtgggtgagagtccacgtggctgcccctctggctactgcaggtgctgactacaccccagggacgcacccctgcaagcccttgtggtatttgcttccccaaaagcagggcagagcagctttgggtcacgctgatttaacacctgtttccctgcctgtcctgagagcacggagcggtgggagcaccagccctctcctctgactcctttctttaagcaagtactagagagtgtggcaggagaggggtgagaagagggcttctcccatctctttaggacccccacacctggctcctagggggctccaccagaaagaagctaagatggccgggcacggtggctcaagcctgtaatcccagcactttaggaggccgaggtgggcagatcgcaagctcaggagatcaagaccatcctggctaacacggtgaaaccccgtctctactaaaaatacaaaaaaaatagccaggcgtggtggtgggcgcctgtagtcccagctactcgggaggctgaggcaggagaatggtgtcaactcaggaggcagagcttgcagtgagcggagaccgcgccactgcactccagcctgggtgacagagcaagactccatcttaaaaaaaaaaaaaaagaaaaaagaaaaacacaaaaaaagtaagaagctaagatgcacccattgcaaacccagagcggggtgctacacccctctacccccacacatggaacagattctgacatctacctaagaaccaaaacataggaaagccaagagaactccgtgccagcagagaaagtccatttttcagccttcagggccagactgtctcactctctcagctgatcacctggacgctggagataactgagtatttgcctcagggacatactcgcatctccagacatcctagctatctagaggcagacatgctctgaggcccgaccccaggatgcccgggctgctgaagcaggagactctgcttgggtttgcacccgattttgttcccttcagcttaaagttcaggtctgctgccccagacaattcggctttctctgtgtcagagacacccaggcattgccatcctcatgagactcctgaccgggcgatgtggctcctgcttgccccgctccccatcccccacaaacacgcatttctggacctttcccagctgcacattggcacctgcacacccagccagcccacctggaccaggagagcgcagcaaaacaggcatcgggcacctctgaaggctgagttcctctccctagggggttgacttctgagtctcacctggaagaaaagtcttccctcagggagactagccccgccacctccaccctgggtctcatgtcccatcccacctgtgctcctgctgccaccgtggcgggtgggggagggactgaggtacagctgtgtccaggaccaccctcgggcccctgtgctatgatgagctgaccagccttggagatgctgcaggacaggcgtgactgtctcagctcagtcccctgcgcttccgaaaacagatccatgagcccagctgagagaagaatgaaaatcaagttcccgtgcctcaagaccttggctgcccacacccacctcctgcaaatggaagccagtcctttatgtggagacctcattcacacagagggaaggcactctggggtgattactcttggtaatcaggggtgtggaggatgagaagagcctttacctctctagggcttagagttcctcatctgtgaagcaggacacctggactaggtgatcaatcccggtctgagcacctgtgtggctgcttcatgatgagccagtcttctggaaggtttagccactctctgagcgtgttcaattcacagcgtggttttacacacatcacctccatgaaaataccagtgaggggggcagagggagactgcacagctcacagaggacatgtggcttcctcaggatcagacagcaccgatcaggatcagtaagtggcagggctgggcctgcagaccaagtctcccaaagctgaatcctgtgcactgttatcccaccaggcggcctctttctcaggactagggtctgtggctctgtcgaccctctgatacttgcttatgttgtgggagtgggtctttaaatccagcagttcaaagccatccaggcccactgtgaggccctatcctgcaaagaaaccgccgtggaggctgagagaaagaacgcaccactgccaaagctggtctcactatgttacgcgacaatgaagttttccagagctctgtcaattgagttcatttaatcccatgagaaaaggggcccctgtctcccaccttcttatctggtttcagagttaaggagctcagacagaggggcctttctgaaaggagggaccacctgggaagactccattagctctgtctacgtccagctgctgctcagtgtcccctgtgtgaacccggggcgagatggagtgaggggcagcatggcagtgcccactctcgccagcctgggacgcctgtcccgccagtgcttctgcagtgagcagagttttcgagtcctcttcttagcagagagggtccgaaaagtggcgctcatcttcccaaagtccagcagaacactcgcaggaggtcagattctggggactgacttcagggacggctgtcacagccatctccatgcccccttacctgcatgctgtggggaaaatgtcttccacaagacactaaagtgggcatgcagcctaggttgtccagcagcatcccagtttctgcctgttctggcataattattaatactaccgtctttccctctcaagggtgtcctggtttggatgacaacagaaacagattcatgcccccccctgctctgtggctaccagggagaaagacaagtgttatatgtgcgtgatgtccttcccattggcaaaagaatgcatcttttccatcccttatgtctgctgcagtcagaatgatcaaagatatggagtatttcccaaagaaaatgtctcagtgtccaaagatcgccccttccccatctcccaggaggtggggtgtgcataggcaatgacaggcggacttgctgcttgcaagccttgggttcactttggctaggctgcagttttccttacagcagcaaagatgggtggcagttagtacagagactaagaacacaaactttggaatgaaatcgaaataatgtagtgtccttgagcaagtcacctatttctgtgtacctcgattatttcaggtaggagcagttataccaatgtcctagccttgtcttgaggatgtaagaaaatatggaatgcacctgacctggtgcctggtccagacgacatactcagcaaggcatggctattactagagttgccttcggtgatggaaaccatttgttagagtggggaggatgggctgggccatgccatcagagtgccggccaccgctgtttcagctttgctgttccacatggcagaggaaccttctctttcagttgcccatgctcagtggtgaaggctgacttgtagttcagcgtcagcgtatgctttcaagggacaacattgctctttgctgcttgcagaacaagaggagatgaagcatatgatgcaggttgctcttttctcctctcacttctttcctctcgctttgcttctccatctccacacccccagctcagtctcaggccctagagacgtcagataggaagagggaatgcaagagcttcccggggccacttttcctcacctgacctccccccaggcgcgccgcaagggaaagctgtggagccaccggtgaagcgcaaaccggctggatgtaatgatgacatcggggcgggaggaggccggcccgtccccatcacccaccgcagctggcttcggctaccacagaagctctgaggaaggaatctccttgttcgtatctcaaagaaccaaaaggggctctggcccacccaactggccagggtgttgttatttttttttaattcatttttttttaatagagacaggatctcactatgtttcccaggctggtctcaagtgattctcccaccttggccttccaaagtgctggggttacagacatgagccaccctgactggcctgatgttcatctctactccaggtcctggggtcactcatgcacgagcagactccctaaaaagtgccgcctctccctaacaaaagtgaagagtatgggatccccaagtcattcaagagcaggttgtttgaccaccctggctgggctgaccgtgggctcccacctacctgccgtggtttggggggcggctgctctgctgatgcctctgctcctcaggggggccaggaccccgttcacattcttcacatgcagcttgcattggtgtggggagcagggaggtgtaaatcggcaccaggtggtggagcaagccatctgacttcctccttgaccagccgcaggcctgatccccacaggactctcagtcaggcctgtcctttgaacccaggatattgggggagaatcaaaggctcacagccctgaggtcccccacctcacccaggctcagtggtccttctccgtagggaactgtgagacgcaccgcatatataaggcattcctctggtcatttctcagaagagcggactgggaggggaaaaccaaaaactcagtagaacaagagataaggagagatcagtgggatcgggatctgggattttgaagggaacactggaccacagaatcctcctagccttcttgaaaatgaaaagtatcttctgagacagcggccagaaggaccttcagatgtcctcaagtccagcccacccctcgaagctaaatggctctgaagccggccctgcctgacagctatgcactgtctggagaagacaatgatatgagctgtagagaaggaggctccctgggaaccttagggccgggaagctccttgtgctgtcttgccctgatcttcaagcagcagtttattctgcatgaaaatcaggggttaaccctcaccttcctccggtcttcactgaggatgtgagcactgcctcatctctcactcagcctccctccgatctgctcaacgtgggcacacagacttgccccaacctcctgtctttagctccttgtgctgagctgtctcggccccgaagcttagcagctggtgttccttagctttacaccttccttgtgcgacctcatcttccccattttgagattgtgaaactgggactcagcgggaagaaatcttgtgatgacggttgcagtttgcctcagaagaaattccaggggttggtccctggcccatcagaccctggtccttcttagagagatcaggatactgttggcctcctggaagcagcaaagacccggccaggagttcatctcggcaagccaccattcctcagcgctcacccccggttgcataatgatgtgattgctttttgtccctccagaatccaactccaggagcaagtgccaagtttcagccttgttgataagatgtttacatcagcctaaacattgctggagtgcttgacacgccaagtaacctgccaacccctgcttgtagggctaacaaaatacctggctcattgcctgtgaggtgaacagacagatcccattcacaaataatgggattcatctggaacgcccacacatggcctcacccgatggaatgtccctctctaccctttcctttctcctccttccactcccaccttccagaccacaggaggagaggaagaggggatcccaagaggtggtgatctagggatcggagaggcagggcaagcaggtgctgcccaactgaccacactccaggctcaaggaacacccacctctgcctctgtgtctcctcttccacaaaatgctcaaagagggccacttcaaggggtcgctgaggcaggagagcgagttcccatctggccttctctccaagccttggaatccagcaggggagcagttggcagcccagggacaagacagaggccaagcagtgatgtatgctctgttggccagcctgggtggaagggagagcaggtgagatcccaagcacatgggtcctcttaggcccacgggatcctctcaagccccagtcaggagggaacgaacccttcggggctgtccaggcagacaccaggaagccacgcccggggaaacctaatgagagcacggtggacctcagagacaggcacacctgggctggcctcctggtttcaatagctgcgtgaccttcaacaggttaatttgcatgaccttcctcattcgtgaaatggaattacagcaccttcttcacagagttattgtgagaattgaatgaggtactgtggcagagtagctgttgttaggagtgattatcacagcaaagttttcagtgttaacaaatccccccccaaagagtagagttaccccaatagacaacaggaaaatgttcagctggattctaagagggaattctactaaccttgagcgctcagaactttgcttctgggctgaggccggggacgggtgggggtggttggcaaggagacggtgtcaggattaaggcagaataagccatgccgtccagtagaactttgtatctgcacattccagtgcagtagccacgagccatatatgactattgaagcactagaaatgtggcctgtgccacgctataagtttaaggttttggattttaatgaatttggatttaggtcgtcccctgaagctgtcctggatgttagacacacaagttcggagcaaggcaggtctgggttcaaagaccactgttcatgcatcagctttgtgacctcgtgcaggttcttgagcctgttttctcacatgcaaaatgaagggagtaacacggagacctcgggggtattgtgaggctttggtaggaatctgatgctcagccccataacaagaggtgatggcagcggacaggccaggccaagggccctgagacttaacccttcactccgcctcttgtctcctccttcctgacagaaccacatcctgacgttaatgtctgtggcagcccgaatctacaagcaccccagcatcaagaattccatcaacctgatggtggtaaaagtgctgatcgtagaagatgaaaaatggggcccagaggtgtccgacaatggggggcttacactgcgtaacttctgcaactggcagcggcgtttcaaccagcccagcgaccgccacccagagcactacgacacggccatcctgctcaccagacaggtccgtgcctggctccggaagccctggggaggaagggagacaggatgggcagatcaaagggaggaccacgaggcctgcccaaacatgggaaacgtctccctgctggccccagctggacgccagagcctcatgcccagaatgatgaggaggtcatgaggacaagtgtgaggtatttgcaagggaaggagaagaatcttgtaagggctctcttccaaaagtttgtgaccagctgtctcctgaggtcacacataacaagaagaaatgggctcaagctgcccagtgagagatctgggcttggaatgaagagagtagttctagctgcagtggttgtaaaacacaggggcaggtagccagggggtcccctcaagatctgcccacagcaggagggctgcccacctacacggcatgacttaaacagacagcttcctgaaagcaagagagcgatcctgtgtgccaggccctgtctgctccttcagtctcataagggccccatcgggcaggccctggtgttatccccattttgtaacagagaaaactgaggcacagagtggccacacagctctcgtgccacatagcggcagcgcccatagtccagccaagacagtgctgctgtagagtcatgttctgaatgactgtgctgtcctgtccccacaaaaagcctttgaagtcccagccagccctaggatgcagccagccctaggatgcagccagccctaggatacagccagcctgtaacatagaacaggctcccttacatgaatggctgatgtgaagacagacagagatttcccgatcttatcactcagaaatccatcttgatagcctttgtattttatattctttttggtttttaattttgttttgttttgtttgagacaaggtctcgctctgtcacccaggctggagttcaatggcacaatcacagctcactgcagcctctgcctgctaggtccaaatgatccacccacctcaagcctcctgagtagctgagatgacaagcgcaagcaccttgcccagctaaattttttttttttttttttttttgctttttgtaggaatggggtttcactatattgcccagccttgtctccagctcctggactcaagcaatctacctgcctcgtcctctcaaaatgctgagattacagactgtttttattttttaacaaaaggaaatttcacaggttactctccaatttagaaagatgggggacgggtgaactggcttgaccataaacacaaaaagaaccaataaagcgaggccactaggtgggatatccagacacgttgaaactgctgttgcgtcttcctccttaaaaaaggtcagccaggcacatggcaagcggctgtagtcccagctacttgggaggctgaggtgagagaatcacttgtgcccaggagtttgaggctaagtgagctacaattactcctgtgaatagccactgcattccagcctgggcaacatagccagacctcgtctctaaagtttaatttaggccgggcacggtggctcacggctgtaatcccagcactttgggaggccgaaggagccggattgtccgaggtcaggagtttgagaccagcctggataacatggtgaaaccctgtctctactaaaaatacaaaaattagccaggtgtggtggtgcacgcctgtagtcctaactacttgggaggctgaggtgggagaatcgcctcaaccccataagcagaggatgcagtgagctgagatcgtgccactgcactccagcctggatgacagagcaagactgcatctcaaaataataataataataataataatttaatttaatttaaaagctcaataaatgcaggtgatgcacaggccagcaaacatgttatgggacgctcagtggtccactcccacgtgcacgctggccacacccggccctgcaggcctgcagcgcaccccacacacacactgatgcactctcttgctctctccccgccacgcagaacttctgtgggcaggaggggctgtgtgacaccctgggtgtggcagacatcgggaccatttgtgaccccaacaaaagctgctccgtgatcgaggatgaggggctccaggcggcccacaccctggcccatgaactaggtaagatttgctgtgccaaagcccacttcaccacatcggagggaactgctcttccagatccaaggttgcgtagatcctaaggaatatgcggcccttgcttaggaatagctcctcctaattttgacagggtgactgtatacaaacagataccgcgcttgacagtgctgaacacaactccgctcccaccccgagcacatggccaaaatacaaaagcagcatcccacacgattatcacaggtcaccgggcaaatgccaggacacaggacaccagacacgtgctggggtggaggcgtggagctgtgcacaagctaagccgtgggatctgggggaagaacaatggtccagggactgtcatgtgagagggcaaataacagagctagatccaaattcaggacgggctgaggcagaaaataaaggggtatccgtgtttcttagtcatctgagaacgcgtcctggaagagcaaagcgcaggggaaagccctacgcagaaatcttcggagagtgagggggtggctgctcccctgaggagctccatctctgtccctagctgggccaggtggggcgccctcaggcaggacagggcggagtggaccaggcctctctccccagggcacgtcctcagcatgccccacgacgactccaagccctgcacacggctcttcgggcccatgggcaagcaccacgtgatggcaccgctgttcgtccacctgaaccagacgctgccctggtccccctgcagcgccatgtatctcacagagcttctggacggcgggcacggtaggcaccggcggccccgccctacttgtccccgtgggcctccttccactggtgctggcgcagagaccccctccagctgtgcctcctcacagggcccttagagctgagtccccggccagcctcccacgctggggcattcacaccacccccgaagtctgctcttctggccccatcttccagcagccgagttctgcgctaatttagattagtcacaaggcagggggaagtcatccgagaaggttgtctgaaggaggagggtttgagcagcgcttgaaggaatagaagcacatagcacagaggagagacgaacctacaacagctcaggcgtgacagaggcagtgactgcgtcctgtgagagcaagagggcggggagctggttcaaaggactggagccaggcatggggtgcacacctgtggtcccagatactcaggaggctgaggcaggaggatcacttgagcccaggaggtcaaggctaccagtaagctgtgatcatgccactgactccagcctgggtgacagagagagacgctatctctttaaaaaaaaaaaaaaaaaaaagggccaggtgcagtggcttctgcccgtaatcccagcactttgggaggctgaggcaggtggatcacaaggtcaggagttcgagaccagcccgtccaacatggtgaaaccccatctctactaaagatacaaaaaattagccaggcgtggtagcacacgcctgtagtcctagctactcaggaggctgaggcagaagaatcgcttgaacccgggaggtggaggttgcggtgagccgagatcgagccactgcactccagcctgggcaacagagctagacttcatctcaaaaaaaaaattgcttctcagaagaggggattaaagaaaaaacaattttaagtggttggaattgttggtaaagtaatattctagatccttctcactgagggagacagggacatgtatgatgcaaaaataagatgatccagacagcattatttggtcttcatttgcatgctgtggctttcaggagcacggttaggttgtgatatggatgaatattgtgttagctggcattcactgggtacacagaatgtcgggggcaatgcttcctagatgttcaggacagcaaaggaaagtcggtcctgaagagcgtttgcaactgatagtcaaaaattaggcatgctctcactagatcatcaagtggtgacagcttttagttggaggtcaagaagtcgtgacacctagaccttcagtgccatccatcacaggccatgaagagctgagagggcggcagccctgtgcatgttcttacacccctgcttcctcttttcccaggagactgtctcctggatgcccctgctgcggccctgcccctccccacaggcctcccgggccgcatggccctgtaccagctggaccagcagtgcaggcagatctttgggccggatttccgccactgccccaacacctctgctcaggacgtctgcgcccagctttggtgccacactgatggggctgagcccctgtgccacacgaagaatggcagcctgccctgggctgacggcacgccgtgcgggcctgggcacctctgctcagaaggcagctgtctacctgaggaggaagtggagaggcccaaggtgagggacagcccctgaggatagcggggaggggaaaggagaaacaaaaggaaatggggaggactgagggctgttctccagaaggaaaccacacttgagagtcatgaaccgagagacagccaggcagagcggctcacactggaatcccagcactttgggaagctgaggcagaaggatcacttgcaccgagaccagcctgggcaacatagtgagatcctgtctgtacaaaaaaataaaaaataggtcaggcatggtgactcacgcttgtagtcccagctactcagaaggcggaggcagggagatcacttgatctcaggagtttgaggctgcagtgaaccatgatcatgccactgcactctagcctgggcaacagagggagaccctgtctccaaaaaaaaaaaaaaaaaagaaaagaaacttcgggccaggctgcaacataggacttctaggtaaaatcactcatcttttaacaaacaaaccaaagcatatttatccacacggtgaggagcccgtgaaggctatcccctcggtcagtgggttgacactgccgtggctccagacattagggagctgctttggggctgcctcagggctggtgcaggtgcagattggtgagcggggtggagacaggaaggtgagcacacaacagatggagccactgtcaattccgtcatgaacacagagacacgcggaataaattccatcaagaattgagtgaaaagtattcatagcctgcccgtgcttgaactgaatgcataattacaggttgggagaatgagagcagttgtgggaattccgtattcaaagaggaggagaggagacagattcagagctgcctctggccaggcagaaaaaaacttggcccaggagagagtaaactcacaagaaaaaccaaggcagtgccagtgagggtttttaaatgattcacttctttgccctgctctgaatacatccaaactgtgaggctgatcgcatttctcttactgtgactcatggagccatcactatgaaacagcatccactgggtttcacagcccggtccccgccagcgctgaatcgccagggtggcccaagcactcctcagtgcatgtcttttgcactgagccttgggagcccgcctgcaccaggtaagctctgtactcttgtcctaagcctgagctggtgcaggattcatggactgatcctcagccacctcccattcaccctgttcattctcatcacatgttattgaggggagagcagagggatctgccaccaatcccagagcacagccgagctaagtgcagggagaggttgacgtgaaatgatcatggaatgatgtgtggcctctatttttaagaagtcagatcagaaaatacatatttatagaatcaggccaggtgctgtaatcccagcactttgggaggccgaggcgggtggatcacctgaggtcaggagttcgagaccagcctcaccaacatggtgaaaccctgtctctactaaaaatacaacaattagccaagtgtggtggcaggtgcctataatcccagctactccagaggccaagacaggagaatcacttgaacccaggaggcggcagttgcagtgagccaagatcataccactgcactctggcctgggcgacagagcaagactttcaagaaagaaagaaagtgagaaagaaagagagaaagagaggtagaaagaaagtgagaaagacagaaagaatatatacatagaatcatatcttttgtaaaataaaagcattgcatttttatgatgatatattcagagcaaaagtatgaaaaatattggtgaaaatcatgttaatggttttatctgggtagtggtgttttaaagaagtgttaatttcttttttacacttttctgcatttttttatttgtcgtatgagcaactattacttttataacttttaaaaaattattttcattttgaatactctatgaacctttgggcatacagcattccaaagggcaaagctttgttctcataggtcagttgtaaaatgggaagcagggccaggcatggtggctcacacttgtaatcccagtactttgggaggccgaggcaggttgatcacttgaggtcaggagttcaagaccagcatggccaacatggtgaaaccccatctctactaaaaatacaaaaattagccaggcgtggaggtgtgcacctgtaatcccagttattcgggaggccgaggcacaggaatcatttgaacccaggaggcggaggttgcagtgagccgagatcacgcctttgaactccagccttggcaacagagcaaaactctgtcaaaaaaaaaggaagcaattctgtttctttcccaagcattgtcctatcaccagaaccagtggctggtagactatggcaacacctcgcagggatgtttcctttagaccagagttcctctgccttggcactagggacacttaggactggataattgttaccgtggggcctgtgcattgctggatgtggagcagcatcactggcctctacccactagatgtggtcacgtacaccctccacagctgtagccaccagagtatctccagacattgccaaatgtcccctggagggcagaattcgccccaacggagaaccactgcattatatgcaaccttattcccataaaagggtgtcattcattcattcagcagatagcctattgagcaccttactaagcataaggcactgttttagacactgaggagtcagtagtgaatgagtccagcctggtctctgtgctcacaaagccatgcaggccacacagtcattaaacaaatgattgaggcagtttacggcactccatgcaccaagatgataatgactagatgaggaagccagggcattggccacccagtgacacagatactgaagcctcctggcctttgctcctcattcagtgtgccattgtatgttgcagcccgtggcagatggaggctgggcaccgtggggaccctggggagaatgttctcggacctgtggaggaggagtacagttttcacaccgtgagtgcaaggaccccgagcctcagaatggaggaagatactgcctgggtcggagagccaagtaccagtcatgccacacggaggaatgcccccctgacggtaattaccactcagggccgcccctgccagagcagctactatcattgctatgacgcatccccagaggatgtgtaaagtgggagtgaagtgggtgtcccgggatatagagttactcccagaggggagtaaattgggtctcctgggatgtagagttttgcctgtgatctccacctaaatgggctctgcaaggttccaatcccaggggcagctctcagggacccgggacagctctcatagtgttcagagagcctggcaaagtcaaggagagaaattacgctcatcttccaagatgtggagaggaggacatcactcccaaccaaacttattggggaggagcctctgcagaggggctggtgtctaggaaactaatcctcctggaggcataggaaccctcatctgtgtgcagaatggaagcattttccaaagcaagtgtcagagccaaacctccaaggtctttctagccaaaattcagcccagggcagagggaggatttctgaatctgattcctgttcacattccttctgagaagagttgcccatcttcccttgggaacatggcaactgtttgacagaatcttcccaggaaggaatactacctctccctccccttggcatattcctatccccagtacctgctggaaaccatgaacattaacttagaggcagtaaaggggcagcagcaaactcgtgagagggaaatcattacaaggtttttccccaccatcccatccaactgcccagtgtgcagctccaggaaggattggcaggcaagaaaaatcaggcagagccttaggagagattcaaccacgggaaaagacactggcattgggttgatgtctcaggagaatctgtaggctttgcggtttcacaagacaagaaggatccacaatggtttgaggctctagaaactttgccctggaattgtatgagagtttgcctggcatacagggtgagacgttgctgggaaagggggaggatgagaatgaatatagggtgcaaggtaggtgtggacgaaaagtgatgccatgatgtcagatgcaccaaagtctgccattactgtcgagtattttttagtattttttgtgtgtctagaactataaaaatgtatgaaaatgtaaaaggcatggtctctgtccctaaggagcttgtagtccaattagagacccaaatccctttaacacagccattacatttcaatggatgagtcacagaccctaggttggtgaggcgctcggagaaaggaaaggctgggtgagcggaagctttgaaaggagttaggactgagcagagtctggaggactgagatgggtgaggtgtgaggggacctgccagggtggtggaaaggtgtgagaagggccctcattcacttaggtggaatcaagcaaagcacaccactatgtcaaggccagaccacagaggtccttgaaggctgacacagtatctgggagttatctgtgccacctgtcccattaagtcacctggaagctcctgcagacacagcccagaccccctcagctgcactgactcagagtctcaggcgtggagtatggcatctgccttggcaaagtctccccaggcattcagatgcacagtttgggcagggaaccttggcaggaagaacagctttaattttaggatttgggggtggaaagcaacccacatctaacttcagatgggttggtctggcagcagcacgtggcaggatggagaggaggcaggcacaggtccccatgaagccagcaggcctgggcttgtggtggtgagagtgggatgccatcgttttaaatcacagattgtcctgaatatagtgtgggtctttgtgacagtttggaaatagcagatagagatgctcaaatgttcgggagataccaggataccagtctcagacttgggcatggtaagatcagcaaatgaaagtcaagacagttcgtggaaggaccatcgggagcttggccatgctgagttggaggtaatcacagtacatacaaacggagctccccagggacacccagaattacggaatgtgggtgtaggggcaagatcagagctagacatgtagatttaggagtctttggattcatgtccggtgtcactgaggaaatcgatactgcacaattagtagtgtcctgagaatatagctccacatgccattctgtgccttccaagcttactgaattgttccctgttgctccctgcgtttattcacctgtagagtacaatgagtctctttccctaatggaaagggcatttatcctagaaagcccagcatgcggctggaggctcctttccttgcccttttgagtaagggtcacacatgcgtctaggaatgttgtgcccagaagacactggccctgggcgcctgggttgagttcaaaaccaaaagaaagaagaaaagtgctgtaaattcgggatttctccaccggatgctcctgcttccgcatgggtgtcacctccatgccgtttcttcctctttctagggaaaagcttcagggagcagcagtgtgagaagtataatgcctacaattacactgacatggacgggaatctcctgcagtgggtccccaagtatgctggggtgtccccccgggaccgctgcaagttgttctgccgagcccgggggaggagcgagttcaaagtgttcgaggccaaggtgagaatcaccctgggactcagatccagagatggggaggaaggtcgcctgtccccacacccccgccccccggcaggctgcttctgtgctcaacacgccctccctcaccttccctttccccgttgcaggtgattgatggcaccctgtgtgggccagaaacactggccatctgtgtccgtggccagtgtgtcaaggccggctgtgaccatgtggtggactcgcctcggaagctggacaaatgcggggtgtgtgggggcaaaggcaactcctgcaggaaggtctccgggtccctcacccccaccaagtgagtctccccagaagttctgtaccttgcttggtagaagagcataatgggctttgcactctgctaggcccaaattgaactgtggctgctacttaatagctgtgagggttgggcaagttatttaaactctccgagcttcagtttctttgtaaaatgtcagcagtatctctatctcagagtcgttgtaaggatttcctgagatgggatgtgcacttggcagtgtcgagctcatagaaaagatagaacacagggcagccgtgacttttacgagggctggaggccatgtggatagggagctgtcatctctgagtcaatcgagccacactgagtaacctggacctctgccagaaaacagctctcccaggcctgttttgggaaggacgtctcaccctaagcctggcaagcccctgtcctttctgcagatggatcttcagagaagggggttaccaaaaaggggccctggcagcctcagggctttcatgaatctgagaactccagacacttttttctcatcctaatgccccacattcataaaactccaaggattttccaaagcgctttcatttccatggtctcatttgatttgtaaaataagtccatgaggtgagcaaggccaatactattcctcattttgcagaggaagaaattaaggcacagaaagattaaatgacttttctaaggtcacattgatggttaatgacagccagaagagaacctagttttcctaagtcctggatgacttttgtctcccattccatgtacttcctgcagagtaagggcaagttcgggtgttttatatgggccacactctgcctgtctgcctccagtacatcaatgtgtcctagggcttatgtgagcatccacctgtccagccacttcccccactcacggtctcagagtttttgagaagtgttcactgtattgtattctacctagtgaagctcgcaaaccctgccccattctgtgtgtgtgtgtgtgtctgtctgtctgtctgtctgtctctacatctctcatctcaccagtctgagagaacagaatcagcctacagcaggcaacttgggactgttttcattttttttaatttatttttattattttgagacagagtctcactctgttgcctaggctggagtgcggtggcacgatcttggctcactgcaacctgcttcccaggttcaagcaattctcctgcctcagcttcccaggtagctgggattacaggcatgcaccaccacacccagctaatttttgtatttttagtagagactgggtttcgtcatgttggccaggctggtcttgaactcctggcatcaagtgatccgcccgccttggcctcccaaagtgctgggattgtgggtatgagccactgcgccctgccttggaactctttttacatttaagctcaaaagacatagaaaaagagaagcagacactattcagatactgggtcccttggccactttccctcaggctttagacagatgggcctgtggacactctaagagtctgaaactaagcagctagccccagctggacatatggtaagaaaagcaaaaagcccgcctgaccactcgcctcactttctccccagcctatggaacccagatttccagaaaagaacaaacaactaatctttcttcatcctacctaaagccctaagcctataatggactggaaacagtttcccaaaactgcttcctatcattccagaagcacagtgctcatggtgcctgggcactcccagaaggtggcttcaaagaagcaggcttaaacccccaactcccaaccccaccctgatcccaccctagggccatattcatcaaatactaggagccgactgactcagagaggtggtgtgaaatttccctcctgttcacgttctggaaggggtgtgtggaacagttttttccatgtgggtttgagctctgggtatggaggtggccaatcaaagttgtataccagtgcaaggagctagaggtatttgagatcacatttgacaggtgccaggtttggctacaccagtgcagctttccacatccttctgggttctcctcgtctctatgctgttctcaacacccacatacctcaactcctcaaccacacttttgaaatagagttgccagatgaagcaaacacccttgaaaatcccaatgtacagacatttctgtctgcctaaacagctaatttattgagaactttgaggcaacttgcttaattacttgctttgtttttttcgtgtctgccacctggggtgcccacttcagtctccaaggcatcatcgtgacctgggctgggcagccactggtctaagggtgtccttctgtttctatcacagttatggctacaatgacattgtcaccatcccagctggtgccactaatattgacgtgaagcagcggagccacccgggtgtgcagaacgatgggaactacctggcgctgaagacggctgatgggcagtacctgctcaacggcaacctggccatctctgccatagagcaggacatcttggtgaaggggaccatcctgaagtacagcggctccatcgccaccctggagcgcctgcagagcttccggcccttgccagagcctctgacagtgcagctcctgacagtccctggcgaggtcttccccccaaaagtcaaatacaccttctttgttcctaatgacgtggactttagcatgcagagcagcaaagagagagcaaccaccaacatcatccagccgctgctccacgcacagtgggtgctgggggactggtctgagtgctctagcacctgcggggccggctggcagaggcgaactgtagagtgcagggacccctccggccaggcctctgccacctgcaacaaggctctgaaacccgaggatgccaagccctgcgaaagccagctgtgccccctgtgattcaggggggcaggggccagtcttgtgctcctggacatgcggtactgaggtgcagacaagggtctccactgtggtgactgggtcccttggccatatcaaggcagcacggcccacccaggcctcccattgccgcaacccctccagtactgcacaaattcctaagggggaagaggagagggtatggggcggcagaccctatcatcaactgtccagtggactggaccttgctcgggttcaagtagagggcataggttaaaaggtaaaagtgcacttattgactcagacaggacactcagcgtcagtctgtttgcaaaggactagcaaacttaaatgaaaaaaaaaattctatctggtttccccgataaataatctacctcacaggggaaaaaattagtacaagagaggcgtggggcagggagtcaatggtgaatgtcaaagcaggctccaaagctggaccccaagctgtcttcaagaatgaccacgactgtcttcagtgttaaaatccatcacctaaagggccgcagcgtcgcagggtttggagagccacatgttctcaggctgccacctgcaggggtggatccatttcaagtatttatgcaaatgtgtctctgaactaaagtgtgatcttatgccaatgcagtggtctggtctgattcattgtttctttggaaagggcagcaacctagaacccagggatggaggctgaaactaggtcagcagctggatccctgcctgctctgggtcctcacaggcctgcagaatccagctcattcgggcaactttcatttgcaggatctagaccagtggttcccaaggtttcattaggatcacgtagagggctgtgaaaatggattgtgaggctgggcacagtggctcacacctgtcattccagcactttgggaggctgaggcaggaggattgcctgagcccaggagttcaagaccagccatgacaatatggcgagaccctgtttctataaaaaattaaaaaacgaaatcagtcggtcatggtggtacaggcctgtagtcccagctactcaggaggctgaggtgggagggtcacttgagcccaggaggttgaggctgcagtgagccattttcatgccactgcactccagcctggatgacacagtgagaccctgtctcaaaaaaaaaaaaaaagaaagaaagaaagaaaagaaaacacagattgtggggccccatccccagagtttctgatctaatggttggggtggcctgagaatctgcatttctaacaagttcccagtgactgacatggaggctgctggtttgggagccacactgtgaacacctgtgctacaggaaacgtccagctgggagatcacaattgttatgcgatgcctttgggctcatcattcttgagaaagaatatccccttcctctctgtgagctaccccatcatcctcttacatgctgcctgcctccttttagtttagctgggggcaccagatcctcagcccctactccgctccatagctcctcatctctcctgtggctcagaggaactctggctcagtcttccacctggtctggtgcagagggaacttacttagtccctgatcacaaatgggtgacaagaaacagacatcaagaaatgacattctagcaaaagaaggaaaatacccaaatgtgcatcttggtttttttcaccacctgtgccccctttgtcctcccattcagatatctggcaccatgggcagagaggatgctgtaggggcactaggcaaggccatgagattccagccccactgttccccttagctgctctctacacgatgacagctgactcagagttggtcactccttcttgtctgcctactcttttcagcgagtgggaggctgggcttacctaagcataaacaggcacacacacaggcatgttgttgatgactagcaaaaccagattgtttccctgctgtgcaccagttttgtggaggctgatgtatgcttccgcaactcttcatcgccttccatttctcg

SEQ ID NO: 821 - DNA, 105002 bp, Human
  misc_feature (1)...(105002): n = A,T,C or G
caggtcagtggcaggttctcctactcagaacttcccaccatctgtgccttagaataaattcaaggcccttcacaaaacagacacaactcacctttctgctgtcatttccactggggcccccaccacaaccactttgatctctctcacagacacaccccccacagggcagctaccctggactctggactgtcttctgactctgcttgcattttctggcctctgccctgtcactggttttctcccaccagctgtgcctgctcaaattcctacccattctttaagacccagctaagatgttgccttccctcaacatttgtcagagtttccccattcattctgccctgtgtcactgagtgtgcctgtattagggttctctagagggacaggactaataggatacatgtatatatgaaagggagtttattaaggagtattgactcatatgatcacaaggtgaagtcccacaataggctgtctgcaagctgaggaacaaagaagccagtccgagttccaaaacctcagaagtagggaagccaacagtgcagccttcagtctgtggccgaaggccagagatcccctgacaaaccacttttataggtctaagagtccaaaagctgaagaacctggagtccgatgttcgagggtaggaagcatctagcacgggagaaaggtgaaggccaggagactcagccagtcaagtccttccaacttctgcctgcttttattctagccatgctggcagctgatgagatggtgcccacccagactgagggctggtccgcctctcccagtccactgttaatctccttggcaacaccctcacagacacacccaggaacaatactttgcattcgttcatatcaatcgagctgacaatattatccatcacagtgcctcagtctccccagtattcaggggagggcagagatgttgtctttttgtccttctgttccatggcgtgcccagatcctgtgatggcaggtgctcactatatctatggaactgaaaggccagaccctggggagaggacagagcaggtttgggagccaactgtgaaaccttggcagtgggagtcaggaagagcaacctaggtctttgcatcctcatgcaacaaggatggaggccacctcaagtacacattatgtgctcagcaaagacgagatttaaaagtataaaacattcacatttgagcaacttaggtcattaagaatttggcctctttataatgatagcagtgtccacaggaagagagtgagtgggacatgaaatttctggttctgcatgcagacttctacatttctaccagctaattattattatcattaaattattaagcaaagagcttactcgcaaaggtcaactttttataaagcataagtcatccttggaagtgtcgtttggtcattctagtaattcttgcttttaattctttaacaactatgggtagaactgcagtgtaccattattccacctttgtttgcactgtcaaaatacccaagacgttgccaaggacgactgaattcttaggcttggccgcagccacccacagggcaggtgctcacttcctcctccggggtagaagagatcatgggtccctttccagtccaggctggaatggagaagtcgtccctgaccacagtgcgccaggcagaggccaaggttctaaactgatagaacccacccaccagggcggtgccaagtcccagtaagggccgcatctccccagcttggctgatgaagaggcggggaccgaaccctccagtgcaggagcctgtctggtgcctggctctcccaccgatccgcacgtacctcttcctcgcgggtcctaccccacgcaggtatctagcgcccagccctgttcatttcccacacctggcccgctccgccccggggccgaggagacgcacgtctgattggccgagggcggcgggggcggggccggggcgcccccagaggcctagacagaggtgcgggcggggcaggccgcgctcagcaggcggggcgggagccgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcaggtaaccgcgggcacgccagccccgcagtccgctgggtgcctcgacgccacagctctgctgccttccagcctggggcagggctgcgcccctggggcaggtcacggctgctttgctgttggggcgggggggctctggagccggaagagtgagtcgcaggggaggtctggcagaggaagcgccccagtgccctcgggggcccggaggagggcgcggtggatgtgggaggacagggcccttctggtgcagaggggacgcggtgcaccgtagagtaggcgcacggaggcttttttggccgggtgccctgctccatcgtcgcctctcttatataatgttgctggagtatggggttccccatctgccctcttgcgtcccgtccctcccgttctcgcttttccttcggcccttggtcaccttggccacagggccaagaggagcctccacccacagcgccaaggattccccacgattcccggatttcactgcgcctacggtgcgcatcaggaaggaagtcaggttaaataaaccatctcctccgaaagtgaccaagaccaagagtcagctatgatgccctcacccaccgcctagagcaacaaacctttcttctcattggtttatcagctccaaatgaccccgctcccccaaggctgacagcctcacggtgaagggcaggtctcctgcttggggacctgctgcctctcactgcggaagcaggaccagaaacagacagccttcattgatgttcagggtagtgccagccccaccacaccacaccccttggcagcaaccggttgcttttactttctctttttgcctgggcgaggggtgtgcagagaactttgtttcttggttggactgcatcatgggcactcaatgggccaccctccaccggccacttctgttatcgtgcctgtatgaggaaggaaaagattgtccaggcagtttgaaaaacattaaattgttggtggctcttattttctttgcagctaagctaagttaccatctggtttagacttccttcggagagcgatgggaagagatttctcagagtgtgaatggcatcatcctatctacagcaaggacctggaaatgaaccctgctctgagtcacacttctctattctcctttgaccctgtgtgctaggaactaccaaaagaatcctttaaaataagatcctttattgccttgataatttattctgcctgccccacaatccaaggtggaaaagttcactgcagcaactaactacagtgaaaatgcactaacttttcaatcactaacctcttggttcccatcgacatctgcttcagtcctgtttttatctccttcacaaatttcaggatttccctaattcttgcaatctctgcaatcactgccctttatcactgacccaaagcgaaaagcaccaggtttaactctgttccccctgtgctaggtccccacaggttttgttatcctgtatccttccttactcctagcagctactctgatcgattttctctcaccctcagagcagacttgtggccttgtttggggaagcactggaattttgaacccccagccatttgggtcaattgtttggcaagagtgtccgcttcatgatgctggtgacggcatgcacctcgtcacatgtgcacggctaggcttgtgcaggtggcctctattacccaaacactgaaggagcccctctgtgtccttggagagatgccaggtgcttagtttacatttttgcctgcttggagagctaacagcttgaagtaaaccaatccatcagggactcctgaggttttcaccagccaacaccacccaatcgtgcgtgaagactttctgactccctggacattgccatggactcaactgtcacttcaggacctgtttttgaactaacaaacctagacttctgattctctcttgctgcacctacctgtacattctgaacacatggtagagactctacaaaatgcttaatatgtgatctatggacggttcccctgaaattataaatgctgccatcttcatccttcttgttttcccaagctatttccctatccatttgtctgtggttataaatgtcaatatccagcttctctttggaatgtgtgaagctctttggtctagggaccaaaggcaggaattatttagtgatcagacaataagaaaacactgaaagagatgatttgcctttgatggatgtaaaaatactaaaaatttattttcaatttatggtaatgctacttagccattttctctcaaacaccactggagaatttatataacatgaagcatatacaaaatgcatctagggggtaatgaggcttctcttcatcaacttctgccttttagatttgccccaatattgtacttggaggtaaatattaaaactccattgaggactggtataaagttgtaaagtgaacaaaacccagtagaaagctattgataaagaatctattttataaaataagttttatacaataaaatctactctgtaattaccttttcaaagtatatttctaaaatagcttatatgcccttctgtaccaaattttctaaataagggattatgttcacactttctcagtcctccttccagctcttcaacctactatcccaataagggtcataagactgaggcagtttcaacagctcctgctaaggttaaagaaagatacggggaagcatcatgaaaggataggactctccctatctaatgtatgtttatacataccttatatatggaggctaataagtttcctttaagtatatcaataattaagatctgtactaagtgaccactataagtgtcacattgaaattgcatacttggttcaaacaagggattagtctgagaaaaacatctatattcagagatgtagcagtttgttaggaagtttggcagctccactttaacatagctactccacacctctcctgtagtgttttagtgtttcaatctcagactcctaactcctgctttttccactgtataaagaaatgtagctaatccattggattctacaaaaattttgaaaaatccagaactgcaaactgcaaaggaaggcaaagctgctgcttccccagttcacctgtttgggatccagcacacaaagcagaatgcccgggaaagacagcagcaagactacagggcaggagaggggctgtttccaacaagggtgatgggcacgtctcctgcaggagcagacttcttttttcttctgtaatttttgatactttggaatgcaagatttattttggagaggcaagagagaatactttggaaaagatgtagatcagagatctgagtagctattgaattgtgggagaaggccatgagagaaagtgtaagtagtaatcttatagcacattttccttttttgttgactgtcttcccagcctgtgtccatcaagtagaaaatggcagaggaatgtcaaagaagaaagtgtgagggatgtggctgggcacggtatctcatgcctataatcccagcattttgggaggccgaagtgggtggatcacctgaggtcaggagttcgagaccagcttggccaacatggtgaaaccccatctctactaaaaatacaaaaattacccgggtgtggtggcaggcacctgtaatctcagctacttgggaggctgaggcatgagaatcacttgaacctgggaggcggaggttgcagttagctgagattgtgccactgcactccagcctgggcaacagagcaagactccatctcaaaaaaaaaagtgtgaaggatgaaagctgctatggcaaacatccttagctgcaatcctgtggaatacttttaaaattcagatttaaaataactttaagctttaaaggattgttgttgctgttgttgtttctcttgtcgttgcttctgttatttaaaacaaaacaaaaaaatccttccaaagttcaagctgcagtgagacttaattttatagttattatttacatggtaaaattcccctcaagtcaccagtccctggtatgggaatttttaactctgaaagcctttgaattattactaggaaaagcatctggtgttagtgaaaccagtgactgtgaagctggtatcaaaatgaaagtgccttttgggaaccaaaattttacaggtctttctgctgaactctggttcactgacagtgattgcttaagcttgtctaaaatatttcagctttactcttatcaacatgatttgtgctgtaattgtttaaaattttcctttgtaaaataactaaccaaattatctgattatagtttgttgtaacagatgtgaatcttattccacaaactcaggtgtgcaagaaacaatgcattactttattttcagaaatccaaattaaatttgatgctgagctcccattccaccaggttgccagaacttcaataattgtccttactggggtctttgccagctcatgcaaagtgccaggggaacattcagggaggattcttctttagtcattggatcccgctggttacctctgggttttccattgtccaaacccacaggatcttgtatctggtggctcaagactcatcagccatcactttggtagttcctggagtttggggttcagccttcttaggtgatccacactgtcaatccccccaggctttccccaggccctgtcgccttcctgagggtgccacaagccagtgtatggctggatagttgcagacgactgtgatgaaactgaggacaatgaaactgccacagtggagctggccacaggttctaccctcagaacccagacctctgtttcttcttgtttctgtaccccactgttctgctgctccctcagaaatttccccatttcctctgagatacctcaatgaatttaggtctccaaaaaatatctagggggaagtggtctttaagaaaattgtccttaagttttcctttttagtggccccactaacttgccctaaggcagaggagcacagaggcctcactatgtacttggatctgaagaaaggaacatatatatagtgcacatgctgtgttaagcatcgacttttcatgtaataatttaccctgccgtagtagctaacatgtaagcaaggcagaattatggtcccaactagacttttcattgagatgaaaactaaagagcttcttttgtcttattaaatgagaagggaaaaatctttcatgaaatagcaacaacaaatatacatgctactctacacgctttacatggattagctcctttcatgctcacaaccatcatatgaaaactggagcacagaggttaaatgatttgccctgatcctatggctaacaagtagcaggagcaaaatatggacccaggcggactggctccagagcccgtgttctgaccctacacactgcactgcctctctgctcaccactgtcccaccttttgtagtcccctgcagcttaaaaagagtgggaacagactgaggatgggaacagtccagtagtgctcagactctcctcagcaggcagggagcaaggcgcttcaaccacataatctacaatctgtctgtccatttgactcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatggtgagtattagagagggactttgaccgatttgctgttgtgcttgtcacatgtggcattaaacatgcacaatttagtaaaaatagagtcgtacattagtaagggcagtgagtaagctcttcacttccaggcactgtgcagttactttgagcgacattcttacaagtccatggtatttgcctctactttgcaggtaaggctaagagagataaagtgccttgtctgaggtcacacagccatgttgtgataaacctgggatttcatcagatagatatgtacttcttatgatggtcttctaaaccctagaggaaaggaaaccctagaggaaaggaatcattagatttgtacaggctaaaagtcaaatgatctaataatgttgatcttattctaagttttaaaagaagaagaaaggtcaggcgtagtggtgcatggttgcggtcccagcttctcgagagactgaggcagcaggatcacttgagcacacaggagttcaaggctgtagtgtgtaatgatcacgcctgtgaatagccactgcacttcagcctgggcaacatagtgagacacccatccttaaaaaagaaaagaaggagaaggaggaaaaatatattttttcttgcctacggattttgaataaaatgggaaaattttgagtggattttcttatttattttcatttttgcatggcaaccaaattttgatgtttatatttatgattcagcattttaagagtggagtttttcagttgcttccgaaaataagtatattaatattgccttgcggggagcggaccatggacttagccctgagtctagggactggattgcaactaatttctaagttaaagaatgagtagatttatttttttaaccattaaatgtaattagctatctcccaagcaaatatttttcattatgttgctctaaattacaccaaatgtcgatatgcatataattatgtcctctaagtcctattatttccccttgcctttctttacaaatttccctagctttacagtggctttcttcttctcttaaagatcatttaagctaaatttggcctcaaagtcactatagcagcttgctcccatactttccattatccatctgcacaagtttttctttctagctttctatttcctagtgaggatgcaagaattattctgagaatgtcaagttctgttgtggagaaatattagagaattagagatagggtttccttttcatcattccctggcctttgaatagttgacagtctgtttctgcgagccagtttcctcctaaaagtaaagcagttgctttttggatatgacttaatggcaaatttaaattctgtgccacaaaagcccttctccaacttgccaactaagaggaaacacagagccaaacaaaatgccttttaattggatttaacttgtttcattgtatttgtccagggatcagaaaggataattttcttggcagggttcttttagtctcctgatctaattcttttgaggggcatagttgtaatcttaaactccctcagtccccagtgtcttcatttcaatataactggttttcctttttatcctatgtattttatgtatgcatttctaatgttcttctgagacagggactgtggatttcacccagctgccaaagagatcagtagcacaaaaaaggttaaggatctacccaggggaccacccagagagagctaagcaatgccaccagcataacccaaaggcatgaagtgtttcttgaccttttcaaatataatatttgaaacactaaagctttttttaaagcatatatagttgtgactagtcaaggcatacctcaagttttaatttgcacagaaaccagggccaaacttgccacctcttctctgtttctgtctgggtgactggtaccatctaagttctacatgtcagaaatcagcaagtcacctgagaggtttcaggctcgcctcttccaccactccaatataatcaaatatgaagtcctggcaattctacccttttcaatttatgtatatcccttcttgttcttaggttagggactgctgtcttaagttagggactttctctaggactccgctctcagactctcgatactgattgttgtccccaccttcttatctagcagtatataaacaaaacatacaagatacccaagtcccaacaaagtgaaatccaaggttacctggtttgttacagcaaagctagggcttaaaaccagtattccattccccaaacatagcttctttctttcccccttggctttagcagtataaaccaagttttcacttgtgatacaagaacattaatttatcactgtgccttgggttgcctctcaccccaactcctatcctgtgtgagtcgtgttcatctcagagaaaactgaagttgtataaattttatgagtgaactgcttttgactagcacccaggtgtacattaatatcattaagataccttgatctcactagcacttttcaaattttgaatgtttggtgaatcacgcagaggaaatggactttttgtggcagggtggctgcagaactatcagaagtctgggcaactcttagaagcctgccaacaacctctttatccattgaaactattttgtctcatgttactgatgacattaatttgctagttttctgcataatcacctcatctcacaaatttgtaactattgcataataaagctgttgttttaaggatgctatcatcataaatttgcacattcagagaagattcttcccaggaaagtctgtcttgctaaggaagcccatggtgtgtaagaggccagcatcagcaaagaatgtgtgggaacaaaatgcttagtgaatagttagcgtaatttagctgcttctggtgtggtggttgtatgcttatcattcttcaaagcatatattgtgacttagagagcttattaattgaagcccagctttgagctatgaaatttaacttgaaacttgagaaggcacccgctgatgtcacaagttgtccttataggtcaagagtctaatcagagagagcccattctcattcctgtcacttgcagctgagtgcctgaatgtatcacttgactactctgcaaaaatggggatttcccagacaagtataatacctcccctatgatctcacaggtttatgataaagaacaaatgacagaaatgtataccaaggcactttgtattccaaaaatcaaaggttttagaaaagaaaactgatggctctacaaggaacagtctttgtgttcagggactgtcctcttaggtttgtaatatgggaaaagaaactggtcatgagctattggggggttttgatgcggttaaactgaaacataggtaataagcagaatccttataaaatataaggtcaacacactctttaacagaagtacccttttgaaaactgtttctatgacacagcaaaacaaaaccagtgatctttaaaagactatttgccaagaaaagcatccagattattattaccttttgctataggtctgcttattacattctaagctgttaaatggcctcacactttagttagacggacactggaggaaaagaaagtagaatcaaatactgtcttaagcacacttttaagcaaatctgtgagacatttggaggaaccctaattgcctggtaaacggtgataagatctgattactatgatttacctaatggccattatttgatctgttaatgactgaggtttttagcaaattgtggaccgaggttttggcaaattgtgacagggatacagggatagctgttctataaaaacacctttccaagagaattagtattgatataagtatcaaacattctttccagcatttccaggcatatttgaggttggaatcacttttcagttcctccccatgtaccagggaaaatgattgaagtaaaagctatgtctactacctcactggccccccgccggtcacatgactgccccattgaagctgctgcttctttcacaccccaaattaccatgccttgtaccttcccaagaatctgctcagaaattcagcagctcttccttttacttcctcaaaaaccacagtctcaattctacctccagtctctgaacaatgggactatttgtccatctttctaatgccgcaggtggttccaaagtccacacccaccctcagtggttccaaggaatttttctggctccaacactttctaaagaaaagaaaatagaggtaaatgtaacctcagccagggcaccctttctggtgaagtgctctgcggcccacagcagagttagtagaccctcacctgatcaagccaggctctttcagcgcctcatcacaccacagtaagtgaagcttcacatggttgatcactgaacgctatccccagtttgcaaaagcagaaacagaggctactagaggttggatagctagcccacaggcaaacagtgggttagcagggagccagcattcatatccagacctgacagcacccatgctctgaattcctacactcggatattgtattctaaacaacgtttcttttaaaaacagttttagaaattagccacctgacgctgactacccagtttttaactctcttttccccaacttcctctccaacccagagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctggtatgtatgggctggtaaattttatgtggaaaggtagtacatttatatgaggcaatagggagaaggaagagttcaaagtgactcaaaagtgactgcaaaaatattatcccggataagaagtgtatgtttggaggagaagagagaggtaatgtgtagccatgaatttgccttcagaagcaggcccggaagtgaaccaaggcggatggtgtcatggaggaggaggagggagtgttccatagcaccccagggagaggaagtgtggaaaaggcatgcacaattaggaaattgctgctgacctttagtagtttcagaagactagagggggtagaagctggattgtagtggaatgaagcatgaacagaaggaagtaagcctcgtaagtttcacggagcagaagaagagacagttggcaaaggacaaaattgcaacaaatttatgtagttacaatcttatttggctttattgcaattctagaatcaggcaacacctcatttcataaaatagactactgtaagtgttccagttcgttgaacagaggggattggctttgtagacagaaaaagggctgaagaaagcaaaaacagaaaccgaagagtggattggtcatttcaacgtaactttccttgtaagagcaatagagaaataattgattggtcaacatcaggtgacttcaggttaagcattgaaacagagggaacttcattatcagtccaattaaagattgaaactggcctgttggggaaattaggcagttgtctctctctcctgatttctcaaaagaccagatgacaatctgtttcagtttggtgatgtggaactttggcatgggtgactccattttgatttttgagtcctagatcaggagcttagtccaaaacagtggcttttttttatttaaaaaagcaaagggtagtttaagaaagagatcagttgaaaaacacttttagaatggtgaaatcttaagtatgtttatggcctgaagcaaagagcgggaaagagaagagatagatcttcctggctcaaaattggtgacactgttccttccaccattcctgtgtgtttgtcagagtgctttttctcgttactttttaccagaagcaaactgttcaggatttgctaaagaatttgctgttctttagaaagacagagagagaccaaagtagcaatcacatcattatctggcacataactgagacacagtttctcaccaattaggtgagagttacaggggatcacggtacctgacatgtgataggtactcacaaaatattacttaatggacaataggttgaaagaatctatagcaaagagaaaggaaagagctccagacctaagtaataatagttaatacttaacagggctctgccaggtgtcagatactgtttcaggctctcaatatacattaactcattcagtcctcacagcaaccctgaaaggtaccatactttatccccattttacagatgatcacagtgaggcacaagggagatatgtaacttgcctaagatcacacagctaataaatatcagaactagaattcaaacccaggaagtctggctatgaagtccttgtcccaaacagctacactaggctgactcattgagtagctagccaggtggtattagtaatgctgatccctccttcgggaatgtgagcttcagaatgcagaagctcttggagagcttggagagattatactgggttaagacttaagatttcagggtgcaacagaatcacatggagagtttgttagaacacagatatctagggcccagagattctgattcagtagatttttggtgggccccccaaatttggcaagtttccaggtagtgctgataatgctggtctgggaaccacacttggaggattacatatctaattagaggcccaggcttctcaacacctgtaacctacctactaaaatagaaaaagccagtattttcttcagctataattgataataagcagagtttggtcagccaggtatcaacttcatttaactctccttatcatttggatcagaaatttagatgtgaaagtttgcttagaggtaatccaatgtaaacccctgtttctcaggtgagaggcagaaggcccagatcagtgaaatgacctgtcagggtcagaccacatttttgtggacactagtgaaggattctttatcctccttccccactgtacatatttacccccactgtaccttgctgccttgacaggaatgtatcttggtgcctttagcctcctgtgggtgttgtgtgtgtgctggggctttgggggtgtgacacatacagtggtgttaatgcatgcatatgcttcctagagttactttttatggaagaagcaagagaaagtttctcaaacctgagggctgctaaatcatggaggtcatgttgtatagcaaacacactgccatcccactcctggaagcttctggatttacaagtgtagggcctcagtggtaataatgaacctttagacaatgtgctttcaaatccaccctattttgtttttatcaaatgtcagaatctctgttgctatttatgctatagaaaaatggctgaagcagcaggatgtgccatcagaggatcaacaagaccagtgccctcattatagctctgtcacagtcacctctaggtctttgttcctgtctgtgaaataaggacattagacaagatgatctctaaaggcccttccagcttataggatcatgagtataacatctgatatgtaactggctataggaggccttttggaaagtcccccagttggagcctgggatgcacttgacacagcctgcattggacttcccctcttgtggggagtacacaggaggctctgaatatattttgaaccagttgttttgaaatttttatttctcattcaggaaacagcttgcagtttctttgtctgaaattatgcatactctacaaacacatatgtatatatgtttctatgcacatatatacacacaaatacatatataatgcatatgtaatgtgaattacatatcatatattctttattaaagtattaaggagaaatttggacatagtttcccaaataaggtagtcacttgggctcaatatcttggccatttaagcagcatgtctgtgcacacacataaacatacagtggtttttatgcaggctgtgggcaaaccctctgtcatctgccactatgttcaaatgagcttgttttccattagctcagtgttcacaacatgtgcacactgagacccatatctcaggcagagggcagtcagggacatgggcgaaaacacagcattgtaattgatagggataaaaggagaatggaaaataagaaagagtggaagcttcaaccagcctgagtcatttggtgtgtcatgattccaattttattgtgatcaaaatatggtctaaatgagtgatggcagtctccctttgggcatatcctaagagtatgcaaattgacttgcagtatttctaagcattctaagtaatagaaaacattatgtccttactttatgatcactaacgtgtctttatcaacagaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaaggtagattttatttgcatgtgatagagcaaattggctaaaattgtaaaggtacttcttcttctgttttcatatccagatgtgtttctttgtatgtaacttttctgacctctcttgggatttaaacttctacactgaaacccataagcaaaaaagtactgaatgtaatcatatttcaccattgagaaatgtatcttgtgatggaaactaaagagagattgatgttcagaaaacaaggttgggtagcaagattaaactgctaccctaatcctaaatgaaaggattttcaaaaagcgaataattaaactctttgaacattgaaaaatagagaattaaaggaagggaaggaagatggttaagttacactagatggcctcagtaaacatccttacattgagtgaaagggtacagtcctcaggggcaaggagtgttttactaaatcttaaagtggatttaataacatggacacagaatgggtaggactttgttttgttttgtttgggggatggtagtggtaattttttaatttttaattatgaaaacttaatagataagaataaataaaaactttaaaagaccatttatcctatcataagaatttaagtatcaccttgttaatttcaataacaaaccctattggaactttgattggaattgtattgaatcatagattcattaaagaggaattggccgggtgcggtggctcacacctgcaatgccagcactttaaaaggtaaaggcaggaggattacttgaagccaggggtttgaaaccagcctgggcaaagtgagaccacgtctctacaaaaaaaaaaatttttttttaattggctgttggcatgtgcctgtagtcccagctgctctggagactgaggtagaaggattgcttgagcctgggagattgaagctgcagagagctatgatggcatcactgcactccagcctgagtgatagaggaagaccttgtcttaaaaaataaataaataaaaggtattgcagtttcaatattgtcttctcaaccatgaaaatgatatgcttttctatttatttaggacttcttttatgtactcagtaaaattctataactctttccatagtcttgtatatctttcaaaagaaactatataaacaaattttaatattatatttaaaaatcaaggaacctaagttactgagtccctgatgagttattctttgaatgaaagacaaataattgtaatatatgataatgatgatgtgccagacagactactaaatgctttttatacattatctcctttcatcccatctaactaccttatgaggtggacgttattgttatcctcattttgcagatgaggaatgcgaggctcagagaggaaacataacttgtccaaagtcacccacaagtatttagcagagcctaaatttgaagagtcagtttgacttgaaaacaaattgtatcacacatataaatggattcaccttttataagactgtaagttctttgcaggcagaaatgggtctcatgggttgtttttcacttttgcacaaagctgtaagctttattgctatatattaagcaaacatgtattgtctaagtaattcagatgcattctgtcacactattttataataactggaaatatttgataaatgcttactgtaagcaagccctactttctccagataaatccattaatcattactacaacctcatcaaacaaatgttttatcactagataaggaaattgatccttagaaataatatacccaacagcatacagctaagaagtatcagattgggatttgaatatcaacatatagaattgcagaactctatttatgtgaaagagggtctcaatatgttgcccaggctagtgtgcagtggatattcacaggtgtgatcagagcacactatagcctcaactcttgggctcaagcgatcttcccacctcagtcttccaagtagctaggactacaggagcacaggatcatgcccagcttttttgttatactacgtacccctcttagatatctttatctctttttatcattaaaaggccacaggtcttttgtcgctctttttgtttacagctttattcagacctcctttcttacttgtagctttacccttttcctgtattgtttggcacttgaatattcagatctttagaatgaaaatctgccaaataagccaaatgagctagtgtttggcattggagttctattccagacctcactgaagcctcagaaaaaatattgttgcgaatgaaaagtgccgataaattcaagtttcctagaatattgacatttggaaaccgatgacttcagtgaaggagaaaagtgccaaagtgtgacaatcaaatgttgcacgattctttatgcatcagttttctttaataactcatgaaagtaatgtaatatggtaaaggaccttattgtaccctactcctggccggacatgccccgtatttaatacatatcattaattttagaagtatatctgtttctaatgtttcaagttcctcttccagtgtgaaagcttcttaggcatatcaatacgcctaattatgactattggtttcccaagacccaagaaaactgtgttttaacctctaaaactctgctttctatctttctttcttttttcttttttttttttttttttgttgttgttgagacagagtcctgctctgccacctaggatggagtgcagtggcacaatatcggctcactgcaacctctgtctcctgggttcaagcaattcttctgcctcagcctcctgagtagctgggattacaggcacacgccaccacacctggctaatttttgtatttttagtagagacagggtttcaccgtgttggccaggctggtctcaaactcttgacttcaggtgatccacccgccttctatctttcttaattgctgatagcatctggtcatcaaataacaaatttgaatgatctatctccactgtaccacgtgtgtgtgtgtgtgtgtgtgtgtgtgtgtgtgtgtgtgactctcactctcattctgtatctctagtctaaacaggaccctttgggccctagagccataagccacatatatatatgttatattatatataatatatatatatattccattgtctatgaaacagctcctatacatatttctgacccagtcccagaaaaacttgatcatatggggatccatgtctgtctccttctactagattgaaattctcatgagggcaaggactttgtcatttcagtttttacatccctagaacctggcaaataatatgtgtgcctaatgaatttaaattgtcagtctagaatacagtcagattttctgaatctagaagtacaatggaaactgcttttgataagtcttcgtatattaataaaagaggattaaaaatagatagtgagacagctactctaagaagcttctgtccttaccttagatgaaagggaatttgacaagctaataggagagcagaactgaattaacttatcagcctttgggtttctcaatagtctgaagacttttgtctattagcattgcctacctttgatgcataaacagccctctacagggattgctgccttacaatcaaggtctgcagatttgtttgttattagtagaataagtctaatttagataataacttaggcaactttgtcactttttaaaaattttttaattcttacagaaaaagaaggcattgctaagattttctggattggtttaaatcagctatactctgctagaggctgggaatggtcagaccacaaaccattaaactttctcaactgggatccaggtaactgctctttccctaccccctctgcacagaacaaatcttcaaaaaagcaaaagcttctcactcaccaatagcttagaaaagtttcacatcttggcagctcttactatggttacctctcagaagaattttttcttcctaaaccattcttaattgtggtactgttattgccaagctgaaccacaccatggacaactgagcatttgaacctctagacctttagaacaaccctacatttttatgtaagagcaaaatgagctccaccacatggcccaggagccattctatgtccctaaaggacttggcatgtctataactcacccatgctgtgtttcatctgcagctgaactctaatatggaattatccgctcgttttcaaactcttggggtctctccccactatagcacccaagtactgacaatataatggttgtattttataatacaaataaatacctcaaagaaagtcttttagggaataaaacaagcaaaatgccacttagccaaaaagcattcttcccaaaggaaggattagacaactttgaaaaataaaatcttaggcttatgacaaatgtagaacctaaagttaacactaatttcagtataaagctgcctgcacacatagtaggaaaactgagttaagagcaataaaattcaaattagccactttagttaatttagtttgctaaatttccttaccagcaaatgaagtaatacttttattatttcagtaaatagaatatttaaagataatttaatctttaactcaaggccttaatggcatgacaatgataaattaatatttttattttatggagtagcagattaagagctactaaccatagaatatggcctggaagtcatttgaggaaaaagtttggtttttgtttttaaaattaactacaacatatcatgatgttttccctttagattctatattttagaagaaagacatatttaagcacataattattcattgaggcttatacgtttcaatttagttaagttttaactataatatgagttcccataaaagcataaaattaggaatacaaattattctttctgacaccatcctggccctaactttctcattctaatgctttgaaaaatgttcccttttaagacaggcccagtgcacctactataggtggctccagctgtgcaagaatggatgctgagtctggtctgtggcagagcttttcctgtgaagctcaactgccctatgtctgcaggaaaccattaaataatacagtggagttaacaggtatctttctcacatactcatacaaatagacaaataggtcttaaaatcatagttttgtgaaaacaagtaaatcttttccaacatccgtttccacctttccttctcctgatactgacagtacagaaaagtacttgatttttaaccctgtggttagatattatcaaccatatatgaataaagctttatttgaggtaatgaagaatattaaatataaatatgtatgcgcccagaagaaggcagagatattcgagataggaaatatacttctgttcgtgtgtggctcttttttctccagagcagtggttctccaggggtggtccccagaccaacagcatcagcatcacctcttcctgttagaaatgcaagctctcaggacccaccccagatttgctacatcagaaactacaggatggggtccagcaatctgtattttaagaaactttccaggtggttctgatgcgtattcaagtctgagaaccactgcagttcatgcctccgtaatgaggcaaaacctatagacacaggagtaagcccaggcttctctaccttgtgccccacagcacccagccctcttctatccttctctgtcaggcaagtctttgcattgaaaaatcaagtaaaaaaggagaggtgcagagggacaaaatgtgtacaataagggggtttttccagggcgtttggggatgaaagtgacacaagaacagctgaagtttttgaggagtggaagggtgtgaggagtttttgaaagaatggagaagaggagtgtattgactgtcaagcacagggcctgatgtatacctggtatttaattacatcctcaccaaatgagagaaactaatactcaaagctggagggatgtattcatccgttttcatgctactgataaagacatacccaagactgggaagaaaaagaggtttaatggaccttacaatctcacgtggctggggaggtctcacaatcatggccgaaggcaaggaggagcaagtcacatcttacatgaatggtggcaggcaaagaaagagagcttgtgcaggaaaactccgccttataaaaccgccagatctcatgagacttattcgctatcatgagaacagcagggagagacctgcccccatgattcaattacctttcaccaggtccctcccataacacatgggaatttaaggtgagatttgggtgaggacacagccaaaccatatcaaggggaaaggatgatttttaaatgtcctgctttaaggaactgtgagtgaagggaataaagcattcaaatgtcttgtcatctaaaaaggagtatagagcaatttttaaggaaaaactagatataaaataaagaatctgaggggatattttaagataataggggaaatgaacatttgtcttccaagttgattcaaaccaaatttagtccatacaacaaaaggcataatagaaaagccagcacaaatgaaaataaactagagcaattgatgatagattaagtaaataccttgcagtagcaattattaaataaatcatgatgtttccacatgattgaataatatgcatttactaaaataactgtgccagcaggaaaatacaaagaacaaaaccaaatgatatgcctacttatcattttaatcttgtaaaaatatgtattcattgagacaaagactagaatatgaaaatgattgcattaagttccattatgggtgatatttttcctctgttcctttatcataattataaaatataacaataatacatgctatttcagaatattaaagttaattgagttatctcgcaagtgtaagaggctagctgaatctgaatcactttatcctttagtaaaaaaaacaaactgtccacatttttttttctttttttttttaattatactttaagttttagggtacatgtgcacattgtgcaggttagttacatatgtatacgtgtgccatgctggtgcgctgcacccactaactcgtcatctagcattaggtatatctcccaatgctatccctcccccctccccctccccccaccccacaacagtccccagagatgctgtgttttcttacaacaaatattccaaatggttctaaatcagtgaagtctgagtaaccaactcactttctggttttgttaacggggatagaagtattctgtggggtttcatacttcattctttttttctaatctggaaagattagaccttcgattgtgagctttctcatggtcaaaacagaatcactaattccatgaggaccatctgtctagcagaggggaggaaagaagtccaggggtaacctttgccctctcatctcttggatgcgaagtgtataaatgtcttattctgtcccttaaatctctgcctgtcctttgttcaacggtgagcgttaatctacatccccttgctaagctggccatacaagaaaaggaggcttgccctcttataatcttctcaaggacagagactggagggaaacctaacaaattccatatccaggaaaaaatttgtcagaaaatgacttaaggcacatctttctactgtctacttggactaagggcaatctcccttgactgtgtccaagcccttaatagtctgtgctcagccatatagcacattgaagcatgttaaagtcacatcattttctgaatcccagcgggaattcctatgatgctatatatacctcatttatgtggtaggcaccacatgaattcatgtcaccgtagcatctgacatcacgtccccagttttccaggactctcattattcaagaaaaaagaatttgcaatgttattgattcacaatagatgtatctttactggaatataaatagctgcttttcccccagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgagggtaagtttttaaaaataccctatttgagaggcttaagccattttaaagtatccctggttttagactctttgtgggaatgaaaagcttacagtttgatcccacagatcagccctgtcagataggattgtctctggtgatggaactgttctacaattggtctagtatggtggtcactagcaacatgcagcttctgagcagttggcatgtagccagggcaactgaggaactgaattattacttttatttcatcttaattaatttaagtggccgcatgtgcctagtggcaaccaatttgacagtactgccattgattgatttccctcttctcatgagctaaattctatttaagttgctcaaaaaacttaagtgataattacttcacttttgtaattatttgaaagctaaagactggtaaaggaaaatatactagacggacagtattatgatctcttcctagaatagaactcttagctagaatagctaagagtaggtacctactcagtgccagcctggtgctccttgtttcacttgtgaaggcagcagagtcataccagggcagcagtggacagtatttctattcaaattgggatatgtatgattgtatttatagaatttcattcaccccacaaagcaaagtttatctacaccagatatcaggaacacccagcctgcagatgttctacctgtgtactttacttgcataagttacttgaaaagccttcattacccaacctgcctgtcgtatcaacatattaataaccgaattaagaatactacaaaggctcttaaaactccatatcagaatataaaaatttgtataacaatgtacatattacagtatttaattgagcaaaaccaaacaaataatacatttttcttttagatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagaggtacgaaacctcctgtggtttctttatattcttactgttttacctaatgataatattaagacttctttggttgggaagtttgcgtataagctggaaaagaaaaggtaagagcactctggatcagggtacagagccacggaccattacctgttaagaattgggccgcacagcaggaggtgagcggcgggtaagcaagcattactgcctgaactccgcctcctgtcagattggcagcagcattagattctcctaggagggtgaaccctattatgaactgcacatgcaagggatctaggttgcacttccttgtggaacagtttcatcccaaaactatcctcttccccaccctctgtggaaaaaattgtcttccacaaaactggtccctggtgtcaaaggttggcaacaaataatctaaagtctagactgtctttctggtagctactttaaaaaggtaaataaaagcaattactaaataagcaacccatatcctatctgagagcatcttttctggtctcaaacagatacagagaatccctttagaactcacattcttgtgctgactgattctagcaacctgctttctctcaggaccagggcctgcacccacctttctgccatcagtgtgatattcggcagatagccacaatttaacctgaaaaatcccatcttccaaattcatgttcagattgttttatatcgatactactttgagaagtaaaaaaatggttttatttaaaaactaggcctaacatttttcagaaaccaccttactcctatagaatgcttaaacattttttgaacatcttttacttaataatccaaaataggctgtgtcttgagcagaaaagatatatgtacctctacgttttgtttgtatcactttcctgtggacccctaattggttatgaaagtgactgtgtcactcagacatctaaagagacttaagtggaagcaataaatattatgtgtatttaaaagaagtttagaaaggtgtcacatttgatgctctatttaaaaggacatccaacatgtctttagaagaacatcagaaatggaaaagtgttcccatgggcaagagtgaattgatggcatacctagacagcattccaatgttcaaaactgacccttatcacaatcgacttattagaatttaattcaaacaaagcaaagtgacgtagtcagttaagcaaattaatgttaagtagcatatatgaaagagagaattttgaagtccagattgaagtagagttgaaagaaacttttgacctagaattcatggagaatagctattttagccaccatcatcattttacacatgaggaaaccgagaaagggaggttgatgatgtacctaaaagtttcaaactttggctgtgcccttctagtctagaagactagaatgctggaactgtgggctgagttcttctctcttcaacttttatactaagtgtgctttgatggttttattgctactcttataagaaaatgaaatttatccacactgtgacctggaggtgatgctgaggtaactggctgtgagccatcactttgcaggcctgttgagtagcattttctaggagtgtgttctcacatttgataattcacttatattcatttctctctctctgtctctgtcatagtttttgtgagttcagttctgaatatgcggtaaataatttcctttccaagcaaatgtttttgtctcctttcaaagctaggtcagtggaaagtccaatcatgtgaggagaaactaaaatatgtatgcaagagaaagggagaaaaactgaatgacgcaagttctgataagatgtgtcctccagatgaggtaggtaaaatccctatgtaaattttctcaagcagtattacaacttcttggttagaaatggtagctgagacttaaataactcagacttataaaatagaggaaactactagcttctgttcatttaagttagaacaagccagaaggcagtgagtcatagcatattggccttcttacagaagcagaaacttgaaaatttctataaatatttgtagaattactatcctcaaggctgatgtctttacttcccccactaatatcaatattcaaaaataattcatccagtgaatattatactcttatgatgagccagccacccatatgagaagtaacccatactttttgtctgacacaggcccacagtcttgtggaggttatctgtgaaattgcatcccaccctcatcacatgtatgatttcaatagccatgtcctcaatttccacaagttctaagacgttatcaatgtagcagaaacatgcttgccagacgggacaccatcaagtctggaaaagagtttgacaatatttttcctctgacttagggctggaagagacatggagaaacctgttacaagatttatgaggatgaggtcccttttggaacaaactgcaatctgactatcactagcaggtgtgaccatcagtaaacttgtactcataaactttcaactctgaattcttttgccaaacagtcttcctaagtaaaaggtgcatcttcaaatagagtcaatcattgtgaaacacttgccaatttgattctccttttgtagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccaggtgagtgtcttaatctttgaagtagtagtatactgtgactagtgaaaggcagcactcctcccaaagatgttcctcacttacttttgaaatgtgagggacatgatgatcttcaggattggagtctatctatggaaccataaatagaagcagtggctatgtcttccctattatgtccttgggaataatccaatgaaagaaattcaaaaacttagttctcccaaaccaccatctaatggctcagagctagaagcaccagtgtgagtttttaaaatcttttccatgtaaatctcaaatagaatctagaagctcccgtgtgaggctctttacattttcatctctctgcttcttaacctattttcaaaactgaatgtgttttcttcccttattctcaatgggtaagaattatggaggctatcttgtattatttattttgtttttgtttttgtttttgttttgagatggggtctcactctgttgcccaggctggaatgcagtggtgtgatctcggctcactgcaacctctgcctcccaggttcaagtgattcttctgcctcagcctcccaagtagctgggattacaggtgcatgccaacatgcccagctactttttgtatttctgtagagatggggttttaacatgttggccaggctggtctcgatctcctgaccccaagtaatccatctgcctcagcctcccaaagtgctgggattacaggtgtgagccactgtgcctggcttcttatttattttgaaagttatttcctctttctccaaccagcctaaagcattgaccataatttgccatagaatcagaacacttaagccggaaaggacctcagaaatacttttagagttaagaaaacagagactttaaaaggtgatttacttgacaaagatcatctggttattgaattaatgaaatccagagttcctgatttttaagccagtggctttgaataagacagcagtataaagcattctacttttcaccctgtgaattatttatattttattgtgttggtctaatgtgatcatgaagactattttttataacacagagattggaaaatatgagcttacaattgaacatgttatttgaaatagaaaatgcccacaaaagttaggacacatggtcatcaccatcaacatgagtgatgttgctagtaacaaagtcatccttttatgtctgaaaaagatagagtatacagatgttgatcctggttaaatctcagattaagaacactctaatggataaagcacatagatttctttttttctttttcttttttcttttttctttttttttttttttttttttttgagatggagtttcgctcctcttgcccaggctggagtgcaatggctcgatctcggctcactgtaacctctgcctcccgtgtacaaacaattctcctgcctcagcctcccaagtagctgggattacaggcacctgccaccatgcccagctaattttttttgtatttttagtagagacggagtttcaccattttggccaggctggtctcgaactcctgacctcaggtgatctacccacctcagcctccgaaagtgctgggattacaggcgtgagccaccgtgcctggccagatttgttttatagacactaagagtaaaggtgacgttcttgataactaagtcttggtggttggagaggtgcttgggaagtagctaccatgactacttcctccattctatggccagaaaggctatgtgaagctctctttaccattattgcacccatcctcagccaacttggtctatcatgggcacaccgtggatagaaggactgaacagggaaaaatagcacacccattcagggtagcaaggcaattatttttcccagtttcttattcctcttgctgtttgtgtatatgagactatgtggcttctctgtttggtgggatagaagttgtcctattacttttcagtatatgtaactcttcttgtcttttacctgcttcaggcagtgtgatgtaatggaaaatggaacatgatgttttgtcagacaaatctggtttcaaccccaactctaccattcactaactctgactgtgggcaagttacttagtcttcatttacaaaatggaactgataattcaaactaccttttaatactgttatgaatacataaaattatgactgtcataaaattaacggtaaacaaatgtatgttaccacatacctccttctacctttattgtaccagcttttcctttggatcagaatctgggagagttgtgttttgaggttaactaagtttcttaaaaactgctcaaagtttttaagctaatttgaaccactatcctaagcagcagtagtatttagggtacagctctagaaacagaccacctgggcacaaatcctggggcaaccacttactaattctatgaccttgaacaagtcacttcattctcactgtacctcaaattatgacaatagaatccccccataggtttgttatgaggattaatctttttcaaaaagtactttacaaataataaacacctgtcattattattctgaacaacatatttctttcctctctttgttccattttttttttattctctctccccaacttggctgaagtaaagagtagaaacactagaaaatgtttgaactttaacgttttaatttttaattgagctttccacttcaatcccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtaaagtgacattctcattctatccttcaatgaagttatttttccactacccttgttcatgtccttgtacaaattatgctcttctccatagtactatgtaacctaactaaagtgctctggagcacagagtccttggcagggcatcgctgaacctctggtgtgaggtgcctcagccccacaccctgcacgtgtcctacctgaaagggcaggcccaaagccagaagtggctccaccccaaggtctttttttcccagtaagttggtgtactatatgccatactgccactatgcctatgatcctcatattcctctaattcttgttgtcaaattaacagctccagcactcctaataatgtaaaaaaagtgtatatatatttacacttttacaaacatatatatatttgtgtgtatatatacaaatatatatatttatatatacaatatatatatttataaacatatttacaatatatatattataaatatatttataaatatatttacaatatatatatttataaatatatttataaaatatatatgtttatatatttacaaaatatatatgtatatatatttacaaaatatatatatatttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacatgatatttacaatatatttatatatatttacaatatatatatttacaatatatatatttacaatatatttatatatatttactatatatatttacaatatatttatatatatttacaatatatatacgtttatatatatttacaaaatatatatactttatatatatttacaaaatatatatacgtttatatatttacaaaatatatatacgtttatatttttacaaaatatatacgtttatatatttttacaaaatatatacgtttatatgtatttttacaaaatatatacgtttatatgtatttttacaaaatatatacgtttatatgtatttttacaaaatatatacgtttatatgtatttttacaaaatatatacgtttatatgtatttttacaaaatatatacgtttatatgtatttttacaaaatatatacgtttatatgtatttttacaaaatatatacgtttatatgtatttttactatatgtatatatttatgtatatttttacaaaatgtatatatttatgtatatttttacaaaatgtatatatttatgtgtatttttattatatgtatatatatttatatatatatttggtctgcatcagtcagctagttccataaacaaaccactagatgccatcccaaaattcggtggctatgacaacaaacatttagcctcacattctcacagatcttcaggccagctagagtttgactgatctagtttgggcttgaatggtgacctctgctcccaacttcaggtcagctgtgctgggctccagcccttccttctagagctcaggctaaaagggcaacagctcacaggggtttgttgttctcatggtatatcactggagcccaagaaggcaagccaaccatataagcacatttcaggcctctgctcagtttaccttcactaatatcccatcaacacagtaagtcatatggccaagccccatgccaaggtacaaagaagtatactccgcccaccagggggctgtggcaagaccatctaattatattacaaggaactgaagaattgggacaaatataattcatcctgtcattgtgtcatcatctcttcttcctcctctgcctcctcctcctcctctttttcttctttcttctttcttcttctttctttttctcctttcttcttcttttgaaacagcccaagttccaggtttacttttgccactttctgtcaatattcacacaccagtgcagactgctctttggttgttcctcgtcagaaaatagtgctatttttgtgtgggtcactgtgtcttatattcgaaatttctattgttagcacatttctttgccaaaggctactcccaaagcatttatatgtatcctttacagccttgcctcctggttcattttatctttcaaggtcctaggaatacaggagaacgtggatcttgttggaatagttccccagcctggctgaggaaggccatccatctgaccacaaggactggcatctgtgctggcctttagttgaattgacactttcagcaggacctgtctgtgtctcagtatatgtgcatttacctatgccttcactacacctttaagaattcatttcaggggcccacacatgtgacagtaattgactttagcactatgaaatactttatgataataccagaaaacaaattaatattatattttgctaaggtattccatgcagaaagaattgtaagaaagaggaactgggaagaagctgaacgattctgccaagcccttggagcacacctttctagcttcagccatgtggatgaaataaaggaatttcttcactttttaacggaccagttcaggtaatactttaagaatgagaatttctatgctgaatttgatgtcctctagatattcaaaattgacatgttcttaccctcactctctgttggaaaaaaaatggacatgttttattatctaaaaggtcatttggtgcttagcagtcatggaacattaagcactcttaatgtgcagacactatgaggaatctaaaaatgaatgagatgtattccctaccctttgtttaataaagtccaacagcaatgtatggcagaaaatctagaatataggcaaggaagggccttgggaattcagaggagggagggagtgtttctgggagtataatcaggaaaaatgtcataaagaaggctgattcttggaaggtaggtattatttcaaaaggcaagataggagaaggagaaggagccagaaaaaaaacagaacataagcaaaggaactaagaccagaatatacagatatggtcaaggagaaatgagtcatacaaattagctagaaaatggaatttggatatgaaattggaatgtccttgtttgcaagggaaggagtttgatcttaagtaattaaacacaaccaaacaaaaaacaaaaacaaggtgcgtgtgtgtgtatttatatctacacacactcacatatacctgcatatatacatatatacacagagaggaaggggttggccaggctggtctcgaacttctgacctcaggtgatctgcccacctcagcctcccaaagtactgggattacaggcattagccaccacacccagcccattatcagttttgattaagtgtgagtctgcaaatttgttcaataataataaagtccaattctgcacttttgaaagagacttaaaacaaagcttgccaattagtacttatccagctctaagactataatgttcttttcctgggaggaaggggccacaaaatactacaaaattgtgaaattctaataaaaatccttaaaaatttaaaaattttttaaattttttaattttaaaaattaaagcaactagcaacattttcattgtgcaacagataaaagttagtgctgagtagctggtggcctcctgaaatggggcctgactctccaatttgccaggtctctaatttattacttcttgaccccacttcacttgcttatgttatgtgcttgtcttatatttactcaaatagcaattgagttaataatcacaagtcatgtgatcatcttaataggtactgaaaatgcattgggtaaaatccactattcattcctggtttaatacataaatatacacttatatttagtaaatataactaatatgtaaattcttatttgaatagaagaatagctcaaattaatagccatatcacacttaatgatgaagcattgttaagtgcatttccctgaaagtcagaaaaaggtaagtatccctatatcatcactattgttaatcttggtttgaaattcaactcctgcacattaagataaaaacaatactataatgtgtaaatgtttatatatattaagcagaggaaaagacagattatcaaagagtaaaaaatatactatttacatttaaaactagactgcaaaaagggtaatggctattatatctctaggaagtaagattttgagtgatttttaaagtcttttctatgggctgggtgtggtggcttatgcctgtaatcccagcactttgggggcctgaggtgagaggattgcttgaaaccaggagttcgagaccagcctgggtagcatagggagaccctatctctatttaaaaaaaaaaaaaaagaattagctgggcatggtggcacacacctgtagtcctggttactcaggaggctgagtcaggaggatcacttgagcccaggagttcaaggatacagtgagacaagatagtgccactgcactccagcttgggcaacagagtgagatgctgtctgtaaaaaataaatgaatagaatgttttctttgaaaatttctatattttccagatttgctttttgttttgttttttgagacggagtcttgttttgtcactcaggctgaggtacagtggcatgattacagctcactgcagcctcaacctcccagactcaggtaatccccccacttcagcctcccaagtagctgggactacaatcacatgccaccacacccagctaatgtttgtatttttttgtagaaacgggtttttccatgttgcccaggctaatctcagattcctggctcaagcgattcaccttccttggcctcccaaggtgctgggatcacagatgtgagccacagtgcctggcccagatttgctctaatatagcttctgctgtgtttttctcattagagaatgtagtttcactacagtgtactgggaatctaatgtaaaatatgatacctgtgttccataaatatttatttattaagcatctatcgtagaatctcaggtattctagacatcattgtccagtgttagaaattaatatacaaaatttcactgcagactgacccaaggcaatttgtatatactaaatactaactcttgggttctttgtgaggtgagtgttagctattccctcaaccttgagaatagattataacaaatgcaaaattcagaccaaaattttccacacatacagacatttgctatgcaaacattcattgaagcagacacaaaacattttatacaacgtgttttgtaagcttgacaacattccagcaatctgtcctttttggtgttttaactatcaccttgcacagatttacttgaagcagatgtggcagtgttctgtggcagcattctgttcccattgtagtgagtatcaggccatcacaatcacctgacccaatgactggatgtggggttgtttcgaatcaagccctactaagatacaggctgcggcctcgcaagattctaatacactcttgagaagtgtgagagtttctctaaatattttagctaatccctgcatctcaaataacttatatttcaccagtgagagcccaatcctaccatcatgctgatgaacaagcttccgatttcactgacattaacccagttctcacattcattctgctcatgaccaaagcctccagtgtgactttggtgatcatggaagtcctcatggtggccacctctggaccatggcctttctttttcttttttttttttattattatactttaagttctagggtacatgtgcacaacatgctggtttgttacgtatgtatacatgtgccatgttggtttgctgcacccattagctcgtcatttacattaggtatttctcctaatgctatccctcccccatcactctgccccacaacaggtcccggtgtgtgatgttccccgccctgtgtccaagtgttctcattgttcaattcccacctgtgagtgagaacatgcggtgtttggttttctgtccttgcgatagtttgctcagaatgatggtttccagcttcatccgtgtccctacaaaggacatgaactcatccttttttatggctgcatagtattccatggtgtatatgtgtggggcatggcctttcaaatacaccaccaatacttcctgacatgtaagtttcaagcagggcaacttaatggcccttagatttcaagcttgacacacacaatatcatattatccagataaagtatttttaagtaaaatgctgacataagctctagattccaagcaagaggttagtaactctaactggaacgaggagccatggataagtactaatgaatgaggttgtagatatttgtgagaaacaataagtagaaaacattggaatatcatatgtgatagaaatgaccattaagagcatccatatacagaacaaattacactaggaaacaaaacatgaaaggaaatttttatgatttgtttctttgttttgaatcacacttgttgagcactcccttctttaaaaaattaatacaagttcattatataaaatttggaaaatataaaaatgagtaatgaagcaaacaatcacctcaaatcctagctcctgattataaacatagtaaacccttagtgtaaaccctttctgtttacttacatctctacacatttagcttttacaaaacctattttccatagaatgtactatgtttaatttttttctaatcataaaagtaatgcacattgaatttagaaaacagaacagcacagagaaaaaacaaatctccttaatcccttcacttataggaactgtattttatttgtactctgatcctagcagttaacacaatgccatggtaagcagactgctttgtttgcttaataacttctccataataaagaaattgtttgcctgtgctgtgcttagagaacatattctaaaaccaaaattgtaaccatggcttaaaggaaagaaggaagcaaacccatttatattagaaaatgattctaaagcatactccttgaatgccttggctttttattgcaggaattgacctttctcagcaagatatccattgcccaaattgtgtattgcatgccaaggagttaagtcagattactgctgtacctctcacaatctaagttccacatctctatttgtatttcagtgaaaaggattcatggtgcaccaaatcattaaggctctgagatctttgcaactcttaatggcagcccaacagggacagccactgtagggcaaaaatagccataggattagagaagaaagccttgtttgcaatgccattgctgctgtgtacactaccccctgtgatgtggcaagaatggatttagacataaatctaaggctttgtagaataagcaccctcatcaaatagtatttattggggcttatggctgagatactgttttccttagcaaccaaatgcagcaggaaatttgattgagaataggaattttaacacaattacacatattaaccttttacgctatctcttcttaacccaatagttttaaaaccatatacttagtgcttggagtaccaggaacttataaagagagagagggaatctcagtttgacttgattccccagttatgatcaggtgcaattttttccttcacattttctaaaatcaacattggaagtgtgcaatgatcaatgtgatatccaatttcttcttccctttatctgcctacagctaaactaggccaaaccaggaatgagttacaattgaggaaatattttccacttctgatcccgcacaaaaaaaatacatacatgtcgctattattttctgtatttatgacatgctagtgagttctttaaaatgaagctgaaatctgtaaatttctgtgttcaaatgaaacttttttcaatctgtaaatttctgtgttcaaatgaaacatttctgaaatacagtttcagaaagtagtggagattagaaattttggacaatcgagcaaactcttttctctaggaagctgtcctctgaggtgcagcaaaggagccagaaatgggcttgaaagcagagatgtttctaagtggaaggaaggggagctattagctgagagaagactgggtaagggcttgaggagcctagaaagttgaggatgaacctctaaaaaggctaccagtgggagcctctacaatgcaggtgacaaatgatctttgatcgtcttcctggttgtattgtggattgtgtaaagaagataaaatagctaatgcttactttagggaaacacaaaattctacacgaattccccaggcccaaatatataatgtgcaaagatttgggagaaatgcagttatttccccaagtaaatatgaggaagaaaacttaactgcctctctattttagccgtctggctttaattgtgctgtgtatgccaattgtctagaccctgtggtttagaaatccagcactcgggcagtatgatacactcggaagcctgtaagagagctccgatgagctgaaggcataaactgcaaattcctcttgtagctactaaatttaaactggatttaattgtctccactggatatatcttaggtccacaaattggtggatctgtctctatgaaagaaaacaagataacaataaaaaccaaaacaggacagtcctcattcatattccattgcattaagtccaaaagccttgaggttgaaaagatgaaaaagtacttattgttgttaaaatatgagagaatgttgaacaaaggtaagaaataaagaaaagcaattatttattaaaaaataagaaatcagtttaaaattctttgtttcagcctttgattcactagtacattttattaaaatgcacttatatttctctgtagacttgtagctatatgttccatatattctgctgaacttgagagtatgcattgtttttagatttggaatctaccccttctctaaaatgtatctgtattacacttacaggcatattacatttatatatatgtatacacacatatgtactgatcatacataccatgtaccaacaaaaggttaaattatgtggaatattattggtcgcctaaaagtgtaataaattttagaaaacattttcaaatggagttagaggcagagaaaattttctgtgcttatattacatctacttatgctggatatttatccctggccagagcataaatgtatttgaggggaaaggattacttagacatatgttcctgcctccatattgcttgtgtagatagtcttccttggaaggcctacccttcttcctcttggccaatctgaatactggcattcagatcatgactagaaagaaatgttagccatcccttgaagaatatcttttgtcctaccaacctcacaaagtctttcttcattttctgcagtccgcagtgacctctcctttctctgaacttttgtgtcacctaaaatgtatataactcatttgatagctttcataaatggtctttacttttttgttcatatatatcttatctctctatttcatattacatttcagggtagatgtaggtcttatacttctctgtgtcatcattgcacctagctcaatgccttttacataaaagtataatacttataggtgataagtataatcacttaaattattgcttaatttatttttctggtatatttctttggcacataggcaatactcaaatgcttgtttaaacttagtggatagtaggaactcaactatgtttcaaatattgtttaacaaaaatttagccaaatagttctgcattttaaagaagaatatttgatagtgttatagacaaacactttaaagaaatgccattgttgcctttgactgtatctgaaagtattgtttaatattcaagcactacagtaaaagtcttggaataatttccatttttttcctcttaaaattcaaagtagaatggtttttgcctttcatatgaagaaaacagcttaatatgtagttttaaaagtatggtactttttctgtaactaccccacattaagggcttagtttcatttcaaaagacttctttatgttgcttgaaactgtgcttttcaattagtgatgcacattagacatgtgagtgctaaatatttttgccaagcattgtcctgtatttttaacacttgctttttacatagtggccagcattggctgtggattggtttgaataaaaggagcccagatttacaaggatcctggcaatggagtgatcgtacaccagtaagttaaaacgttattgttttaggtagtatggaaacactgtttgtttcaataacaagttgattgttaaataatacattgacacctaaaatttatatggaaccacaaaagaccctgaatagccaaagaaatcttgagcaaaaagaataaagctggaggccatcacactacctgagcttgaagatacacctcaaagctatagtaaccaaaacagcatggtactggcataaaaacagacacttagaccaacggaacagaatagagaggccaaaaatacatccatatatttatagccaactggttttcaacaaagataccaagagcacacaatgagaaaaggacagtctcttctataaatgatagtaggaaaactggatttccacatgcagaaaaatgagattaaacccttatctcataccatatacaaaaatcaactccaaatgaattaaagccctaaatggtaggccccaaactatgaaactactaggagaaaacacagggggaaagctccatgacattggtctggacaatgatttttttggatacgaactcaaaaacacagacaacaaaaaccaaaatagacaaatgggattacatcagactaaaaagcttctgcacaataaaggaaacaatcaacagagtgaagagacaacccacagaataagagaaaatatttgcaaattatcatctgattaaaggttaatatccaaaatacagtcgtacatcacttaacaatgggatacattttgagaaatgcattgttagttaggcagtgtttttgtgcaaacatcatagaacatacttaaacaaacctagatggtacagcctacttcacacataggctacacatctaggctttatattgctcctaggctacaaacctgttgaacatgttactgtactgaatactatagggatttgtaacacaatgataacatagaaaaggtacagtaaagatataatcttgtgggaacacatcttcaagggatggctaacatttctttctagccatgatctgaatgccagtattcacactggccaagaggaggaaggataggccttccaaggaagactatctacacaagcatatggaggcaggaacatacatgtaggccatctgtggttgactgaaaggccattatgcaatgcatgactgtagataaggaactcaaacaactcaatagcaagaaaacaatctgattttaaaatggccaaatgactgaatagacatttctcaaaagaagacatacagatggccaacagtcataggaaaaaatgctcaacatcactaatcatcagggaaatgcacattaaaaccatagtaagttatcacctcccacctctcagaatgattattataaaaaagacaaaagatacatgttggtaaggatgtggagaagagggagcttttgcacactgttggtgggaatgtaaattagtacaaccattattgaaaacactatgaaggtccctcaaaaaattaaaaatagaactaaccacatgaacagcaatcccactactgggcatatattcagaggaagtgaaatgagaatgtttaagatactcggagggtgactgcagcactattcatggtagccaagataggaaatcaacctaagtgtccatcaacagatgaatggatgaagcaagtatggtacatgtacacaatggagtactactcagccataaaagggaaggaaatcctgccgtttgtgacaacatgggtgaccctggaggacattatgttaaatgaaagaagccaggcacagaaagacaaatgccacgtgatatcactgagatgtggaatttaaaaaaaaaaaaaaaggatctcatagagctaaagaatagaatggtggtttccaagagctggggcagatgaggtgggggactggggagatgttggtcaaaggatacaaaatttcatttagataggaagaataagttcaagagatctattgtacaacaagttggttatagttaatattttatattcttgaaaaatgctaaaagtagatgttaagtgttctcaccacagaaataactgtgtgagataatgcatttgttaattagctaaatttagtcagtccacaatgtatatatacttcaaaacatcatgttgtatatgataaatgcatatacttttatctgccaatttaaaaaataaatacattcacgtatcatacaaccattaaaattatgtgtctttattgaaatgaaaatagagtctcatataggcagtaaggaaaagacaagttacaagtcttctttttatttttaaaaacccatatgtatagtctctctatatatagtcaaaaaattgtaaagctataaatatagtagtcatctttgggtagtatgagtgatttttttctttttgaaatggggtcttactctgccacccagggtgaagtgcagtgctgcgatctcaactcactacaaccttcacctcccaggctcaagcgatcttcccacctagcctccccagtagctgagaccacagatgcatgccatcacgcccggctaattttttttttttttttttgagacgtagtctcactctgtcgcccaggctagagtgcagtcgtgcaatctctgctcactgcaagctccgcctcccgggttcacaccattctcctgcctcagcctcctgagtggctgggacttcaggcatgtgccaccacgcccaactaattttttagtagagatggggtttcaccatattggccagggtgatctctaactcctgaccctgtgatccacccgcctcagcctcccaaagtgctgggattacaggtgtgagctaccgtgcccttccacgcccagctaattcttatatttttttgtagagatagggtttcaccatgttgcccaggctggtctcaaactcctgagctcaggcagtctgcccatcttagcctcccaaagtgttggaattacaggtgtgagccacatctggccacaagtgattgttttcaaagctttctctttatactgtttattttcatttttatagtaagaagcttttctttttattatctaaatatggaagagttatacaaaaaataaaatatctttttctggggggactaggtggggatgacagagtctcactgtgtcacccaggctagaatacagtggtgccagtatgactcactgcagcctcaacctcctgggttcaattgatcctcatgtctcagcctctcaagtacaggcacatgccaccacatccagctaatttttgtattttttgtagagatggggtttcaccatgttgcccaggctggtctcgaattcctgggctcaagccatctgccaaccttggcctcccaaagtgctgggattaccagcatgagtcactgtgcctggccaaaagtatccttattggaggaaattatttgtttggagaaacctctagaaaatccttgctattattccacatttatattataaggatatattagtgtaatagttataggagcaaaattattctcagatattcaatatttactccaatttttgtcaccaaaaattggtgactccaatgtcacctccttttttattctttctaaatgtaaaactccttgagtttattttcaaattggagcatatctgagattagttaatcaaataatgagcatttcaacacatgcaaaaaaagaaaaaagtattttgcaaacctgattctctatgactccagcggcgaacttaatacactattaacttccacttctgaaactgtggcttcctttgtttggaaacttatgacattatgacatttgctaagtcctctcatgatttagcatcatgatataaaaaagagatggaaaagttttctttctgtggcatatcaacgcacttgagtgattaaggctgcctaaattacatctaaattgcaaatatttatacatcagtcttaaattctcaagcctctcttgtcttttcaggtgtctactattatcatgccaaatgagtttcagcaggattatgacatcagagactgtgctgctgtcaaggtcagtacaatgctggaaaatctgcatatttaaaacataagtccatcatcatatgcagtcaagtaacagatccatggagtgtctttttatgtgaagcatgatgttagatgcagtgagagataagcacacccatggcctggccctcagcagcctaacttacacttcatttgagaggataaaattcatattcaagaaaacctctctcattaccacgcagtaatatgctccaaatgagggggctgaggaaggctaatgaaattcagaggagaaagtgagtcccatggccatttcccaggaagaggtgggacttgaactgggactttaaggatggatagagtttctacaaatgggatagggtaaggttttttcatgaggggatggtatgagaaagtggtataaaataaggtggaagtggaagagggcagtggagaacagaatacagatcaagaagtttcattggtgctgtccttgataacagtattaggaaatcagattgatgccactttaaggaatttctacacttcttgataggcaacagggcattttttaaagtttctgagtagggagggtcacatgaactaaggagggtatgaggaagattcatcttgagacagatgtcaaaagcaacaggtaagattggaaggcatagaagaccagtgaggcatcttcctttgcagaatgcattcatgtatccatttcataaacagtccaaggagtcagtgaggcactgggtgatagaacaatgacaaggtacaaagcatagccattgtcttcacaaaactaaagtctagtaggaaataaagacaagtaaacaagcaattacgacaccactgagtaaagactatgacatgcgaaatacaagttttatgcaagaacaagaattttacgaaagaataataaggatggtgatggtgatggtccatggtggtggtgatgatgatgatggagcagctaacactgattaactcctttatgagccagccactatactaggcatgtcacatatgtcacatagcacataagcaatcttgtgaggtaggcactgttactgtattcatctcacatggaaatttgagctgtgagtaatttaccccagcttacatggagtaaatttaaactgaaagaactgaaatttacacccatgtgtgtctgggtctggtactcttaaccactatgctatatgactaggcatttatagaaatagaaagggtattgatttatgagaaaattgtatgttttagttcagatattttgaatccaagctagctataagatgtatgctatggtaagttgagatcaagagtcttgagttgaaaggaaaatgtatatttttaaaaaaagggccaagaagtggatttggaggaactgccaatatatagagtgaaaaaagatgaagatggaggagacatcagttaatatctttgatttgtagtccaagaaagagattcaacaaggtggctgaccagaaatgttacaggaaggctgagggatataagaactgacaaaaccacaggaaagcactgttttcaaagtaactcttctagtaataaactgtgtagtacatgtcatttttatagaattcccaatgtaacacaggaaaaggtgaaaacttcagagaagcttatggaatttttagtagtgttgagaacactggtacaataaactgtgttctagggaaatagagttgccaagtatggagagatttgaaaatctaccaaataaataaagagatactaatgcaacctgcatcaggaacaagcccagccagggcagtgttctgtaaggaaaatcttacctcacctgccacagaacccccagaaacttggtcttaagagaaaatagtctaagaagtgatggatgtctctcccaagtaatgccttcccctatcctttttatcctacttgctgactggaatttgtaatgagccatcctggaccatgtggagaagggcaaaatcctagaaatggcatggtaacaccagagaaggagcctgagccgctgaggctggacctttatgtcgctttctgatctaatttgatcacagcttggtgcttggatacctctgaaataaatattctaacaaaaattgtcaggtgtgggggagaaaatttgcattttggacataaacatgactttacaacatatttcctttgttagcccctttgagggctcttgctcagggtattactgtttaaatattccattaattcatgtgttcatttatcgaacaaatatcttaggtgctagagctaaaatagagatcaaagtcatagggcttacagtttagtgttccataagggatgtatcaacttcaaaatattctgcaatacttttcctcttataggtatttcataggccatggcgaagaggctggcatttctatgatgatagagaatttatttatttgaggccttttgcttgtgatacaaaacttgaatgggtgtgccaaattccaaaaggtaagtggtagttattccttttcacaaccttctcatgttaacattgtgaatgcctagctcaaagtagctaggggagcattttgatctataattctgatgtctaaaagcctatgatgatgatgcaattaatatgtggagcaccccctgcctgactccggcttctaatagaaggctagcttattgaaatttagtgatatcttactctttgatcatggaagaatttgcatagaagataaaatgtgaggctcattcagggaaattagattttggatgaaatattattttaagcaaaaggagaaatgcagaatcattttcgtttttattttgatgcaaaatgaaaaaataaagataatcttgggaagaataaggcagaagtcaagaaataaaaatttggcaggtccctgtaaaatttagaagcaattttcaatgaactataaaactgctaatactttatataaattcaaatttgagaagccagttagattgatagtatagcctttgataacagaagggagagtggggagaaatgtagataccattttactttactttttccagcaaaacatgaaatattaagaaaaatgttaagactttaattctcaaattattattattattttttaagacagtcttgctcagtcttccaggctggagtgcagtagcacaatcttggctcactgcagcctctgcctcccaggttcaagtgattctcctgcctcagccactggcgtagctgggactacaggcacccactaccacacctagccaatttttgtattttcagtagagtcagggtttcaccatgttggccaagctggtctcgaactcctgacctcaggtgattggcccgcctcagcctcccaaagtgctagaattacaggcatgagccactgcacccagcctcaaattatttttaagcagagattggctgtatgaaattaattagcagaaaacccatagaaggtttttaaagaaatctctgaactgaatgtaaacagatcattgaaactaaaggtatatcctcctacaagttctcaaagaacccaaagttcacatcatggaactgcctattagaagattgttattcctaaaatagttaaaagagcttcagatgtgacatcaggtagtagcgaatctctttcacaaaggcaaactgtcaaaccagttgtaagggaaagacagttgtgttgatgggtttttctaaaggataaattatgcctaagttattcttgattattttattaaacccaaaaaagggacaaaggaaaaccagtttggatatcctttaaacaagtggaaaagtaacttgtatataattaattcggacaatgtctctgttttgaagtgttaatgtgagcctcccattactctctggcatttgttagcattccacagacagtgtcattgttccaaccaaagtgccctctatgggagctgctgcccccacctcctgtttgagcagtggagcagaccccagagtttaaacaagggcaaccttagaaatggcaaattagccaccacaggaaatagtatgaagggcatgtggaggtgtatatatattttttttaatatatattttttaacaagagagaaaggaattaacccacttaaaaatataaatcaattaatcgaacaaatctaaataattccacctccattatccccatgcagaaataaaataaaaaactaaactcctgttctcagcctgtcccaatcacttgaagaaatcaatgattgcttgctccagggtttaaatgttatgttcacccttttttgaccgtactgtacctaactttctaagttacgatgtgatgcattcagctggttggatattttcttggttattagagcagcctaagtttactcaacttgtattcatctgtattttctggttttcttaaagaagttttcctcttatgtattctaaatcaccatgcctcttctctggctcttgcctttttattacttggttctaattaatcctctcttccctaaaagagatattttgacaacctgtaaatttgaagttacctcaaccacagtggatatttgtactttttaaatattattttttgagaaaactgtgtcaaaaataaggctcataaaagtgtttttaggaaaattacctatgatgccattacccagacatagcaatttttattgtatttcttgataccttgtacacacatacatgtttgcaatcttgtataaaaaacaccttgcatcctacttttctcactaatttaaagatatttaaaggttagccatagctttccctcccccacacacaaataatcagaagtctttgacaagattacagacaagaaactatgtacattttgaactgacttgcaacattattgttggaaattatccaatacgaatagaactggctcagagagagactaaagatgctggctattcaggcagtcctctgagtcaggtcttctgatgcctgcctgaggctcacatgccacaccaaaattaagaccagctattttactctgtaatttctaagattaagcaaatgatgtctttgacttgaagccagtgtgatctgtggccagaatgaaaagggggaggaacgcaaataggctcccatggggaacttccctgtgcctggtcctgtgctggccacttcctccagggcatcacacgtgaccttcactctctgtgagtcaggtagccatctagttttcatagaggagaaaatcaaggctcagagagggttaagccactcatccgaaataccacggcagcaaaatgcataagggcatttgcacactgacccgcccagcttccaacccagaattctgtgtagcatgccattatttactccgtttccatctgggaatcctgagtcacttttaattattttcctctcagttttgtctcatcttctcaaaaggttcaacactggagcattgtacattgtttccaaggatatcttggaagacaatgaactctatcaacctaagtttacagaacagttaacctgtttcattagatgcagaagtggttcctgaataacttcccttttcaatgaccgttattttggttcctacttcttatgcttctgtgtaacacatacaatatcattatttacttgtttttactttctaattcttagctatattttatctgtcttacttcttttgtgacctctgtgacacaaggtaaaagactgctagaaatacttcattaatatttaacgtatctgccttttggatttctcctgaagcaggtttagcatcggccctacaaaatacaactaaagtgatcaaaacgtgaagtgggttggccagaaatggacaagcctcaacaatactgcaagtcctttcgagctacattaaaggccgtacttatagtataccctgatctgtcatggaatactaatgccacttgctttcttcctcatacaggccgtactccaaaaacaccagactggtacaatccaggtgagttaagaaaactgaaatttaaccaaagctgcttttaccttgtcactaatgcatttagttaattatttaagtgccagcttcttctctatacatcttcaagtgagacaaaatttctccaggcaaggaaggtgagcgactggtatgggatgaggtgatgagggtggctttttccttccctgtgagtgtaggggagtggcagagtcactggctcaggaatctcttgttccttgtagtcagtactgccccagccagagagggccggtaatctgaattactatttatagttttgaacattaactcatgcttagaggacacagtttgctttgcatagtcataattctaatctttttcttcttcttctttagagcgtgctggaattcatggacctccacttataattgaaggaagtgaatattggtttgttgctgatcttcacctaaactatgaagaagccgtcctgtactgtgccagcaatcacagctttcttgcaactataacatcttttgtgggactaaaagccatcaaaaacaaaatagcaaatgtaatttaaaagaatatattttaaatatatttcttatttttgtatttattccatttaaaaatattacaaaaattttgccaaaatctacaaaagttaaatttttctttaatgtaaaatctgcctcacagcatccaaatttgtttcatgttagaaaaattaagtagaattgcttatgttttaaaatatacaagattaataataaatgtcactttataaggtaaacatcagtagataatatagatcattctaatttcctgtcacattttttactaaaagtcaactttatagttaacttgagtttctgtttctactaataagtaactttgcaaaataatttttgggaagaaaaataatttctgtatttttaaatttataatcaattgcaataggatactgtatgcccacttaaagtattagtctaattaatatatgcccataattacagctaccatatttcctgtacccacaataggatctgtaaatatactgagaaatttcaactactctttggcaaaaggttctagtttgtataattttgaaatctaagtaaggaatgtctggaaattttagtggttagtgattatagtaagacaatgtattcgaatcaaaaccctcaagaaagctcagcacatataaggatggatgtttggcttgtttttcagatatctggtgatggacagaagtggtggataagaattagcgagtggccaatagatgatcattttacatagtaggtgacatcattgattctacctttgtaaagttatcacttaaaagaagcagttccttttactaaatggatttctatttataagtagtttgaatattaatccataaactgcctaaattagagaaaccaagcccttttgcatgttagcatcaagaaaaaaggggtatagagtaatggtattaacattaaatttagaaataaaataacttacagtaaaaagaaaaaaatggaacacctaattacattacgagttgtcaaatctgtcattttcttttagctcacgatatccatggcaccgctttcctgtgacatttggagaggaatgcttgtacatgtctgccaagacttggcttatcggtaaagttaattctaaatcctttaatgctgattatgtaatatgtgaagttcaggttcagtttctagcttaatcttgttttccttttaattatatgtttggtaatttcatcttattctgatttattattagcaacaatagctcaaattcccaatgcaaataaaggtacttttcactgtgaatattttaacttcctttatcctaaagcagttacttagtaataaacttaccactttcctaactgataagtgtctaagcaaattttcaaagataagcaggcagcagttctaaaatatagtttaagtcccctccccctgattacattgccccttcaactctcttcctacctcctgccttcaccctgggatggtatggtagtcacacaaaatgtgtgctgtttcatagacagtattggtatgctgtaacctactgataaaaataatcatagaagacagaaatggctagagaagaaagggaatatattttaagcatttaggaaagattgatttcaagagcctttctttactactgggttgcttttaaaatgtgctgacttggccgggcacggtggctcatgcctgtaatcccagcactttgggaggctgaggcaggcaaatcacttgaggcaaggagttcgagaccagcctggccaacgtggtgaatccctgtctctactaaaaatacaaaaattagccaggtgtggcagcatgcacctgcaatcccagcttcttgggaggctgaagtatgagaatcacttgaatctgggaggtggaggatgcagtaagccaacattgcaccactgcactccagccccgggcaacagagcgagactctgtctcaaaaaaaaaaaaacaaaaaaaaacacacaaaacaaaataaaaatgtactgactgaaaaattctcaccatagtaatcctggcttttcatttctcagacttaggtaaaccaacagactgtagtaccaagttgcccttcatctgtgaaaaatataatgtttcttcgttagagaaatacagcccagattctgcagctaaagtgcaatgttctgagcaatggattccttttcagaataaggtaaaaagagaattgctacattatgcaacaatgattgcttccatgctggttttatagcctatggcagaatggcaacccattagtgacaacatcactgaaatagactctgcatgtttcaggatcccacctggccctctgtgttgccagaaaccgtggatgatatcaagaattaactctcaagttggtcatgcctacaggtcttttaaagtgcagcatttctattttgttgctactaacacttaaattgcttaagttgatctgttgagggattgggatgcattgaatagtcaggactgtctctatggccttataggaaactgacttaatttctggcttgtgttttctttttcccctcaaggagagcatccaagcagcatctgccaatcaaattagaccagcatttcacaaactactttttggggactacacacatgctacaaaatgttaatcattgatcttgcctccaaatgggggttttatgattaaataggtttgagaaatgctgcattctgtatctgcctctttgagatgcataatccatgttggtatatgtatgtattaggaaatgcatttggcttctgaaaagaggttgctacagtatgagaaaagatttattctgtcacattaaagacatttgaagataagcaggtttgtgtggaaacaccatgaagtcttcaaaatcaggcttcttttggttttgctctgccatccttaatataaggcttccgagcttaaattcagggtgttctctctagggtcttttctagaagttacccgatgagtttgtccacattgggtagcttggctcattggccactccagtctataagaaagctgaaaaaaaaattttttttgtaagatatttcaaggaacacaatttgggacataccactctacactaaagtgatcataatgtgaaaaagggaaaaaagagatgtgtctgacagctgaaagcatctgtagtaaagctaggggtacattttaactttttaaaattaggacaatctttttaattcctcaaggtaatagtactgtgttaatttgcatagctgatataaatttgaattaaaatatcctgccaagaaagagatgaatttttcaacagtgtttcttgacataaggagatgatgattaaggacacagattttgaaattaggtggaacagagtacagatactgaccttactattgtgtggctatttcacttatggatgaagttatttaatgtccctgtgcctcagtttctgtctccattgtgagaattaaatgagataatactacacaaactgcttaacacataggaagcactcaataaatgagagatctttaaatatataaagatataatataaaatatatattaaagatataatatacaatatatatcttatatataagatataatatatatatatatatatatatatatgaaagtttgaagaccgctcttcagttgtttcaattgagaaggtagcttgagcctggaagctcaaggttacagtgagctatgattgcaccactgcactccggcctgtgcaacagagagagactctgtctcttaaaaaattaaataattaatgagagcataaacttgaattcttatggtactacattgcaaattaccatatctcacagaccgaaaattagcagccctctaaaagatgaagcattttacttcctatgtgagcgttcctgtgtctggaatctcatgcttcacatatgtctttgtttgcagtgttttctaaagatcaaacccgtgtctctcacattttctcaagcaagcgatacctgtcactcctatggtggcacccttccttcagtgttgagccagattgaacaaggtactggaattatttgggaaacatgttttattctgatctggggccaggttagttttaggaggctatggggaattaacatacaaaaattcttattaaacttcttttgttatggaacagataaaagactatgttgatagataaacaaaatatattcattgacatttttaatgtatctttaatttgaataaatcaaatgctttttaaaaatctctttctaacagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatgtaagtttttttaaaaaccaatactcttcatacctctgtgaaatacttgagtctttcatacatttttggactaagcaaaaccccactgtattattccatttgtatgaaatgtccagaataggcacatctaagatagtaagtaggttagtgattgctagaggctacgggggatggaaggattgagaatagtgcctaaagagtatggagtttcttttggggatggcgaaaatgttctaagatttatggggtgatggttgtgtaactctgtgaatatactaaaaactattgaatatgtactttaaatgagcgaattgtctcatatatgaattatagctcagtaaagctgttgcaagaacaacaggtgcctccccagccttctgatggatgtactggtttttcacagtagcatcagattccatagcacttatttcataaccatataaaaccatcatgtagtgagttgtaaatagaagcaaatacagatgttttgctttacattttgggactttgggctctcagcctcagtctcctgaggcaaaaagtacaaaattggtaactggtgatcatttttccccaagagctaaatatagggaagtcagagaagggaagagggcattatactgacagtagttatgctgacaccacagtattaccgcccactgcttctgttctctatactttctggatgcagattaccttttgcacaaagggcaaagattgagaaattaacataaaagtctaattccaaaagtatgtcttagacagtaatcaactgatattcctgacataatgttactttgctcaaagttgatgttggtagcaaaggaagttctcaatcgtgagtaactatgtacaatataaatatcaaattattacttggttattatagaagatgtggaagttagagtaaacgcagcaatgaaaaatgtcaaccctaatcttaagacagtttaaacttttaagcataatctatagtaagaaatacatttaaatcaccatctagtacatagatatagatataatattaattgaaacaaaagtttcaagaaacaatacttacccttataatttatgcactctgatatgttcgttctcttctattttgttccattctcctgtcttatcctatcctttactgtccaatcctactatctcctattctgttctatttcattatcacaaatacttgccaaaatccacttaagtgatttcatgatatacgaaatgagtctcaaccatatttgagccctagactagggaattacaatgagtacttgagcatcttttcttctagggcttttccatacactgttttcttgatataagtgagatcatagtatatatactattactctgcttttctcagtttgtattatatcataagtagtttcttcagccattaaaagatctacttgataagctttttaatggttgctggggaacaggtggtgtttggttacacgagtaaagtctttaatggtgatttgtgagattttggtgcacccatcacctgagcagtatacactgcactcaatttgtagtattttatccctcacccccttcccatcctttcctcctaagtcccccaaagttcattgtgtcattcttatgcctttgcatcctcatagcttagctcccacttattagtgagaacataacgatgtttggttttccattactgagttacttcacttagaataatagtctccaatctcatccaggttgctgtgaatgccattaattcattcctttttatggctgagtagtattcctccatcatatatatatacatacatacatatatatacatatacacacacacacacaccatatataaatacacaccatatatataccgtatatatggtgtgtgtatgtgtgtgtgtatatatatatatatatatatatatacacaccataatttctttatccattcattgactgatgggcatttgggttggttccacatttttataattgcgaattggattgcacaatatttcttgattgatatgccatcatttacctaaccagtgctgggtgttaggttgtttccagttttacacaatcataaatagtgctgcaatgaacacctttgtgtataatcttagcctatatttcacattacctgcagagagattttggaagtcatgtagccagatcaaaggatataggtaatataaagctctgattaccaacttgcttccagaaaggtttatgaatttacattcctattcacagcatattgtgattgtccttctatcctcaccagcatattattaatttccaacatatatcaagcagttaagatgtgccaggcactctgctaatgtatcacatacattatttcatttaatttgcccaatagctatgaaataaagatgttacccctgccccaccttagaaaagtgaagatggagtcagtaacttgccagagatcatgcagcctatgcatgcagagtcacggttgacatctggttctgggtgggcatggtggctcacgcctgtaatcccagagactctggaggctgagagggggaggcctgcttaagccctggggttcaagtctgtagtgagccatgattgcaacactgccctcccatgtgggcaacagagcaagaccctgtctctaaaaaaaattgttttaattaaaaaatgagaaaaaaggctgggcgtggtggctcatgcctgtaatcctagcactttaggaggccaaggtgggcggattgcctgagctcaggagttcgagaccagcctgggcaacacagtgaaaccccatctctactaagaagtacaaaaaattaaccgggcatggcagtgtgggcctgtactcccagctattcaggaggctgaggcaggagaatggcttgaacctgggaggcggaagttgcagtgagctgagatcgtgtcattgcactccagcctgggcgacagagcgagattccatctccaaaaataatataaaataaaagagagagaaaataaaattgcctttaaagagcacttggtttttaaaattcttcttaatttggtagtttgatatcgtattttcattgatctttctctgatttctaatgaaaacaaacttcaataagttaaataatcattcatagttcatcaagtgggagtgttctttttctttgcaaatttatctatcaaacccttcatgtatttcttattgattttatgactttggaaatatcaaatatgctgatcctgtatttcttgtgtttattgcaaatactttcctaagttttctttaagtctgaatgccaaaaatattacagaaataaattttgactattttttaatatgttcaaatctgtatatttcctttttatttttcctctgttgcttttaggttagaaagtccatcatgtaaattgtaaatattagttaaatatatgtccatattttcttctagttttgtttcataggttgcctttttttgttgttttttctgacacagggtcttactctgtcacccaggctggagtgtggtggtgcattcataacttactataacctgacctcaagcaatccgcctgcctgagccttccaagtagctaggactgcaggagcgcaccaccatgcgcagctacattttctaatttttttgtagagacagggtctcattgtgttgcccaggctggtctggaacccctggcttcaagtgatcctcccacatggtccttccaaagtgctgggattacaagcaggagtcaccacacccagcctctgttttttgtgtgttttttttttcccctttctgatagcatgttacatccatggtatatgatacatgttgtcagtgcatgcttaattattttccctaatcctagccacttgttctagcatcatttattacatatactttcatttgttaaaaacaatataggcctgggctagcactttgggaggctgaggcaggaggatcacttgagcccaggaatttgagaccagagaccagcctgggcaacacagcaaaaccctgtctatgtttaaaaaaaaaagagagagaaaacaatatagcaatataggatgcctcttttatcatatattaggactgtgtgtgtatgcatatatatgtgtatgtgtatatatatatactgtattttataatatttatatcagtatggtagctatttaaaaatatttctcatatacataatgtgtgtatgtgtgtatataacatacaaatacagtcagcccttcatatccatgggttctgaatctggattnnnnnnnnnnnnnnnnnnnnnnnnnnnnnnnnnnnnnnnnnnnnnnnnnnnnnnnnnnnnnnnnatcagaggatcccccctataatagctaatacaatgtaaatgctatgtaaatagttgttatactgtattttttagggaataatgacaaaaaagtctacatgttcagtacagacaaaaaaaattttttctcaaatattttccatctgcagttggttgaatccagattcagaacccacggatatgaagggctgactgtattgatatgttatatacacacatacacatattatatatatgagaaatatttttaaatagctaccatactgatctaaatattataattttaccatatttttaaaaactataataggattaattatactttattacatgcccttaaaacatacttttagatattcttgtccatttttccaggaaaactttagaattattagtcatttttcatccaaatagttaaaattttaaaactcttgatgagaatttgactacatgtttgggagaattgacatctttctattaatcttccaattcatgaatttgatatatctatttattcaactcttcctttagatcactctgtgaagttttatagttccatctctttctcattgtcattaacaatggcaactttagctataaaaagaatggaatcatgtcctttggagcaacatggatggagctggaggccataatcctaagcaaattaacacaggaacccaaaaccaaatactgcatgttctaacgtacaagtggaggttaaacactgagcacaggggagagggagggagggggacctgggttgaaaaactacctcctgggtactgtgctcactacctgggtccaacacacccatttaacaatcctacacatgtgcccccatatctaaaataaaagctgaaatttaaaaaaaaaaaaaaagaatgacagctttaaaaaatttttcttactgatttgtggggaagctattgtttgaatttgttatgggttttttttttccccataggcatctgtctcactaaacgctctttctctctgagtttttcattggattttcttgggtttcctaagtagctaataataatatacaagcaacagtgaccctcgttcctatagttacctctctcgttttcatttcatgcctcaccacatatgctagaatttccagaatttccatggcaaataccaggagcagtagtagccaccattgtagacttgatctggacctcaacaggttgttaaacattatgttgactcttggtttaagatatagcattctataactagcttgtttagaacttttaatcaggaataagtactgggttttctaaaacttgttcccagcatctgttaagattgccatatagttttttttttttttttttaccattaggcctatttgtacgtggtatatattagtagatattgtattaaaccattttacattcttgttgtaaaatctgggtgctcagagtggattaatattttactattctgcattatatttgttagaattttacttgggaatgtgttcctctctcttcatagagtcaatttcttatgctatattgtcatatttttttctgatcatgttagcctcataaaatgactgggtagctttccatcttttctgtgttctgaaattctgactcagcttggggaattctctttccctgaaagtttgggggaactacctacaaaatgttagaacccttatccaggagcatttttgctttttaaaaaattttaattattccttatttataattgactcataataattgtaccaatttatcaggtgcagtgtgatgtttcaatgcatgcatgtgttgtataaacaatctgatcagggtaattaccatattcctcactttaaacatttatcttttctttgtaaagataacattcaaaaccttctcttctatgtgtcttgaaatatacactacattgttctttgcagagatcatactctaatgataaaggaatttggtgcagcagtgaagggcccaagctctggagtcagattgcctaggtttgaattccagttcagccatttactatgcctttggaggtttacttaacttttcttaagcctcaatttcttatctgcaagctctaattctgttgcattaccttataaggtcaatataaggattatataagataatttatttaaagctttatcaatagtacctgacagacagtaaaaaaaaaaaatggccattattaattttccatttccttcaaagtgattgttacattttggtatttccatttttccttatgacaattatgctaattggcatttttcaagaaagttgtctatttaatttagattttcaaatgtattgaagtaaagttgcttatggtatttaaaaaatctccattatctttgctaacatttttagtttgcattatttacatttttacaaaaacagatgcatgttattggttttgtccactctcttctccaccctctactcctattgcttgacctgtgttataaatactatttctacctttttctaccccatttttcgtggggttctgtttttgttcattttccaatctcctatattgaattcagttcatatttcctttaaaaaaaagagaatatatttaataatacacatttggctccacataaagttttactcataccaatttttttgacatttctcattttattctttcctataattattttagttcatttttggtttactatttattgagtagcatttttttttgtcagtatctcctggtataaacttacttttcttatttttctaagtgtgatatgtttcaaacatacagaaaatgatagggataatatacttggaataaattttcatatctaatattattgattgtgattagaaaatgaaatctagatacttctgttttaatatatggagatttttatagtgactagtataggatcagagctttaaggtatattctgttatgtggtacacaacttgttacaaaaagtctataaaaatctaataagttgaattaataatcattatgttttgcttatactgtagtcgagtgttaaatattgctggaggtgttttatcttatttctaatagtttatctctttaaaaatatgtttatcaagattgccactattttgttttttataaagttaattgccctttatccatgctttgaaagtttttaaagattttctaggaaatgtcatggtcaggtccttcatggaattcttttatagggggacaaattcaatctagaatctaaacttttcttgctaggagcttcagaccattgttacatgattgcatgtatgtatttgcctttttgtttagttttttgaggaagagtctcgctaccactgtgccctaatactcaacctccaaaaatcaccgtttactgggacgtggaattttacatcctgcagtgaacgccactttgtgtctctctgtcagaaatattcaggtaacaattattatctagataactatggtactttatgctattacatatatatatatagagagagagagagtcactttctatagggagggaggggaacataggttgaaaaattacctattgggtagtatgcttaccacctgggtccaatacaccatgtaacaatcctacacatgtaccccctgtatctaaaataaaagccgaaaaaattttttaatactataaaagaatttatattaatttataatcatatggcttaaaatttcagcatggctaaatccatattgggttagtgagtcagagtttatcaaatggaatgtgatttttttaaaggatcattgccataattaattaaattaattaattgtatctgatggaatttgttaatagtagttatcccattatagtaattgaattttgttcttttttctactctggcatttttcagattttacattttattatgggaaaaggagaaaaaaacttcatatttttaattgagtgcagtattgagtattaagtccactaatagtattcactgttaaatttagcattaacaaataaacaagtgggggtttgaaacattataaacagatcactgtctatgcctttccataatccaaataaaagtagaatgcatacttaaaagtaggcatcatccatattttgaaaaatatatttttaaaaaagtattacattatttttcattgatcacaatgtgtttttaacaaatgatcaagaaaaaattttgtcatataatgagaactgtaagtagatatctcatgtgctttggcagaatttttttttgctaaattaatctttacccattttttccatgtttttaactaactcctttattagcgaagtactataaagcaataattcaaatacctcctcttgtggatggtttcttacatttcttcatgctagctctcccaggtgaaaactttgtaaggggatacttaatacatttatttccttcaaacaaaagaggtatttagcaccgacatgacatgataatgcaggttacatttatttgcagatattctcttcataaatcagaaaaatgaaacagaatgttgttctgattttagaaaacaaatgttgcagctcacacattttacttaaggtatacagcaagacatacctaattctctcacccaaaatctaaaataaataggcaaataatatctaaattagattagtatggggagaaatgtgaaaaaaatgtcccataacttgcagagtgtggggaagggtttgttgttgttgttgttttcttttacatgcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgtaagtgttcagtcccaactgccaggactgggtgatggaaagcgacattttttattgtgcatagcttctctcacagcagactaaaacaaacagaagaactgaaaatcttactccagtaaatttcatggaatatgtcggggtttttaaattttgttttgagacaaaggctcacactgtcacccaggctggagtacagtggtgtgatcacacttcactgcagccttgacctcccgggctcaagcgatcctcccacctcagcctcttgagtatctgggactgcagttacacaccaccatacctggctaatttttgtattttttgtaaagatgaggttttgccatattgcccaagctggtctcaaatgcctagactcaagcactctgcccaccttggcctcccaaaggtgctgggattaccagcatgagccatggcacctagcagcaatatgtggtttttagaggcaattatctttccactattgaaagatctagtacttcattgtttaaatgaggaaaaggttctggtggagatatatatatatttgagcacttctttttatttattctaatcaaagacgagctagaatctggagctgccatatctcttcagccaatgaaaagataagggaagaatttaaaaatcagttgtgtggaagcactatggatagtgttaaagagtcctttccatccctttctcttttttctttttcttttttttttttttgagacaggttcttgttctgtcacccaggctggagtacagtggtgcaatctcggctcactgcaacctccacctccaaggttcaagtgattctcatgcttcagcctcctcagtagctgggattacaggcatgcgccaacacgcccagctaatttttgtatttgtaatagagatggggtttcaccatgttggcaaggctggtcttgaactctttacctcaagtgatccgcccgccccaggctcccaaagtgttgggattagaggtgtgagccaccacaaccagcttccatccctttcaacatcagcagcatggctgggcaccgtggtgcacacctgtagtcccatttactctggaggcaagaggataacttgagcccaggagttcaaatccagcctggactacatagcaaaaccccagtctctagtttaagaagaaaaaattcagcaaagtaaaattaagcaactctgaaaaggaggttgaatagtgttttcctccatctcaagtgctgatcctagatagatgtctcaagcacttctcattcatttcagagcccaacaaagaatgctagtctcctactaattcgcatcactaacctctgcacatgtagcacaaaccggaatcattacacagctgaagttttggctataattaaataagggatttttaaataaagctgtggtattcctattggcattataggccacctcttttctcagccatggtatatcccaaagtataccaggatgggtctagggatgcatggaaaaaatgcgattgaagactcagaattgaactgaagaatggatggaaaaacaagaattgttatcaaaagctcaattaaaagtagcatttaggaatagcttaaagaatagtctctctgagccacagggtattctaaagttaacccagatcggccgggcatggtggctcatgcctgtaatcccagcactttgggaggccaaagtgggtggatcacttgaggtcaggagtttgggaccagcctggccaacatggtgaaaccctgtctctactaaaaatacaaaaattagctgggtatcatggcgggcgtctgtaatcccagctactcagaaggctgaggcaccagaatcacttgaacctgggaggtggaggttgcagtgagccgagattataccactgcattccagcctgggcgacagagtgagactccatctctaaataaaaaaattaattaattaattaaattaaattaacccagagcaagccaggagatggggaagctgcttactcagtcctcacagtctcaattgttttatagcattgcatttacttgctttatcttcagcattggaaattctgtgaaacgctttgttgtgtctgttgtgaggaaacaataggtgattacatttcctagtttcagtcaccctaaatcttttgagacaaaaacagtattgcaatgtagaaaatttgtcagtaattaaaagaacaaaattaaagtcacctgtaatgccagtacctaaaaataaacatgattcaatcaatattttggtatggatctttcaagttatttttctatgtgtacctatttattttttagacagttggaatcagactattttgtaactcccctccccacttaatgatttgggtcttacttcttatcctattttcaacctttacctatggttctcttttccctttcacccttaattttaacatattctgtgtagctgtttaactatatatcctaatagctgccttaattctttgaaaatgacaggatgttaataaatactttacattgaaagcaatgagaagatattgaaagattttaaacagagtagtggcaatataagactttacttaagtagacgacactgtgtggaaggccggggaggacgcaagcagctggagagagggagagcagttatttttctataaattcatgcaggaaatgctgttggcgtttacagtgtctgaggagaggcagctctgggttatgtgaagtgcagagtgtggccatgcagtgggtcactcaagtacccagcttgaagaaataaaaatacatagaattaaaggaagtcaagaaggcttggaaacatgaacacaggcatcccaagttaatggtaggaccgggaggacagcaagaattgggacatcttagtgaatgtcagggaggagcaaggcgaccaagtcctctgtgaatgtcatggggagtttgcagtgatacaaggggaataatcctgaaaggaaataaaaggagataaaaatatccactactcctttctcatagtcctgtggtatctgagaatagaatatcaaatagtcttcccctgtgggtgctgaaaggagattattcccttggaaaagccagatttatgtatttatttaagattcagggggtacacgtgcaggattgttacaatacatacactgtgggatgctgaggcttgggcttcagttgaacctgtcacccaaatagtgaacacagtacccaataggtagtgtttcaacccttgctccactccctccccacttttggagtccccagacaatatcatgcccatctttacatccatgtgtacccaatatttagctcccacttatataagtgagaacatgtggtatttggtcttctgttcctgcattaatttacttaggataatgtcctccagctacatccatgttgctgtaaaggagatgatttcgttcttttttatggctgcacagtatgccatcatgtatatgtgctacatcttcttgatccaatccactgctgatggacatctagattgattccctgtctttgctgttgtgaatagtgctacaataaacatatgagcgcaggtgtattttggtagaacgatttgttttcctctgggtatatacccagtaatgggattgctgggttgaatggtaattctatttttgttttttgggaaatctccaaactactttccgcaggggctgaactaatttataatcccaccaacaatgtgtgagcattccctggaaaagccagagttaaattaagatcaattaagatcaagaatttagtgaaaagatatttatagtcttcatactttgtattcagtaaaaagataaaaggtgtgggatgatttatttagatggaatggaaattccaaaggatcagggacagggttaggtggggagtgcagcaaaggggaagaaatgcagggcagtctgaatgagtgcaggcaaagtcgcatggccgaagggccacactggaggccacagtggcttaggccctaactgggttaggttaggggctaggattacagctggaactctggtcatgaacatttcagaatgaagcagcgagtggtgttgaggcttgactgtgttgctgtttatggtttactaaggagactgtgtcgcttcgttccatatttcaaataaactagtgatgcagattgtcttgggactcaggaaagcttagctcagtgggtctgttaggccagcaccaggcccaccagtgggtatgtaaggtctctggcagcaccatggggaagctcagacaggcctgtaccccacaatccatctcctgtacctagatgggtggtcaggaccttggcagggtgtaaaggcagacgttcacagacctctagcacacaacagaatctagtgaatgaagaagcttctctccccaacaagtgtgaaaacagtgatgtgagagccacagcgcctgaagagttcagaggaagggaaccaccagctctctgtgtgccagctagcccctgggttgcgggctttacacatgttatcccattaattccagccccacgaagttaagtgtcacacttaacttggtaggggatggaaatttggagagatggcacatgaaagctagtaagtgactgaatcaggattcaaaaccatgtaggtttagctccgtagcccatattctttccactatgccaggtggtctctgatctaatcagtacttatagtgatcctcaccccattttagctttctgatttctgataaccagtggatccaattatgtgtgaggcagcgtagcataatggttaggacatagactctggggatcgacagcctggcagaaaggcccagcactgtggtttgtattctgtgggactttgcacaagttacatacctttagtttcctcatctttaaaatggagataataatagtacctctcctatatggttgttacaaggattaagtaagccaatatttgtaaagcatttagaacaatgcttgttatgtagtaaatggtatgtaaatgtgtattaaatattaaaaaaattaaaaatcattagattgaccatgggagtcaaaataatacaaagggttaacatcaatattgccacctgaaatgtacttctgctccttacaggatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaagtatgtgaatttcagatcttttaattcttaaattattaacagtcccataagtggtagaatttctgaggagtggttttataaaatctggttttggaattgtgaagaaattatagtcatgtctttttatggcaacatttgttgtgaaaatttgtattcaagtagaattatatattacatatattattattaatgggtcattttaggcatgttttatttttatgtcagctgacaatggggattaacacttaaaatcccattgttactctacctctttctgcatatatttatagttgtagaaagcttacatttgtgagaattcttttgtgattcataatatcacaactaacaggacttttatgagtcttaagattcacagcaaccacctcaagctagcttaagacaaggggaaatttaggatccccaaaacggggatagagctgaacctataactggagatgagttgacaatttctaaatttcactttgtaaatccctagagaacatctcatgaacttagcctgagtcaggtgtgcagtctctagcccagtcagaggaaagtgtttttacaactggcaaggtcacatttgtgggtctgtggtagaaagaagacactgcttcatggacaaagggacttattgtgatccaggagagatactgagtgatctctgccacatattaaatcagtttaatgtatttgagtggaatatgtttatatttgtatctttgtgaatgtatggccttttcataaaatggaaaaagatcataatcagatactgtagatgtcagattttaaatattatttttgtttgacttggttaaagcaataacttatttagaacatcaatgtttcatttaaatgttcctttaaaattaatagtatcagtagacagaaactttaaaataaattctcagagttatagttaggtgacttttaataatgaatatgtttgtacagcatctctaggggtggtcccttgtacttgacatttggtaatgcaggaagacagaaactgcatttaacctaatagcacctcattttttacattcttccatgccacagcaggggtaagaaaattgtgtcaagtaatttccttcctatagaaagctggctttttgtgtgctatatctgagtataaacagagacaggcttcaccaggatattacttctcggcttcctgaatatttcctacaaatcaagcctaatgactgcaaacaggatttaacatttatatctcaaattagaattcttaccattaactctttttctagatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgagtaagtattatattagtccattctcatgttgctataaggacatacccgaggctaggtaatttataaagaaaaagaggtttaatggcctcacagttccacatggctggggaggcctcacaatcatggcagaaggcaaaggagaagcaaagacatgtttacatggcagcaggcaagagagcatgtgcagggaaactgccctttgtaaaaccatcagatctcataagacttactatcacgagaacagcacgggaaaaacccaccctcaagattcaattacctcccaccaggtccctcccatgacatgtggggattatgggagctacaattcaacatgggatttggatggggaaacagccaaaccatatcaagtatattatactgtcattacttattgtattttgctaattaaaaaaatatttcctgtgttataaatatttctaattagcactagtaactagatgacaaaaatattcatctcctaatatctacattatcagtgacaaagtattaaaatttgtgttagttaaaatggaaagtataggcataactcctttctttactcttccattcaagaactagtctatgtttgtaaggaaggcaggttctcctttaaaaggaaaagaaatgggctaggcacactggctcatgcctgtaatcctagttctttggaaggctgaagtgggaggattgtttgatgccaaccattcaagaccagcctgggcaacatagtgagactttctgtctgcaaaaaattaaaagcatggtggcacatgcctgtaattctagctacttgggaggctaaggagggaggatctttgaacccaagaggttgaaggtgcagtgagctgtgattgaaccacctgcactccagcctggataacaggtgaccctatctccaaaaaaaaaaaaaaaaaggaagggggaaagaaatgacacacaagagagcagagaactggacattaaatcaagctaggctatggggaagtgaaaataagttagttggagcagtcaaaagcttagatacaccacaaggcagcagctaagcttaaagaagtgcacatttcacattttcagctctcaagagtcttcagataattcctatgagatccactaaggatttgtgacttccaaatgatggaactgttggaaccaatggaacaatgaacttagtgaaagttgctatagaaaatatcaaaccagtatttcccaaagcatgctccgtataacatcagtcttgagagatggtctgcaaaaagtccttagaataaggttgaaaaaaataaccaacaaaaaagaaaaaggttgagaaacactagacaccatagcttcctgttggacattaacaaatgtacattaacatatgccttaagaaatactggcataaactagtttaattttgtttaaaccaatgtttgcaaactttttttaaaatccatgtagatcttttctgaaacttccttgttaattttgtgaggaacaccctttgggaaatattaagcctttttaaccctcatactgaaaactaaggaaaaggaagatctgtcgtatagcccagcagtccccaacctttttggcactgacagggaggggtggatggtttcaggatgaaactgttccacctcagatcatcagaccttagttagattctcataaggagtatgtaagctatatccctcgcatgcatagttcacaagagggtttgcactcctctgtcaatctaatgccacagtgctctaacaggaggcagagctcaagcggtgatgctcgcttgcctgctgctcacctcctgctgtatggcccggttcctaacaggcccggttcctaacaggcctggttcctaacagtaccagtgtgtggcccgggggttgggaacccctgttatagttcatctaagaggttctaattattatagcgtaatctttgacagtatatcattactatgggtggatttataccaactgaaaaattacctttaaataggggaaagtgaagtgaatcaatgttttaaattctctactcagctactagttttctattataccataagaccaaatttaacatcaaaacatttgaaaactccttaacctattaattttagtacaatgggataattttattttacatatgtttctaattgtccaatattgtttatattttgaagtatattaaactgagaactaaaatgttttaaacttatcaaatagaagtgtactagataagtaattgttaaaattattgattattttttattcaacagatccaaaatcacatattctgagtattcgagatgaaaaggagaataactttgttcttgagcaactgctgtacttcaattatatggcttcatgggtcatgttaggaataacttatagaagtaagttgtaaatctgccaactttctctatttgtttttgtacttcattataacataattatcaagccatagttcttcaaagtacatgtctatcaatacgtgaaagtataattatgtacttagcataacttacataaataccaagacagtttttatgtctctgctctgcctttatcatcgagtttaaagttaaatggcggaaaataattttctgaattagtttgttcccgcactgctaaaaagaactacccgaacctgggtaatttatgaagaaaagagctttaattgagtcacggttccacaggctttacagaaagcatggctgggcagcctcaggaaacttacaatcatgtcagaggcgaatgggaaacaagcaggttttactatggtggagcaggagagagagtgaaggaggaggtgctacacacttttgaacaaccagaactcattagaactcactcactatcacgagaacagcaagggggaaaatcacctcccaccaggcccctcctccaagactgaagatcataattcaacatgagatttggatgaggacacagagccaaaccatatcaattttcttttttcactcttttatgtagcaactcaagactaactaaaaatgatcaccatcccatataaatcttcaatacttactttttgtttccactaactatgtgagatgagcaagaacagaatcactctattagtgttgcagttttgggtttataaccctggcttagtttatactggcccacatatgataagcattagaaaaatgagacacatggccaggtgtagcgtcccacgcctgtaatcccagtactttgggaggccaaggcgggtggatcaccagaggtcaggagtttgagaccagcctggccaacatggtgaaaccctgtctctactaaaaatacaaaaattagccaggcatggtgacgtgtgcctagctacttgggaagctgaggcaggagaatcacttgaacccgggaggcagaggttgcggtgagccaagatggtgccactgcactccagccagggcaacagagactcaagactccatctcaaaaaaaaaaaaaaaagaatagaaaaatgagacacatggtctgacaatgggctcgaatatttggaatttggactaaataccaccaatccaaaatatgattgataacaaaattttttaaaacagtctaatatagaggaaacaaggtcttgtttctaaatgcttctgagcatttagaaagatgctcagaaatgtcctgaaaatcatagacattttggaattaggaaaacctttccacggccatagagcatcaaaagcatacatttactctaaagagggtttgataaggggcacaggacaatgataaccaggggtagggaaggaaaagaagctaaattactcaaatctgcctgttttaaaaataggcttctcctttgctctctaacccatctgtttcttggggttaccaatgttttcctgaaatgtttatggttggcagaggggttaatggaaattaaactatcaagcaatagataaagacttggtttaccaagtgaggataagttcatcatagtaggacttagttggcccaaaccttttctctgatgacacttaactacccttgaattaaaatggagaaaaactagctggaaaattctgaggcttcacctgaaagtgactgaagaaacaatggtcttgtattgagccatagagaccacacccaggacagagagattgaaattgtaccctttggtatactttgtagttatattatcagaagcaactgaaaatctattataaattctgaaaaagcatttttagatcagaagactcccttattgttttaccttctttcataaaatgtttgagtaataaaatttctattaaaatatacaggcatatgagggacatatagaaagacatttcaggcaaatggcacatttgatttgaatctcattcttactgacttaatttacatctgtaagttactgttttgggttactttgatatacttataaaatatttaattttttggcccctatacaaggaattctgtttttaaaacagctttgacttttcaatagcagggccatgaatagaaatcactgtaagtcactgtttttggttacgttgatatagaatatttaattgtatttggcacctacccaaagaagtttgtttttttaaacatttttgatttttcaatagcagggccatgaatagaaattactatgagaagccacagtatgtcaactgagagatacattaagccaagtgaaaaaagtgactttttcttaaaacaactttagaaatctaccattgcacatcatattggtcagaaaattgataactttgaagtttaggagaagggaagaggaactggaaggcatgagatgatataaagcagcaaacacgaaccaaatcgtgtgtgcagtgcttctaatgtgtcattgctgcaggcagatgtttaggggtcttgccttgggagatggtaatcaatgaagaccagaaataaccaggacaacattgggtgtgtgtaggtagtgatggcatcaatctttataccaatttataattgtaatatgcctagcacctttttttaaagctttattgcaatcatcactaccccaaaaagaaacacaatacccactagcattccctccctgtctcctagtcctcagcaaccactgatctactttctgtctctacagattgcctgaatgtaaaattctggacattttacataaatgaaatcataccatgtgtgctttttgcgtgtgactggctttttccattaagcataaagattttaaggtttatccacattgtagcatgtatcagtacgttattcctttttatgactgaataaaattccattctatggatataatacattttatttatccatgtatcacttgatggacatttaggtaaaacaacctaaattttaaaccatttttaattattatgtataatgcttctctgaacattcacgtacaagtttttgcatggacatatgtttccatttctcttgggtaaacccctgggaatagaattgctgcatcttttgtttaaccctttgaagaactaccaggttgttttccaaaccagctataccattttccattcccggtatatgagagtactgatttctccgtatcgatgccaacatttgtgtgtttttcattatagccatctaagtgagtgtggaatgatatctcactgggatttttatttcatttccctaatggctaatgatattaagcatcttttcatgtgcttattgaatatttgtatatcacctttggggaaatccctattcagattttttgctcatgttttaaattgagtctttttattgtcgaggggtaagaattctttatatattctggatataaatactttccagtatttatatataaatatataaataatttccaaattattttaaaatttatataaaatataaaattttatatttctggatataaataatttccaaatattttctcccatgactttacttatgccacaaaagtgtttttctttttttttcttctttttttattgtactttaagttctggggtacatgtgtagaacgtgcagttttgttacataggtatacacatgccatggtggtttgatgcacccatcaacccgtcacctacgttaggtatttctcctaatgttatccctcccctagccccctaccccccgacaggcccagtgtgtgatgttccactccctgtgtccatgtgttctcattgttcaactcccacttatgagtgagaacatgcggtgtttggttttctgttcctgtgttaatttgctgagattgatggtttctagcttcatccatgtccctgcaaaggacaggaactcatccttttttatggctgcatagtattctatggtatctatgtgccacattttctttatccagtttatcattgatggacatttgggttggttccaagtctttgctattggaatagtgccacaataaacatacgtgtgcatacatctttatagtggaatgatttgtaatcctttgagtatatacccagtaatgggattgctgggtcaaatgatatttctagttctagatccttaaggaattgccatactgtcttccacaatggttgaactaatttacagtcccaccaacagtgtaaaagtgttcctatttctccacatcctctccagcacctgttgttcctgactttttaatgattgtcattctaactggcatgagatggtatctcattgtggttttgatttgcatttctctaatgacgagtgatgatgagcattttttcatgtgtctgttggctgtataaatgtcttctcttgagaagtgtctgttcatatcctttgcccaattttgatggggttgtttgtttttttcttgtaaatttgttgaagtttcttgtagattctggatattagccctttgtcaaatggatagactgcaaaaattttctctcattttgtatgttgcctgttgactctgatgatagtttcttttgctatgcagaagctctttagtttaattagatcccatttgtcaattttggcttttgttgccgttgcttttggtgttttagacatgaagtctttgcccatgcctatgtcctggatggtattgcccaggtttccttctaggatttttatggtcataggtcttacatttaagtctttgatccatcttgagtttatttttgtataaggtgtgaggaaggggggtccagtttcagttttctgcatatggctagccagttttcccaacaccatttattaaatagggaatattttacccagtgcttgtttgtgtcagatttgtcaaagatcagatggttgtagatgtgtggtgttatttctgaggcctctgttctgttccattggtctatatctctgttttggtaccagtaccatgatgttttggttactgtagcctcatagtatagtttgaagtcaggtagcatgatgcctccatctttgttcttcttgtccaggattgtcttggctatccgggctcttttttggttccatatgaagtataaagtagttttttccagttctgtgaagaaagtcagtggtagcttcatggggatagcattgaatctataaattactttgggcagtatggccattttcacgatattgattctacctatccatgagcatggaatgtttttccatttgtttgtgtcctcttttatttccttgagcagtggtttgtagttctccttgaagaggtccttcacatcccaggtaagttgtattcctaggtattttattctctttgtaacagttgtgaatgggagctcattcatgatttggctctctatttgtctgttattggtgtacaggaatgcttgtgatttttgcacattgattttgtatcttgagactttgctgaggttccttatcagcttaaggagaatttgggctgaggtgatggggctttctaaatatacaatcatgtcatctgcaaacagagacaatttgacttcccctcttcccatttgaatgcccttcatttctttctcttgccagattgccctggccagaacttccaatactatgttgaacaggagaggtgagagagggcatccttatcttgtgccagttttcaaagggaatgcttccagtttttgcccattcagtatgatactggctgtgggtttatcatgaatagctcttattattttgagatacgttccatcaatacctagtttgagagtttttagcatgaaggggtgttgaattttgtcgaaggccttttctgcaactattgagataatcatgtaatttttgtcattggttctgtttatgtgatggattatgtttattgatttgcatatgttgaaccagtctttcatcccagatatgaagccgacttgatcctggtggataaactttttgatgtgctgctggattcggtttgccagtattttcttgaggatttttgcatcgatgttcatcagagatattggcctgaaattttctttttttgttgtgtttctgccaggttttggtatcaggatgatgctggcctcataaaatgagtgaaggaggagtccctctttttctattgtttggaatagtttcagaaggaatgttaccagctcctctttgtacctctggtagaattcagctgtgaatctgtctggtcctggacttttttcggttggtaggctattaattactgcctaaatttcagaacttgttattggcttattcagggattcagcttcttcctggtttagacttgggagggtgtatgtgtccaggaatttatccatttcttctagattttctagtttatctgcatagaggtgtttatagtattctctgatggtagtttgtatttctgtgggatcagtggtggtatcccctatatcattttttattgtgtctatttgattcttatctcttttcttctttattagtctggctagtggtctatctattttattcatcttttcaaaaaccagctcctggattcactgattttttgaaggttgtttttttgtctctatcgccttcagttctgctctgacgttagttatttcttgtcttctgctagcttttgaatttgtttgctgttgcttctctacttcttttaactttgatgttagggtgttaattttagatctttcctgctttctcttgtgggcatttagtgctataaatttccccctacacactgctttaaatgtgtcccaaagattctgatatgttgtgtctttgttctcattggtttcaaagaacatctttatttctgccttcatttcgttatttacccagtagtcattcaggagcaggttgttcagtttccatgtagttgtgcggttttgagtgagtttcttaatcctgagttctaatttgattgcactgtggtatgagagacttatgatttccattcttttgcttttgcttaggagtgttttactttcaattatgtggtcaattttagaataagtgcgatgaggtgctgagaagaatgtatattctattgatttgggctggagagttctgtagatggctattaggtccacttggtccagagctgagttcaagtcctgaatatccttgttaattttctgtctcgttgatctaatattgacagtggggtgttaaagtctcccactattattgtgcaggagcctaagtctctttgtaggtctctatgaacttgctttgtgaatctgggtgctcctgtattgggtgcatatatgttttggatagttaactcttcttgctgcattgatccctctaccattatgtaatggccttctttgtctcttttgatctttgttagtttaaagtctgttttatcagagattaggattgcaacttctgctttttttttgttttgttttccatttgcttggtaaatattcctccatccctttattttgagcctatttgtgtctttgcacatgaggtgggtctcctgaacccatctcatctgaacagcacattgatgggtcttgactctttatccaatttgccagtcgtgtgttttaattgggggcatttagcccctttacatttaaggttaatattgttatgtgtgaatttgatcctgtcattatgatgctagctgattgttttgcatgttagttgatgcagtttcttcatagtgtgaatgttctttacagtttggtatgttttgcagtggctggtaccggtttttcctttccatgtttagtgcttccttcaggagctcttgtaaggcaggcttggtggtgacaaaatctctcagcacttgcctgtctgtcaaggattttatttctcctttgcttatgaagcttagtttggctggatatgaaattctgggttgaaaattcttttctttaggaatgttgaatattggctcccactctcttctggcttgtaaagtttctgcagggagatctactattagtctgatgggcttccctttgtgggtaacctgacctttctctctggctgttcttaacattttttccttcatttcaaccttggtaaatttgatgattatgtgttttggggttgctcctctcgaggagtatctttgggttgttctctgtgtcttctgaatttcagtgttggcctgtcttgctaggttggtgaagttctcccagataatatcctgaagtgtgttttccaacttggtttcattctcctcatcactttcaggtacaccagtcaaacgtagatttggtcttttcacatagtcccatatttcttggaggctttgttcattcctttttattcttttttctttaatcgtgtcttctctctttatttcattaagttgatcttcaatccctgatatcctttcttccgcttgatcaattcagctattgatacttgtgtatgcttcacgaagttctcatgctgtgtttttcagctccatcaggtcactaatgttcttctctacactgggtattctagttagcagttcctctaaccttttttcaaggttcttagcttccttgcattgggttagaacatgctcctttagctcggagcagtttgtaattacccaccttctgaagcccacttctgtcaattcatcaaactctttctccatccagttttgttcgctagctggtgaagagttgtgatcctttggaggagaagaagtgttctggtttttggaattttcagcctttttgcactggtttctccccatctttgtggatttatctacctttggtctttgatgttggtgaccttcagatggggtctttgagtggacatgctattcttttctgttttttagttttccttctaacaggcccctctgctgctggtctgctggagtttgctggatgtctacccgactctgtttgcctagttatcacccacggaggctgcagaacagcaaagattgctgcctgttctttcctctggaagcttcttcccagaggggcacctgcctgatgccagccagagctctcctgtatgaaatgtctgtcggcacctactgggagatgtctcccagtcagaatacctgggggtcagagacccacttgaggaggcagtctgacccttagcagagctcgaacactgtgctgggaggtccgctgctctcttcagagccatcaggcagggatgtttaactctgctataagtccctgactgtggctgctgcccttttttcagagatgccctgcccagagaggagaaatagggccatctggccacagcaaccttgctgagctgcagtgggctccacccagttcaaacttcccagcagctttgtttacactgggagcgtaaaactgcctactcgagcctcagcaatggcggatgccactcccccgaccaagctctagcgtcccaggtcaatctcagactgctgctatgctggcagcgagaatttcaagccggtagatcttagtttcctgggctccataggggtgggacccacctagccagaccacttggctccctggcttcagcacccctttccaggggagtgaacagttctgtctcaccggcattccaggcaccacttgggtatggggaaaaaagaactcctgcagctagtttggtgtctgcccaaatggctgcccagttttgtccttgaaacccagggccctggtggggtaggcaccagagggaatctcctcgtttgcaggttgcaaagaccctgggacaagtgcactatctgtgccagagttcctcaggctcagtccctcatggcttcccttggataggggagaaaattccccgaccccttgcatttcacaggtgaggcaatgccccaccctgcttcagctcgccctctgtgggctgcacccactgtccaaccagtcccattgagatgaacccggtacctcagttagaaatgcagaaatcacctgccttctgcatcaatcttgcttggagctgcacactggagttgttcctatttggccatcttgccagcaatccatcacaaaagtgtttttcttttgtcatttgtgcatatgtaagaaggctttgcttaccccaaggttatgaagacttactcctatgttttctttcttttctttttttttttttttttgagacagacttttgctcttgtcaccgaagctgaagtggtgcagtgacatgatcttggctcactgctacctctgcctcctaggttcaagcagtctccagcctcagccttctgagtacctggtattacagacaaccgccaccacgcccagctaatttttgtatttttagtagagatggggttttaccatgttggtcaggctggtctcgaactcctgacctcaggtgatctgcccacctcagcctcccaaagtgctgtgattacaggggtgagccaccatgcctggccttccatgttttcttctaaagattttatagctgtagcgcttatatttatgtctgtgatctactttaatttttgtgtgtggtgaaagaaaggggtccaacttcattttttttttttttttacatgtggatatccagtttagaagactattctttccacactgaattgtcttggcatccttcttaaaaatcaattgactggccaggcacggtggctcatgcctataatcgcagcaatttgggaggccaaggcggatggattatgagatcaggagttcaagacctgcctggccaagagggtgaaaccccatctctactaaaatatacaaaagttagccagccgtggtggtgggcacctgtaatccctgctactcgggaggctgaggcagagaattgcttgaacccaggaggtggaggttgcagtgagctgagatcgtgccactgcactccagcctgggtgacagagtgagactgtgtctcaaagaaaaaaaatattaattgaccataagtatgcacaactgtgaacagtttatgtccagagaagagatttctgtggtgacttttataacttatcaatcatgttttaaataaataaaatagttatgttcatttccatgcaattaaacgtatatgtaagagaaaataatatttttttatttcaataggtttttggggaacaggtggtggttggttacatagataagttctttagtgttgacttctgagattttggtgcacccatcacacgagcagtgtacactgtacctagtgtgtaatcttttatccctcatcccctcccactcttccccccgagttcccagagtctattgtatcattttatgcctttgcatcctcatagcttagctcccacttggtgagaacacacaatgtttggttttccattcctgagttacttcacttagaataatgatctccatttccattcaggttgctgcgaatgccattatttcattcctttttatggctgagtagtattccatggtacatatataccacattaccacattttctttgttcacttgttgattgatgggcatttgggctggttccatatttttgctattgtgaattgtgctgctataaacatgcatgtgcaagtatctttttcatataatgacttcaagaaaagaatatttgatgacaaaaatgaaatgttattactgaaggatggtggaattataggtcaatatttatagtttgtatttatattcaaattaaaaatgagcatgatttactgttataatcagaaaatatcttaaagggttatacataatcatacaaccttttagaaggttgggaaaagagaaaattagtcaagtttgaaatcttaactgtataagtgtaattcaagtcttgatttaatctctaagcataggaaaaaatgtttcttctctagataattctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatgggtaagtatagtaaaatatagagttttctttcactccagggaaagaatataaggctattagttccaccagtgggaatcatacaatcaaatgcttcctctgtattcagtcctgtgcgaggtgttacagaggttatcgaggaaggaaaagatacgggccctgctgtcaaggttttgaccctaaggagtaaaatgtagttgtggagacagcattaaattccttatcattgtttaatgtaaattggtcttagattaattgatacaggcttaaattgtggggaagtcaaaaccgatacattggaaaggggaataacaaaaaaaaaaggaaaggcttcaagaagaggtgaaacttggttggggtttgaaaaatggatagggtttatataaataagaaagtgtttggggaacgagttttaacattccgtgcaaagtgaatgtctctccaccttgcttaatctttaaataaatctatttttaaatatatgttagttttaattttttcacagcttaaaaactgttaattattaccactgtgccctaaaactgtcattactcccactgtgcccaaagctccctgctcactgggagcccgtaaaggtggagtgctggctagttggctcacttacagcgccgcagtcacttcccaagaccgtgtccaccagcaacctccagggattccttattctaacctactttgagtgcatgtaaacttttgagacattttagaaacttagtctctatccccagtttctaggccttctcccagttccctgtttttccccattcttgctcagcaaagcatctttttctcaatcaagctggtctcttcattgtcccaggcacagtgtatgcccatcctcatacttgcacctttatgttttccttctgccaagaagttttccaatttctttctttctttattttttttacatctttaataaacttttcattttaggatagctttagagttacagaaaagttgcaaagatagtacagagcattcccatctaccctacaatcaatttcccctactgttggcatattactttagtatggtacatttgtcacaactaataaaccaatatttatccattattatctttaactaaagtccacacattattcaaatttctgtagtttttatttaacatactttttctttctaggatcccacctaacctttagttctcctgcctccttaagctcctcttggctggctgttttctcagacttttcttatttttgctggccttgacagttttgaggaacactggtcatgtatttggtagaacgtccctcagtttgggttggcgtatgtttttctcatgattaaactggggttataagtttttgagggaagaccaaagatgtgagggagcattctcacttcacatggacagcatgtactattcatatgacttatcactggccacctggcccaaggtagtgtttgttaggttctctgctgcaaagttacctcttttcctcctttccatactgtcttctttccaaggaagtcactatgttgagtccacacttaatagggtagaaagttatcctccaccttcctatgaggggagtatcgatataaattacttgaaattcttctgcacaggatatttgtctattttctccaatttttattttattttattattttatttatttatttatttttttggagatggagtcttgctctgtcacccaggctggagtgcagtggcgccatctcagctcactgcaacctctgcctcctgggttccagcgattctcctgcctcagcctcccaagtacctgggattacaggcacgccccaccatgcccagctaattttttgtatttttggtagagacggggtttcaccatgttggccaggatggtcttgaactcctgacctcaggtgatccccccgccttggcctcccaaaatgctgggattacaggcgtgagccactgcacctggccccaatttttaaatttattcagtcatttatttataccctcatcattgtagtttttttgttatttgtttgtttgtagcacttccatactttctccttaccttctttttattcttgatttcccccaatcctctagacctagtataggttcattgttatttattttatactttggattataatctaacatactgcattctgtaatattttgcttaagtctttccagctttggcccttgggagctctttcacttggctcccatgtcccttgaaataacctcgtcattgtggctttgctgtttgtgcttgttttaagcacttccttactttctggttcccttatttctttttagtcttaatttcacctaacccttgagacctggtttatcaagtagtcttcctgactcttctcattcaaatgaatctctaccaatttcacataccctactggttaacagttttgccatcatttcagccattgttgtttctgtctccaactaatatatgagcttcttaaatcaaagaaaatgtttatgccttttaaaatatcaatcagagaactttaagagcctaagatatgtgtcataccagtaagaaaaataaaatatacatttgacctcccttattaataagaaacccagttttatttaacttttgaaatgattgcatgttgtctcatccaaaagatgtatttgaaataatttaaattttaatcaccagtgcttttaattattatagttgactacaaagaagaatataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatgtaagtcttgcttcgttttccagaaacttttcaaatgtgttattttgagggttagaaatttgagcgtaaagtattaacacaaagtacaacattagatgaagtactgggactccgcttgcatagcatggtgctttcttaccttttacaacacagaacaaatagaaaattttactgtagcatgcactaggacaaatgatcaggccatcccaagggcccagtggatgactatctcaacaacacctctatagcctatttgggacagacaaattggaaagctgataaaaatgaaatagcatagaatcagaaaaccctgagtttgagtaccagtagcagatcttccatttatgtgctgggtgatcattaacctttgcaaccttatttcctcatgtagaaaatcagggtaataataatttcactgagattttaacacaaaagtttatacaaagtaccatctaaaattctccacatggttaggactaataaatgtataccttcttcccacttttcctctagaaaattatactacttaggattaattctgctagtaaagacatctgtgccactatttgaatcatattatttaatcatttatgtacttacagtagggtcttgtgtacaaaaaatggttatctattgagactagagttgtagttttaatttaaataatctttagaacagagtggggaagatttttttttaaaagcatggcaagttaagattataaattcaaggaaaattcaaaaatagtcttcccattttgagtttcttgggaagtgtttctcttttctagctccctactgcttggtgtcctctgtagtgtgaaaaatgtagccagagacacaaaacacaaaactataaaacacagaaaacaatattcagaacaatatgaaggttgggattgtaaatttgtaattatgacaaatggaagccatttgcatgttgtttaatttcgagtgtcacataaactcatccttcaaaaaaatctgaagaccaggtgtagtaactctgtctgtaagtttaaagttctccataaactgtatcagagcaaatgtcccaaatcaatgcatcagaagtaaatcagacctacaataatagtaggttcagacctacaatactgtaagcaaataattaatattccattataatatttcttaaagtatgtatgttgttctttgtattctttttgaagtcaaacatctggattcaggttatctctattgttcttacaacagggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatgtaagacttcaatttcagtaacagtacatttatgaaaatgtgacataatttatgcacataattaaaagctcagtggaatttttatttaaagatttattcacaagggccgggcgcagtggctcgcgcctgtaatcccagcactttgggaggccgaggcgtgcggatcacgaggtcaggagatggagatcatcctggctaacaaggtgaaaccccttctctactaaaaatgcaaaaaaaatagctgggcatggtggcgggcgcctgtagtcccagctagtcaggaggctgaggcgggagaatggcgtgaacccgggaggcggagcttgcagtgagccgagattgcgccactgcagtccagcctgggagacagagcaagactccgtctcaaaaaaaaaaaaaaaaaaaaagatgtattcacaaataatttttgtgaaaataattttgatactttgtaaatggaaacaaatacagtataagcactcagggaatttattcccaatgactttcatttgttctgtcaccaggtaaattctaccctagaatttgtgaattctaatttcacttagcaatgtttttcaaaggctgagatgcttatttcaaaaaagggtcccacaacatataaatttggggaacacctcatgtgatttaccgtattaaagtttctaagagagtttcttttcttttcttttcttttcctttcttttcttttcttttttcttttcttatcttttctttttctttttttttttttgacagggtttcagctctgttgcccagactggagtgcagtggcatgaacatggctcactgcagccttgacctcctaggctcaagcagtcctcccaactcagcctcctgagtagctgggaccacatacacatgccaccacacccagctaatatttaaaatattttgtagagttagggtctcacaatgctgttcaagctggtcttgaactaggatcctaggctcaaacaatcctcctgtttcagcctcccaaagtgctgagagtataggtgtgagctactacgcctggccaaaggttctaagagagtttctgtaataatgaagtctgtttaactttgtgtaaccaagcattttccaaatttatatgatccttaaagtttaagggaagagcctcttccattagaggctggacttagggtcacccctggtggataaagcatgaaccttgaggaagaccacaaaaaaacaaactaccggggactgcagaggcctgcaggacaggctggggggtggtggcattggtttccgaagactctggttctcaatgctcaccatgttttctgctctgaagaatcttgaacggcagattcaacatttggttgaacagattcaggccgaagaaaatgtgaaaactttagagaagcaggttaataaaagaaagggagaatgatataaaggatgaggaatcaaggtacaatcaagaactgacttctcagttgttaggcacagaaaacaaatgtaactctttagaaaaacaattggaatacatgagaaataaggcatgcagaaatagagaaacaggctttataggatagagaatgataagatggccagacataagttctgtgctctaccaggttgaagagtgcctcctccccaaagattcccgtccagtcagaaccttagaatgtgactttactgagaaatagtctttacagatctaggtagttgaggtgaggacatattggataatggtgggccctaaatccaatgactagtgtccttataagagggagatacagacacacagagggaaaaagtccacgtgatgacaaaggctgagattgcagtgacagagtgataaaccaaggactgtcggcaaccaccagaagatgagagggaggcacgagacagattctccaatacagcctccaatgaaaaccaatcctaacaccctcttcaattcagacttctagcctccagaactgtgagagcatacatttctgttgttttaagccaccaattttgtggaatttattatggcagcccaaggaaacgaatacaagggctaactttaaaaactggatcttcaaaaaaaaaaaaaacaaaacagagaataacaggcattagtgaagatgtggagaaaatggaacccttatgcactgctggtaggaatataaaacagtgtaaccactgtgcaaaatggtgtggcaattcttcaaaaacatgtacataagattactatgtgatccagcacttcaggtatatactcaaaacaactgaaagcagggattcaaacaggtgtttgtacaaccatgtcatagcagcataattcataatagccaaaagatgaaagcaacccaagtgtccatggatggacgaatggataagaagccttaaaaaggaaggaaatgctgatgcatgctgcaacacagatgaaccctgaagacagtatgctaagtgaaataagccagtcacaaaaagacaaatactctatgattccatttatatgaggtagtacccagagttgtcaaattcatagagacaggaagtggaatggcagttaccagggactagatggaggggaatatggggagttattgtttagtgggtatagagtttcagttttgcaagataaaaaattttagagatgggtggtggtgatagttgtacaacagagtgaattcatttagcaccacgggactgtacacttaaaaatggttaaggccagatgtggtggttcatgcttgtaatctcagcactttggggggctgagacaggtgggtggcttgagcccaggagttcaagaccagcctgggcaacacagtaagactccgtctctacaaaaacgtgtaaaaattagctggacacagtagtacatgcctgtaatcccagctacttgggaaactgaggcaggaggatctattgcacccaagagtttgagactgcagtgagctatgattgcactactgcattccaacctgggtgacagaataagaccctgtctctaaaaacaaaacaaaaccaaaatggttaagatggtaaattttatgttatgtgtattttaccacaattaaaaaaaatggatcttcttgaacaggaatgtaacacacttaccacgatgcaagcccttacagaaaaaaaaaaaaaaaagagttggaagcaaaacttcatgaagaacaagaagaaaaaaaaatgtacgcagcctaagagaccccagttgcagactatactagaaacaaatagaccaaagataaggcagttccttatgttgccagtgcaagaagtaatgttaaaaaaaaaaaggtcaaaccattcagaaaagttccctatcctaatgatgccataataatcaatgttcaacaagttttgcattaacaattgagcccagtgcaacaatgagtaatcagcaatatacctttgcccaaccaactattttcataaggtggtaaaaacaagaacttactagtaacatttcttttcaacagcagcattgatgaggagttgtgagaagttttatagattgtatagatgaatttggcaaatgcattttgatctgcagcagctgggaaacttacccaggagtccaactgctgaactgaagacttagtactcaaattggtgtgttagtgagaagaatggaggcaaaagccaatcaaataaccgaagttcaaaaagatcaagtctggtttctaacagaagatagagaagcagcagaaggaactaagggccactaaagagtctcacagtagccgccattcctctctaatcacagagaccacaaataaggactctgccaagtggagatttggagaaaaaaacagaaaaagcctttacttactgaaggacataaagatcatacagaatgcattacaaagcaatagtttgggttgagattactgactggtaccaggtcagatatttgattcagataagctgtaccgcactaatacgacattgacaatttactttccagttttcatatgctcttcggttggaattaaaaacaggtgttaaagggcacaagctgcattcctcaggctgcttctgttactcagcacaattaaaaatcaatttaaatggaaaccaggggcatttttaagagctaagaagccactcctagtctttttttgtttgagtgatgttgcggtgctgatgtattatgctttgtaaaacaaattagctatttttaaaaaatagttcttcttatgactaagtaaaactagatttatttagattatcaaaataaaaaggaatccaacgggctaggcgctgtggggtcacgcctgtaatcccagcactttgggagcctgaggcaggcaaatcacttgaggtgaggagtttgaaaccagcctggccagcatggtgaaacttcgtctctactaaaaaaaataataataaacaaaaaaaggaatccaaagaaagaaataattttaattattatttcagagtactttcaggtctgcctggcctgtctttacttctttttctagtctgtctttctcattgtttctactttagtccaaatcagtcttagaaagctaaggcactttccacttctatcacctaggttttttaaacggtattccaaaaagttaattaaaatatgtatttatagagtgtgggctgtggctttctctggtatgagttaaatgctactcaaccacaaacgcaacagttccaatcagggacattgaagtagattttgaaaggcagtcttttttttccatgcattgttacaactgtgtctaacatttttatagctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatggtgagttaaaatttgttgattttcttatgactcaataatttttagaaatgtttcttaaggatataatttgaagcaatgattgtatttttgaaaatatttttaaagcactttccatttctaatagcgctataaactaattgcccagtggtagggaaatggttaagtatctgatgacataggaactcaatgaaatattggaatagccattaaaaacgcctgtaatcccagcactttgggaggccaaggcgggcagatcatgaggtcaagagatcaagaccatcctggccaacatggtgaaaccctatctctactaaaaatacaaaaattagctgggtgtggtcgcacacacctgtagtcccagctactcgggaggctgaggcaggagaatcgcttgaacccaggaggcggaggttgcagtgagctgagatggcaccactgcactccagcctgggtgacagagcaagactctatctcaaaaaaaaattatcaatgttaataataagtacatggaaaataataagttggaagaagtagaattttaaagtggtggctgggtgcggtggctcacgcctataatcccagcactttgggaggccgaggtgggaggatcacttgaggttagccattcaagactagcgtgaccaacatggcgagccctcgtctctactaaaaatacaaaacttagctgggcgtggtggcgtgcacctgtaatcccagctacttgggaagctgaggcaggagaatcacatgaaccagggaggtggaggttgcagtgagccaagactgtgccactgcgctccagcctgggcgacagagcaagactccatctcaaaaataaataaataaataaaataaataataaaaataataataaatgtaaaataataaaataaaagtggctaagtgaactgctaagtaaaaatactgacaaatgattggaaacggttttacctatagctagatatgcttagaaaaaggaattaagaggtaaaatttttgtaaagttagctaagtagtaaataaaaattatagttgttccattgcttagttattaatacataagcttagcctcaccagggtaacaaatcaaagtagtatggttgtccatccgttctgcaataggattggccacatcctctgaccaccataaagggcagtgctttttgccttcagatttagctattttagaaagagtagcaatgattggctctttcccgtgacaaatttgatccatagtcaaactgtaaaatgacttctagggaaactacctagagtatttcaaagaccaaaacttgtttacctgcttccttgggtagcaaattagccaggtagatggatggcatttatctaatttattctgataaccgttgtggagacacttgactgattgaaaaatcttgtagttaccgggaacttttgtgtgggaaccattcggttttatacctgaatacacatgatggaaactgttgtaagatatatgtatgttttgaaagtcataaacctttttctcctaaaggagaaaacagaatggtttactgtaaaactaatatgtaggttaagcacttaagacttggaggcatgagggtctgggttcaaatcccagttcccacatatcctagctaagtggcattgggaggttacacaactctttctcttttctcatctgaacagtcagagaggtctcaggggtaggcagttccagggccaaaaaaatattgccagataaatattttgaagaaacacaaaatttctttatacgtgtttggaagtaatttttttgaagtacttataaaattttgacctaaataccagtttttaaaaactgtctctgtgtaaggcttgaatttatcaatgatcttgttaataatatatgtatttttcaaatggctagttgagaataaactacttctctagtttccataaagctaattgagaatgtgttttctttcaacagatcactctgcaactatcgtttccataaaagatgaagatgagaataaatttgtgagcagactgatgagggaaaataataacattaccatgagagtttggcttggattatctcaacattctgttggtaagtgaaataattgtatgtgtagtgtgcaaagagagttctaactcatcctaaataacaagtcgtccttgctaaagaatgttaagtagtggctaattcagatgcctcttctggataaataagctaggtcgctggctgttctggatggttataaattttgaatgaatccatgagttaacttagcaatgacggaaaccactaatgacacagaaaatcctgttaaataaagtggaatctttctagaggcttatttctgggatccttggatcaacatcaggacattttcttctccacaggaatgtctgtgtccccacaaggaacccatgcctgccttctcttagagttctagtgcctgtcaccgcatggatttgcagcttataacttcgttattcagaaagttatcttcttgttattcccttctctctaagaatatttttaccattggttaaaattatgtcttaatagtaatctttaaaaactgtcttagtgttaggttggtgcgaaagtaattgcagcttttgccattacttttgcgccaacctataaaattgcagataattgattcaaagaaaatttgtggaaggattttttaatacgaaatagtagatacagggtttaggtgaacttggaattggtagaaataagagtacaaatatgacagaagataaggtttttcacattttatgcaaagttgaattttaaattattaaaatgtgaattttaaaatgttaagtacttgtcaaaaaataaaaggattccaagatgtccatctaaatgaatcctaaatcgtgtttacactgtcaccacaaggtggtgccacttcagctggaaagcaaaaatggagtcctggtggtggtgtgggagaaaggtggggatggagattcctgcacccttcctcttccaccagcatatctttaacgatatgactttttacaattagagtaggggaaggatatgggtccttagaaatctctccctcacaaaataaatgtgcaagcattctgcactttaacggaaacaccacattctctatctgtgttgtccaatagaactttctacaaagacagaaatgttctatatctgcactgtccaatatagtagtcactggccacatgtggctcttgagcacttgaaatgtgactagtgcaactgaagaactgattttatttttttcatttttaatgcattttattttaacaagtggctctcatattggacagcacagttctgatgagttacatgaacccatgcttgtaacttactagtttagtggcagtagacatagttgtatttaatttctttcttcagaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctgggtaagtatggaacctgtccttaggagactttttgcagaacagtcaggaaataaatgtacaatccaattatgtacaaaattctgtatttagtcttgaagtatttagtccttaaagtatatccaactatcttgattaagtcatagagatttccccctgaaaaatagattacaagggacgataactgcacaagatgtccaggactccagtctacattttatataattctttcctaagaaaaacagaagttgccagggtattagggaagtaatttcttttaaaatgttcttgagatgtattttattctatagtttgattatataaaagcttaaaggtctatttctgcagttaatttgcttcctttcttcctaatcccataaaactcatggttaattttaaaacaatgcaaaactggatttagttattgaaaacattcagggtatctataaaaaatcataatttgaacttacatttcattatgaattgatacataaaattaccattaaaatgttatattaacttcatttctggagaaagagctccaaatttttcacagtaacatttttaaagatcttgcataaaacttttgcttcttgtatataaatattaaagataaaacctcaattctaggtaatcagtatccatgtatacacacactgagacagtaaatagagtgtctactatatgccatgccctgttttgcacactgggatgcacctgagaacaagacagataaggtacctgttctcacagagattacaatctggtgaagaaagataagtaaacaggtcaattttttaaagagaggaaaatatcaaatagttataaactctatgtgatggagactcagtggatagctactctagattaggaaaccagggaagaagcctagaagcaggagacaccgaagctaagatctaaaaaatcaagccaagcaaacttcaagggaaagggcataacagacagaggtaccagttggagcaaagagcctaaggcagaacaagttggctgagcgctcagggaagaactgaaaggtaggcaggtgctagacatacagagctttggaagcaaggcttgagttctggttttattctgagtggaatggaaagcaactggaagatttggggggttgggtgggagcagagttagggtgttgcaaatcaaaagttctacgttggccattttgagttatccatagagggacgagatgtgtagtgtgcatagcaatggtatttaaagtcatggaacagagcgaatccatctgggcagtatgcagataagggtcttggaacagcagctgcactaaatgaactcatctgagagacttaaatcattttgaagcaaataacactttatttagccccaggtaagtcaaaaacaaaaatttatagcttttagcaatttgctatcaaagtaggataatatacaagtagtgatgttcccaaattggtgttaggaagggggaatgtgagaataatcatagcgcattaatgtctttggaagaaaattcctatcacaatgaagaggatttgaatgaataggaaaacacttacatttgaaaagaaatcacttaagtgtttcttttgatctgacgatgagtttgaattctatgttagcgctatgaaacaatcagatttattatgtctgtatacagcttacaggtttacatgtgtgacacaacccataatgtataaaatcaataatgatcacttttgtattctctcctccaacatcaaaccttttcctgttccaggccctgattacacagcaatagctatcatagttgccacactaagtatcttagttctcatgggcggactgatttggttcctcttccaaaggcaccgtttgcacctggcgggtttctcatcagttcgatatgcacaaggagtgaatgaagatgagattatgcttccttctttccatgactaaattcttctaaaagttttctaatttgcactaatgtgttatgagaaattagtcacttaaaatgtcccagtgtcagtatttactctgctccaaagtagaactcttaaatactttttcagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactaggatatgtatattttaatagaatttttaacaaaacttcttagaaaattaaaataggcatattactaggtgacatgtctactttttaatttttaagagcatccggccaaatgcaaaattagtacctcaaagtaaaaattgaactgtaaactctatcagcattgtttcaaaatagtcatttttagcactggggaaaaataaacaataagacatgcttactttttaatttttatttttttgagactgagtctctctctgttgcccaggctggagtacaatggcgtgatctcggctcactgcaaatctccgcctcccaggttcaagcgattctcctgcctcagcctcctgagtagctgggattacaggcaactgccaccatgcccggctaatttttgtatttttagtagagatggggtttcaccatgttggccaggctggtctcgaactcgtgaccgcaggtgatcctcccgcctcggcctcccaaagtgctgggattacaggcatgagccaccgcgcctggcctctgcttactttttatatagcaaaatgattcctcttggcaagatgtttcttatattattccaaagttatttcataccattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcagcatttaacttacatttgtactttagagtatttttgtataaaatccatagatttattttacatttagagtatttacactatgataaagttgtaaataattttctaagacagtttttatatagtctacagttgtcctgatttcttattgaatttgttagactagttctcttgtcctgtgatctgtgtacaattttagtcactaagactttcctccaagaactaagccaacttgatgtgaaaagcacagctgtatataatggtgatgtcataataaagttgttttatcttttaagtaaaagtaaaagtgctggagttgatccttcttgaaaaaaaaaatctctagattgggttttttatgttaggcatatagtacaagaaataaattgaccacctattgtaaagcgaggcatttgctaagagattttgtgtgcattttttagagaataaataggcgggtagtggctcacacccgtaatccctcttgacactttgggaggccaaggcagggggatcatttgagcccaggaattcaagttcagcatgggcaacaaagcaagaccccatttctaaaaaaaaataaaataattagccaggtgtggtggcacccatgtgtagtgccagctactcaagaagccaaggcaggaggatcccatgagcccaggagtttgaggctacagtgagctatgaacgtgccactgaactccagtctgggtgacagagcaagaccctgttttgaaaaacaagtcgatattgatccaattgctgaatactggaaaggcaaagtcagataaaactggattctcggaattaggaaaccaatgaccatcttagccaatgcaaatgtagcagagtagtgaagccagaatccagatggaagtgagtttaaaagtgaaagggaaggccaggtgtggcatctcgtgcctgtaatcccagcactttgggaatccgaggtgggtggatcacctgaggtcaggagtttgagaccagcctggccaaatggtgaaaccccatctctactaaaaatacaaaaaaaaaaaaaaaaaaaaaaattagcccggtgtggtggtgcatgcttgtaatcccagctacttgggaagctgaggcgggagactctcttgaacccaggaggcagaggctgcagtgagctgagatcgtaccattgcattccagcctgggtgacagagcaagactctgtctcaaaaaaaaaaaaaaaaaattgaaagggaaattaggagatgaggaacatgagatttcgagaagtatgatggagacagaaaggaaaggggctgggctatagccagaggggaaagaagggttgaaaaagggtttttttctaaaggggagagaaagaggttcacaagtttagaagctgagatgaaaaaaacaaaaacaaaaacaaaaataatggacagagagcagttgatgatgcagtggggagagggaatcattaatggaagatcttggagaagataaaatgagaggggcagtcctaagcagaaagaggaactggtttgggtgggctggagaagcatgccttcctctctgagaccacaagagaagaactgcagataagcatttgaagatgtttgtctatatgtaatggcacctgttttcttgtgtactagaaggcaaggtctgctgagaaagatgggtagcagatggggtcttttaaaaagttttttaattttttagagacagggtctggctcagttgcccaggctggaatgcagtggtgcaactctagctcactgcagtctcgacctccaacattaacttttttttttccctagagacaggtgatttcaatgttacctaggctgctctcaaactcctgggctcaagtgatcctcccacttcagcctcccaagtgttgggattacaggtgtgagccaccatacccagcctgggatcttagcttgaaaagagtaataaatttgaaagactcaatgagagaaataggagaggacagtgactaaggtaaaatcaaatacaaggattgcagaagaggcatagaaggcccagatgaaattaaaagccatattgtttatagtgacagccatcgggagaactgattgatttcctccacctgtcctcagttaacttcagtaaagttgaggaaaaagagagcacgggccaggcgaggtggctcatgcctgtaatcccagcactttgggaggccaaggcgggcagatcacttgaggtcaggagttcaagaccagcctggccaacatggtgaaaccccacctctactaaaaatagaaaaaacttagccaggtgtggtgatacacgcctgta

SEQ ID NO: 822 - DNA, 57933 bp, Human
gccaaggcaggctggtgtgttgtgacatatcaatccacttctgtgtacctgcccttccccgtccagcaaaatatcatcatttttaatatatgttgtgatactaaaatatttcagaagtgttgaccgagtagacattcaataatgattatagctgatacttacagagcacctactatgtgccaaacactgtatgtattttaactcatttaatccttgcaacaatcctgttaggttggtattgttattctcattttgcagatgaagaaatttgaaaagacttgcccaaggtcacagagatgagaaatagaggcatcagcatttaaacctaggcaatctagaaccagagggtacatttaaccactatacatctcccctaaatacatctttgcatcacacctgttatctcagcactttgggaggccactaaggccggaggatcgtttgttgccagcagttcaagaccagccgggtcagcataccaaaatcttgtctctccaaaaattttaaaaattggccaggtattgtaggggcacctgtagtctgagatacttgggaggttgaggtgggaggatcgctagagcccaggaatttgaacgtgcggtgagcatgatccagccactgcactccagcctgggtgacagagtgagactgtgaacaacaacaaaaaaatcaagtttcctggatctatacaaaattttcaatttaacaaatttttataaaaatttgttttaaaataaacacccctctaaatggcaaagctagaacagaatctggtcacaatctataggttagatataggatgacagggaggagcaagagctgaacacatcagctgcagcaccatctactttgcctgcgactccgttagcaggcccactttgcccttttataaattatctgatcaacaactaagagattaaaattcgatctatgttttactctatctgaatcctcaatataatgaagaactttataattgttaatttatggatataatttaagttcattaaaccattatttccttcctatatcctctcattcttccacaaaaacctctacctttgggtgtttacttttacagacacccacgcacacaccccacacgcacgcacgcacatgccttatcttttaactcaagattctcatcttcctttggggagaaacaaacatcatgagccttgaggtccattttctgagggaaaggggggggcggaggcgggatgaataggtttttacccggtattttttatcataaacggggaggtacaaaccgcaaagaaacactagtcgcttggtgggccaccacctctggggctcactgatcaatcgcacccaaactcatttactaatttaaaaaagtactgtggcaaggctcgtttacgtaagtcttggagagaagccgccgccacaatctgccgcagtctcgtgcggagtcacggccaccgagctcttcactttccccaagaggctcccacgccttccccatccccaagggagctaggcggtccctcgcggctctgagtccctcggggaaggccgcgaagagaggccgcaggcgccctggcgagaagggagggcgggggcagcgggcggcgggcagcacccgggctccagttcatgaccccgttattccacagaaaaatggaacattccgctctttccgcccacagaggggaggtggggggaacccttcgatctagtctgggagaggcgacgcggacgcagccaccggaatccgggacgcgaagagccgcgttacgggaatcgctacccctcggagtcccgccccctcgtcgacaggcggccactggaccaatgcctgggcgcaaagggtctctcaggggccaatcagcgcctaggtcccggtagggggcggggcgcagcgttggccggccgggggcgcagctgggcgggattggggagcgccccgccccgccgcgggactggggtggcgcgctacctctgcggagaaggatctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgaggtgaggaggggccgggtgctgggtcgcgtagctggagttagagtgtcggtggtttcggacgggctatctggcactcgaggagacctcccttccccctgagagcagcgcccggaacttgtcagcccagcctggaaatccccacattccttccccttcctgctcccggacctccgaattctacttccacaactttgtcacctcgattatcgcagccctgagtacaaacttcacccaggcgcacgcacgcacccctcttaacgcccgccccgcagaacgcccttcaagaacaaacccccctttttgttaccagatcccacgtttttcccaatccccttttcatctcccctgaaattctattcgctccgcacttgtcttcattctcgaggtggatttcccttccccaaagccgttttttcatcttgaaatcgtaacgtttcagctttgttgaaagttcacaatgcttataaacactattaacgtttctttccttcttttgatcttttctattaataattatcattcctaacgaattccacatctcactgtatcccaaggagaacaaatcagtttttaaaattttacctcctccgacctaaacttttgaagatagtgcaggaagcaagggtctgttcttcagtggatgaacagcattttatttcataatccgaaactgaaaaaaaaaaaaaatcacaggttaaaaataagacgtcaccttttttttttttttttttttttgccttcagaaggaaacgcattttggcttagtttgtgaagtatttcaacaattatactgccttaaaataactagttattagaatgccagggtgaattttctgaaagattgtggtatttgcttttgacagtgctgtaaacaaaccctttaaactgtgtatgactgccagcttcaagttggaacaactcttaatttgaaattacggactcagatcatcagtttagctgtgtgccattatgttaatttcttaaattcatgttaattcctatttggaagtatttttgaactatgaactgaaatattacatttatagaaccaacttgctattaaattgtgctttccaactatttctctttagggataatcttgaacgtttgtttttaatcttgagtgaaagaaaaaaattacaggaaggagaaagtgtcaaaaaggacagactgtagtgggatttttttcttattttaagtatgtattgacaataccagtttaattttctcacaggcaatttagattattataaatactgctgccacctaatttaatataatatagtcttacgtaactaaaaatgttgttctcactcttatttgtgaattgcagtattttcaatttatttaaatttgtttccaaggctttgcacttcagttcagtgttagggcgaaagttaaatacatgtgaagtaggtgttaaaatgtcccctttatagagaaggaaacaggagtctcgctgaaaactagatctgtgtgactccaaatcctgtgctctgaatcattttgtcatgttgacacgtttctcataaaaaccccagtgccacaatttggtttgggaacttaagggcaacccataaatcctctacagtggcagggagggattccccgctccctcctttcagagctgctcattttaatgggagtcagaattctctggccctaatacatttgcagcttggctcctagagaagcatggaatgttctcacagcttctccgtttctttgattgcaaaggcagaatgatcagagttgaggttcctattgtgctttattattttacacagcaaatactaagcaattactacctgctgtacgaactcacaaaggtgcaggagatgtaatcaggaccttcaaagagtttataataattggattgacaaacttatacgaaaaaaactacaaggatgcaaagcagttttaattaaatgcagagtgatgcagaaaatcctgtagatattaaaattagggaatgatcgtttaaggattggagtgagcatttaaggattggaatgagcaaaggatttaccagaagttggccttgaaacctgggtaggatttggataaagggaaaaatgaagacagcccattaataatagcgaatggaggacaaaatgtagaatggagaatatagaacataatataggactagcttgtggaaaggatcagcagtaactaaggtctattaattaaaacaggcaatatatttagtgcttatgttgtgccagttgctgttttgagcactttgcccatattaaggcatttaatcttcataatattatgaagtaggtctaataataataggataaaatcctctttttacacatagggaaacccaggcacaagaaggttaattaatttgcccagctaagtggtagatctaaaggtcatacatagacagcctggcttcagaatctgacctcttaaccatgatacatcctgcgtctccatacagtacgcttgagcgacagcgagtagatagaaaataagatcataccagaaagtctataaaaacccacccttaattgtccaccaggtgcctcaaactatggtagattctgaggatatcaagatatgtgaaacaattactgtgcagtgttctgagtcctgttagggaatgatgtaagagtacactgacagcaaagatgtttgaagtggggggaaattccatataagagatgatacttcaaaagcagtttgtagtgcacagcagagtcaggaaagacattggaataatatatgtagaagcacagactgaaagaacaaggtatgttagaggaagtctagtggtttgctgagtctacagggatggttagtagggagtgatgaaagataagaccgaattataaatggcatggtgtggtcaagcaaaatgaggagcttaagtatttgctttgcagtttggaaactacaagaataatttcagcattattggagtaaaaaagccagattgcttgcaattgcaagcagttctctctagaagtatagtagtaaggtagcttgagggaggagtctgaggaaaggatttttttttttttttagaatagagaaacttgagtattggaaaagatagattggataggcacatcaaagccaaaattttaggttcttaaatagttagaatatttggcattattattcaccctttaaaaagctgttgaggagaagaatgacaggtttaaagttgtgttgtagagagagtgatccaccaacaatgttcagaatgcttggtggggaggaaagagactggaagcaggaacacagttgaaattattgaggtgatcaatgtccaaattaggttagtttgtggtagagagtaaaaagaagagatgggtgggaaagatattatgggagagaagacaggataagatttgtaactgagaaaagctaaaatgtactgcatagatgagagaaacgatggactccattgacttaggcagttgaagaggatgagttgtttgtagatagggaaaaatggtaagtccttgtgactttttaaaaagtgtgtgggcattcatcccattactgggcatatacccaaaggattataaatcatgctgctataaagacatacatgcacacgtatgtttattgcagcactattcacaatagcaaagacttggaaccaattcaaatgtccatcaatgatagactggattaagaaaatgtggcacatatacaccatggaatactatgcagccgtaaaaaaggatgagttcatgtcctttgtagggacatggatgaagctagaaaccatcattctgagcaaactgttgcaaggacagaaaaccaaacaccgcatgttctcactcataggtgagaattgaacaatgagaacgcttggacacagggtggagaacatcacacaccagggcctgtcatggggtagggggaggggggagggatagcattaggagatatacctaatgtaaatgactagttaacgggtgcagcacaccaacatggcacatgtatcatatgtaacctgcatgttgtgcacatgtaccctagaacttaaagtataataaacaaaaaaagtgggtgggcatttatgtgtatatgtgttcatgagcatgtacctatggtgtattgtttttagacctcttaaattgataagactcagagacagaatatctaagaagatgaaatgtaactggaattaaaagaaagatccaagccaaaattcttgaaattattttgtttgaaggtagtagttgaagtcatgtcttcaaagaagttggtatttaaaaagaaaagtcgatgcccagtactttatctttgggtaccttcatagcctggagataaaagctagcagagaattcagtaaaggagacaagaaagaggataaaggaaagaattcaactacattatctggttacatagaaaccaggatataggagaaattcaagaaccagggatggtcaacaatgtgaaaggcttcagaaacacttgtgatatatatagtcaaaatggctacagtctcttcttcttcttttttttttaaactttgcggctatctagtgtatcttagtaagatttaataagaaattagctgattgatcgtgaataagagagctacattggctgaaaaatggctatagtatatagatgattgttttaaagctgtgtgtatacatatccagagcaggagattcattcctttcagcactgtaaatctgttgccctgttacatttggaatgttctgcctccaaagtttcattttcttttaagcaatcagcttcaccctttgctctaaggttgattgatctgctcagtctttttttgtttggatgttctgttttatgtattacccccaaccccaccccctagtgcaaagtgagttaatcagagctatgtttcagatagcatagctctggttagactggcatgctctgggattttgtcattggtaatcttcacttgacaattagagtcaaagatgatgtagagttcatatgtgtgctattttctctatctaggaacccctacccttattttaagactgggcgctcctggcccctgtctgaattgggtattttctgtgctcctgtggcactttgtgcatattctgcatctctaaactttggacttcttaaaggcaagaactatttatatggcttcaattatgtttgtaacggaataaaaattgaataaaagcttgagcttttatttcttaagcaatggtgagaacatggatgttcatcaaagtgctctgtaaaccttttcatttggctaaaatagtctaattttaaaaggccctaaggtcataagcatattctatgtgtttttcaatatgcttataattttgcttttgcatttaggtccttaatctggagagagagtgtatgcttatacatgcatgtgcacgtgcatgagtgtgtgtctttttgtctgatgaaatggggttcttttttttcttttttgcttatggagccagttgtcccaatactatttattgaatagtcctttattttcccagcaaatgagcaaccttttaaaaaatcagatactaaattcttatatacacttgagtgtgttttgttttgtaccattgatttagttgtctattcatttgccaatcagtgctatgtttactttacctttagactgccctttttttttttttctgcgagactttttttttttttgagacagagcctcgcactgttacccaggctggagtacaatggcaagatcttggcttcttagcttgctgcagcctctataagcccaggctcaagtggttgtcccacctcagcttcctgagtagctgggattacaggcatggtccaccatgcccggctgatttttttttttattttttttttattttttatagagatggggttttgccatgttgcttaggctggtcttgaactcctgggctcaagcaatctacctacctcggcctcccaaagtgctgggattacagccgtgagccactgcacccagccttctgttacattttctaattagttattactggtatgtaggagagcttttttttttttttttggagatggagttttgctcttgttgcctgggctggagtgcagtggcgacatcccggctcactgcaacctccgcctactgggttcaagtgattctcctgcctcagcctcccaagtagctgagattacaggtgtgcgccaccactcccggctaattttgtattgttattagagacagggtttctctatgttggtcaggctggtctcgaactcccaacctcaggtgatctgcctatctcggcctcccaaagtgctgggattataggcgtgagccaccgcgccagctggagagctattttttgatgatgttttgtttgactgttatgttaaactctaaatagtcctattattttttgatgatgttttgtttgactactgtgttaaattctcaatagtcctaatagtttgtcatgtgattctcactctttcttgatagatgatcatatcattcacaatttattttccatttttagatcttatttattatatttttgcttaagccctttagagcagtggtgaataactgatgacttcaagcatcttgtctgaatcttgacattaataggaacgcttctaatttttacctttaaacctatagatgcttattataggtttctttcttccttttttttttttttttggaggcagagcctcactctgtcgcccaggctggagtgcagtggtgcattctcggctcactgcaacctctgcctcccgggttcgagcaattcttctgcctcagcctcccaagtagctgggactataggtgcccaccaccacgaccagctaattttcatatttttagtagagacagcgtttcaccatattggccaggctggtctcaaactcctgaccttgtgatccacctgcctcggcctcccaaagtgctgggattacaggcgtaagccaccatgcctggccttgtaggtttcttatagtagtacctgtggcagcaacagcaagagctgcactaataataacagctgttaaccttttattgagtagttacaatgagccaaatgattctaagcactttatgtataatgagttatttaatcatcataacattcctagatgggtaggtggtggtggtaccccatgtttacagataaaggaagtaaaagtgaaggctatttaaaaacttgcctaagatgttaaaatatagggactgaaatttgaacacaagcaatctggttctagagtccctgtatcatctttgttatccttcaccaaggtaaggatggtctctttcagtcttagttttctgacactttgttgttatttttaagttttagatgaacagttgttgaatgttatcagatgcttttcaaacatctgttggaatgaccctgtcattttcctttggtctgttaatatagtaattagcagtatcttttctcattttgaactgtgcttattttaggctaaatacttgttagcattcacactttggttttgttttcaaatctatttagacttttctctaaccatactacaaaaaaatgttaaaggcagtttttcaggcccaaggaaaatgataccagatggaaatacggatctatacaaaggaattaaaagctctagaaatggtaaccacacgagtaaatatgtgccagtctcactctgtcacccaggctggaatgcagtagtgcaaccacaactcactgcagcctcgacctccaaggctcaagcagtcctctcacctcagcctcctgagtagctgggacaacaggcatgcaccaccacagctgtctaactttttattttttgtagaggcgagagtcttactatattgcccaacctgatcttaaacttctgggcttaagtgatcctcctgccttggcctcccagagtgatgggatttcaggtgggagctaccaatgtgaagttttaatatatgcaaaagtaaaatatatgctaaaatagcacaaaggtctggggggagaaatggaagtatactattatatactatgcctgaggtgacataatattacttgaagatagattgtgaaaagttaaagatgtacactataaacctaaagcaaccaataagaaaacaaagaattatagcttattagctaacaaggaaaagagaataaaaaataattaagaaaaataaatgcagaaaagtaaacaggaacaaagaacagtcaagaagaaaacaaatatgaagctgatagctttaaacctaatcatatcacaaattatattaaatgtaaatggtctgaacacccaattggaaagcagagattatcagattggatacaaccacatgctgcctaccccctaaagatgccacttaaatatgaagaaacatacagattaaacaaaaaagaatgggagaggatatgtcatgataacactaatcaaagtaagacagaattggctatagtaatatcaaagtagatttcagagaatgttaccagtggtaaagaagggcatttcctaatgataaaagggtcaatttatcaaaaggatctaccaaataacatagtttcaaaacacaacagggtaaaaactgcaaggagaagtaaatccacagttatattcagggatttcaatatccctttttgaacaatgatagaagtagtagtcagaaaatcagtaaggatatggaagatttgaacactatcaaccaaattcacgtaatgaccatttatgtaacactctaccagcagcagcagtgctttttaagtgcacacagaatattgatttcaagatttataaggctaaagtcatcacgacagtgtggtggtagcatataaataagcaaattgatcagtggaacaaatagagtaggagtcatcctaccttctgttttcataaagtactgttagaacacagccacccctgtttgtttatgtattttctatggttgcttttgtgtcgtaacagtagattggtagctccaatagagaccttatggctcacaaacctagaatatttacctcctacctcatacatgaaaagcttgcccaccctggaattgagagtagccaaatagacccacacctgtgaacaactgatttttaagaaagacgcaaaggcaattcacttgagaaaggataattttttcagcaaatagttttgaaacaattatccgtatatacaaaatgaactcaaatttcagcttgacaccacacataaatattaacttgaaataactgagacctaaatgaccctaaaactataaaacttgtaggaaaaaacctttttgactttatttttattttttatatttttttttttttgagaaggagtctcattttgtcacccaggctggagtgcagtggtgctatctctgctcacttgcagcctcctctgcctcccgggttcaagcagttctcttgcctcagcttcctgtgtagctgggattacagatgtgcaccaccacacccggctaatttttaaaatattttagtagagacagggtttcaccatatacccaggctggtctcgaacttctgaactcaggtgatctacccacttcggcctcccaaagtgatgggattacaagtgtgagctactgcgtcgggccctttatgattttagattaagcaaagacttcttagatacatcaaaaacacaaattgatgaattgaactttattaaaattaaacctcctattcgtcaaaagatactgttaaaagaatgaaaagacaagcatacaagaaaataatgcgtaaatccattttctaataaaggccagaatatcttcttagaactttcaaaacttaatgagaaaacaggaaacccagttgatcaatatgtttgaacagacacatcatcaaagaagatatagccaagcacacacctgccgtagggcctagccattccactcttcacttaccttctattttggggacacacactatgtgttagtttcctaggggctactgtaatagagcatccctttgttacagtatcccttacctgaaatacttagtaacagaagtatattggattttggatttttttttttcagtttgtgttgtatttgcattatatacttaaagttaagcatcccaaatcctaaaatctgaaatccaaaatgccagagctcaaaacgttttggaattagagcatttcagtttttagatttgggatgttcaacctgtaccacaaattgggtggctcaaaacaacaaatttattctctcaaggttttggaggctagaagtccttttgagactttggatagaatcttcctttgcctctcctagcttctggtggtagccatcgtcgttgagattccttagcttacagctgcataactccaatctctgcctgtgtattcacatggtattcttcctggctctgtctctttaaagacaccagtcatattgtactaaaggcctattatactccactataacatccaattaaatctgcccatagagtaacattttgtgctactggggttaagacttcaacatattttttggggggaacagttcagcccataacaaacaaaaagaaaattaatttaattatattgtatttagaacaggggttggcaaactatagcccataagccaaatccagcttgcagccatttttataaataaagttgcatgggaatatacctatgcccacttatttacatattgtgtatggctgcttttgcactttaataacggagttaactaattgcaagagagaacttaaagcccacgaaatctaaaatatttattatctggccctttacagaaaatgtttgctagcctattttagaaggtgttaagtgttgtagaaaaaaaaaaaatcagtaaaggggtataagaaacacagggtggttagggaagatctctatgaggaggtgaatttgagcaaaggctacaaggaattactctctatatattaacttatgaagatgtccactatgtagtgttaagtgaaaaaggttataaaacatttctcacttacatgatcccatctttgtaaaatagaaaagtgtgtatatttatacaatgtaaagttatataatacatgtataaaaaattttgcaagaatatccaccaaaatgttcatggtagttatctcttggtgggattatagtgcactttcacatggcattttttcagtttcttttcattagacatttaaaaaatatttttataaatttaattccttatgtgttattaagttatatcaaaggcttaatgtgtatgaaacaataatggaagattcaactccttgcctaagtttgaagttacttgttgtatttcaaagaggagcactagtacttaagctagaatttaagtgaacaaatcttaaaatggatttttatctctggttacatagaatagttgttagcaggcttaatttagtgctagtagaagaagaaatatgtgattgttaaagaactccgtctgtcataaatgttcctgtcatgtttctgtgacattacatagacgtcagggaagtttgcattaggtgtgggtgagccaataatgtttgcaagcgtatatcaaatcatagcactagggctgggcgcggtggctcatgcctgtaatcccaacactttgggagtctgaggtgggcagatccctttgagctcagcctgggcaacatggcaaaacactatctgtactaaaaataaaaaaattagctaggcatgatggtgccatctctagtcccagctactcgggaggctgaggtgggagaattacctgagcctgggaagttcaagctgcagtgagctgtaattgtgctactgcactgcagcctggtgatgggagtgagacattgtctcaaaaaaaaaaaaaaaaagcactagaatatttgaatactcttatacaagtgtttatgggtttattttattctgaagctcagaacatatctaaagtaggatactttctgcaaacccaaaagcctaagagcagatggggatttttaaagtacacatataataaaattatcaaagccagccttctgaacaagactctcctctctttacagtgaaacccaatggaaaaagcatgacatttagaagtagaagacttagcttcaaatccctactccttcacttactaattttgtgatttgggtaagtaattgatcttgtctgaattttttgtttttttattttacaaagttccaataaataatccctgccctactcacctgattctttaggatattaggagactaaagtgaaataatttatgtgacaacattttgtgtaatgtaaaataatatcctagtgttaattgttatgaactcataattgatactaatggaagagaacagagtggataatttaaaaactaatttaataattagttaattttgtgtaggtattaccaacttctggcagtttattcacagtaacactgtactgtgaaagatatatagaaattttcttcatcttgatccccacgcaacttattaattcaacaagcattattttgccttctatttggcaattttagttcatatactgttctacaattgtaatagtaatgttaccatagtaacaaagtttatattgacattctttttcacatgcaatgtaaatctaaatatattcgtgctttttatttcatccttaggttaagttagaaaatgaaaaaaaaatcacaatccataggtgacaaaaataatttataaagagcctaaccattaaatatttatccattgtaactctactgctttttctctcacttgagaaaacatatggaaatgaaagtaaatgagaatgaacaactatagggataatcttgaatttattctattttaaataaatcatttatgaactttgtttctctaacattaaaagtagcaatacttgttatacatcatctagctcctttcggcacactaccatgttatatcaccatagttgaggaatgattacagcttttggttttcagaaataatctttcctgtatttatggttactagttaggttttggcttcatagaagcttctcaagttacctgcaaatttcaaggaaggttagtgtatgcaatgtatggttataatatatgcatagaaaactctgcaagaggtgaggtaatagtgctattaatataattttaaattaaatattagtatcaacagaaggaaaggagggaaaaaataagcaaactactgtcaattctgtcaatttttttttttatttttttgagatggagtctcgctctgtcacccaggctggagtgcaatggcacgatcttggctcgctgcaacctccgcctcccaggttcaagtgattctcctacctcagcctcctgagtagctgggactataggtgtgcgccaccatgcccggctaatttttgtatttttattagagacggggcttcatcatattggttaggctcgtcttgaactcctgaccttgtcatccgcctgccttggcttcccaaagtgctgggattacaggcatgagccaccgcacccggccataattctgtcaatttttaagcaagccccaagtgaagttaactgtattgcatataatattttatatagtgttactgtgtcttcatctcttagatttggactatgaaatcaagtcccataatagatgtttcttcatcacctctccattacaatcttttaaaaattaggaaagattactttctaaatgtgaaatgtggaatctacctttgcctagttcgctttgcttgtgttccatggtactactcaaacaaatctaattgctttgaagtaatcataaattctttcatggacctcttgttctggagcagctttgttgcaagaatatagtacatttggcttggcacagtggctcacacctgtaattccagcactttgggtggccaaagaaggaggattgcttcagaccaggagtttgggacctgcctgtgcaacatagtgagacccccatctttacagaaaaatttttaaaaaattagctgggcatgctggcaagctgttacatgattagggagtgcataaaatcaagttagtatgtatatttaataaaacaatattgtgttccaagtgcagaactaggaagccatttctcatcaagaagagttaatagttttatttagaagaaaaaaattacacattaagtattttgtctttaataattttagcttttattttaggttcagggagttcatgtacaggttacatgagtatattgtgtgatgctgaggtttggagtacgattgaactgtcacccagttggtgagcatagtacccaatagtttgaaccttaagtatttatttattttatttattttttgagacggagtttcactctgtcgcccagcctggagtgcagtggcgccatctccgttcactgcaacctccgcctcccgggttcaagtgattctcctgcctcagcctcccaagtagctgggattacaggtgcccaccaccacgcccagctactttttgtatttttagtatggacggggtttcaccatgtaggccaggctggtctggaactcctgacctcagatgatccacccacctcggcctccctgagtgctgggattacaggcgtgagccactgcacctagctgacattaagtattttttaatttaaatttattttttgcataagtactaaagattcacatggtcaacattgcaaggctgcagagtatatggtggagcgtctccctaccaccctgatctctcaaataccctgtcacagccagtatttgaacttttatcctcctagagatactgtgcatatataaaaaaacgaatgtgtgttttgttttcttgtatattgttttgcccacaaataatagcaaatgcgttgttctgtaccttaacaatgtaacaatgtattttagataactttatgtttctgtacatatagagcttcctcattttttttaaatggctacaagtatttacatttacatggttttggtataccatcatttaactagtgtcccatcataatcaggttgtttcagccttttactgttaaaaacaatgcagtgaataactttgtacatgtgttgttttattcatatctgtaggataaaataaagtagaatcattagaatcaaatgtgtgtgttttaattttgattgatattgccgaactggctctctgccttgtttgggtagagcttttttctttgtttttaagtgaggtctaatttacaaacaacaaaactgaccatttttaaagtgttcaatgtattgggaagcttatgccaatttacactataacctgtagtgtgtgacgatactttcgttgcttagtctcacaacaccctgttgatactttttgggtttttatatttttgccaacactaatatgtaagaatggtattgggataatttttggtttgtttaccttttgttacatactgcaaaacagaactcataagtgtacagctcagtgaatttatcactgtccagatcaagatacagaacatgctcagcacccagaatgtccccttttatacccttcctcacaaaaaacaactgctctgacctctgtcaccaaacaccgtagacttttgcctctttttgaacttctgtaaaataaatcatgcagagcgtactttcttgccttttttctcttttaaaatttttttgtagagtcagggtctcactattttgtgcaggctggcctcttaactcctggcctcaagcaattcttccccctcagcctcccaaagtgctgatatgacaggtgtgggccactgcacccaacctgtctgatttctttcattctgtattatatatgagattcatccatgatgcatgtatctgttgttatttttcattgctgtgattcaattacttgaatataccataatttatcctagtgttaatagatatttggttgattttatttttcatctattttgaataaaacttctgtaaacattcttgtagatgtctttggaggtattaagcactcgtttcttttggttataccttatctgggcagattttgtttgtttttaaggtctaatttataaacaataaaattcaccattttttagttacaacttgataggaaacccatgagtctaacatttctgcgtttcttatcagcaaaaaccctgatggctgccttttttctgaactttgttttgagacggagtctcgctctgtcacctaggctggagtgcagtggtgtgacctcggctcactgcagcctccgcctcccaggttcaagcagttctctgcctcagcctcctgagtagctgggattacaggcggccgccaccacgcctggctaatttttgtatttttattagggacagggtttcaccatgttggtcaggctggtcttgaactcctgacctcatgattcactcgcctcagcctcccaaagtgctgggattataggcgtgagccaccatgcccagccaacttaccttttaaagaatgttggaaggtagactctcagagccgtggagcaaaggacaggcttacttacagtcttcaaagatacagataatgtctccctctagagtaaatggcagacatgcttcctgcatatttttcaagtttagggttacttaagatctgtctttctttcctgtgaagcagcctgttcaggtgtcatctgacttcacaatgccctgtgacagttgggactcaagcagctggcgcaagaaaatgctgatactctgactactgttatgagtaatacagtcctttgcttctgacgcaaaaatgtcatgccttttgccagtatccatgacactgtggtaggctgacttgttagcttgaaagtaaggtaaaatctcagtgcctttgaaacagttgacacagaattcagtgaattttgacaaatgtagtctttttttttttttaaatagaatttcgctttgttgcccaggctggagtgcagtggtgccatctcagctcactgcagcccctgccttccgggttcaaacagctctcctgcctcaagcctcatgagtagctgggactgcaggcatacaccaccacacctggcgtgtgtgtgtgtgtgtgtgtctgtgtgtgtcggggtctcgctctgttgcccatgctggagtccagtggcatgatctgggcttactgcaacctctgtttcacgggttcaaacagttctcctgcctcagcctcccgagtagctggcatcacagacacccgccaccacgccaagctactttttgtatttttaatagagatggggtttcaccatgttggccaggctcgtctcgaactcctgacctcaagtgatctgcccacctcggcctcccaaagtgctgggattacaggcgtgagccatcgcgtcctgccaaatgtatagagtcttatagtcaccaccacaatcaagtcatagagtatttttatcaccccagatttcctttatgcccttttacgtgtgccttctctacctcagccctaggcaaccctggatctgctttctgtcaccttagttttgccgtatcaagaatttctgaggcacatgcctgtaatcccagtgctttgggaggctgaggcaggaggattgctcgagcccaggagtttgagacagcctgggcaacatagtgagacccccatctcttaaaaaaaaaaagaatttcctgtaaatagagttatacaatgtataacctgttgtgtctggcttcgtttattcagtgtaatgcttttgagattcattcatactactgcatgtatcaccagttcatactcttttttttttgtttgctgagtagtattctattatatgtctctaccattgtttgaatgtatgtttatacattcagcagttggtggacatttggattgtttccagtttgggacttatgaatgaagctgctgtgaacatttgagtataagtcttattgtgggcatatgtttttattttggggagtacgctctttggagtggaaataccaagtcttatggtgtgcttttaacttggtaacgaactatcaaattgtttaccagagtgtctgtatcattttgcgttcctatctgagtagttctaatttatatctctcattttgagtgaggttgaaagtatcttttcacatgcttgatttacttgtatttccttttctataaactattcaaatatgtttgcctgttctattaggtgttagaattttttagtgatttgtaggcattctttatatatcgggaaaatttttggccatgctatgaattacaaacatttttttccatttgtcaggtatcttttaaggatacatattatggtgagttttgccatgtagaaatttgtcagtctgaagttcttaatctcacagttatttactaatataagacttcacataagaaagaaacaagatatctcttttaattaaccttaaagtataaattatgttttctagcagtgttttccatagccataacttcagtgggaataaagaaaaataatgtgaagacttaagttttctacattctcataagaattttaccaccttttagaaacacagctacagcatggaaacaagattgtgtcttaaattatgtgtatataagagaaaaaatattaaaagtaatattacatgtgtctgttgcagaaatatccgcgcaagatgttgacgttgcagacttggctagtgcaagccttgtttattttcctcaccactgaatctacaggtaaggttcatgaaataccctatcttctaacttcacaaattaggtttatatatttttatattattatataattaagcttatgtttaattattatgttcatatattctttctaggataatcgagagaataatatcttaaattgattttaataaaaatattcttgataatctgtttttgtataatttgagttgtaacagtcatcttacatgctaagtcagtaatttaagtcagtaatcttaaatgctgtatatcaatactaacaataactttaaaatggggaaggaaagaagtgtgtgggtttttttttttttcttcagtaaatgaataggagaaaatttgttaaatcttgttaaattttacgtcattcatactacatgctcttcaggtattgaagggctgctttcctgtgtctgtaagtcctcgtccccaaattacagttacccagatatctaatcattctataggatctggtttttaaccctgtgcatgctgattaccctactgattcttctcttagttgcctgtattacatttaaaatagaatactggctggacatggtggctcacacctgtaatcccagaaccttgggaggcataggcaggaaaataacttgagtccaggaattcagtctgggcaacaaagcaaggccccatctctacaatttttttttttaattagccaagtattagtccattctcacactgctataaagaaatacctgagactgggtaatttataaagaaaaggtttaattgattcacagttctgtaggctgtgcggaagcatggtggcatctgcttctggggaggctttgggaagtttccagtcatggcagaagacaaagggggagtgaggcatctcacatagcgagaacaggaggaagagagagagaaagggaaggtgctacaaacttttaaatgaccagagctcacaataactcattcctcatccaccatctcgaggcagtaccaagtgagaaatccacccctatgatttaatcacctctccaccaggccccacctccaacactggggattatgatacgacatgagatttgggtggggacacagattcaaaccatatcatgcctctagtcccaactactcaggaggctgagccaggagaatcatgagccctggacctcgaggtcacagtgagccatggtcacgccattgcactctatcctgggtaacagagcaagaccctgtctcgtaaaaatatttatgtgtacgtgtgtgtgtgtgtgtgtgtgtgtgtatgtgtgtgtgtgtgtgtgtatgaataatactatcccagctgtcccccttactagctgtaggaccttggtcagtcattttctgtacctcaatttcctgatctatgaaatggtgataataaaggccactacctcctagggttattagtgaggattaaagaagttaatatagaggccaggcatggtggctcatgccagtaatccaagcactttgggaggccgagatgggtggatcatttgaggttaggagttcaagactagcctggccaacatggtaaaaccccgtatctactaaaaatacaaaaattagccaggcggtagtgccgcacgcctgtaatccccactactcaggaggctgaggcaggagaatcgcttgagcctgggaggcggaggttgcagtgagccaagattgcaccactgcactccagtctgggtgacagagtgaaaccctgtttccaaaaaaaaaaatctgagcttggtagcacatgcctgaaagtctcagctacttgggaggctgaggtgggagagtcacttgaacccgggaggcaaaggttgcggtgtgtggagattgtgccactgcactccagcctagggtggcagactgagaccctatctcaaaaaacaaccaaaaataagttaatatagaggaaatatttggacagtgtttggcctacagtaagcattataaaaatgatagttactgcatatttattataaaggttattgttgtctttgaataaaagtttctttatgaaaaaaataaacgtaatataccaaaaccaatctgactacagtggcactcatacttactttgatctgaacatcatttttataaagttacgtaactatgtggtagctgagatatacccttgtttcatgttgagctagtgatcagtgaaaattctcaggtggtttttacatgagttactcttaaactagttctccctcacccaatgtatatttcttattacctaaataggatatatttcctctgttgctaatttcattttatcagttttagcctggtgttctactctttcagcataattttaaatcccaacattttcatccgaagtgttggcagttgtttgtagtcctgtcctctgctaatttgataagcatgtgtgtctgtcttttcccaagttgttgattaaaatgttgaaaataacaggactgcattagctacctgttgctgcctcacaaatactccaaatcttcaaggcttaaaatgataataatacctctcatgatttgtataggacaagactatagataggcaggcacaatcagacgtattcatctttgctgtacaatgtctggggcctcagctgcaatattcagactgggggctggagtcatcttcagactccttcgcttatatgtctgttgttaatggtatctgcaggctgagggctttgctggggccattgtccaaaacaccatacgtggcctctttttatggccctggctttcttacaatgtgtggctgggttctaagggcagatatcccgggagagagaaagaaagctaattggagtctgtattcttttaatgatctagcctctgaagtctcatagcacactccattggctggagtggacacaaggcacccatacagatctgatgtggttgggggaaatgcagtccccacctcttcatgaaaagagtatgcgtgacatcgtaagaaaaacatgtgggatgggataaatatgtaggtgtggccattcttaaaatacagtcttctccaaggattgagggcatgcacttcagcatattctacttaagactatcctctaattgacttttttcttaagtcagtttttttatatatgggtaatcaaatataaatttgagtatgaacctataaaagtagcaaaatatcagcaatttcataatgttcattgtaatatcggttatagtatattctttttttttttgctttttttctttttttttgagatggaatctcgtttcgttgcctaggctggagtgcagtggcacaatctcagctcactgcaacctctgccccccaggttcaagcaattctcctgcctcagcctcctgagtagctggaattacaggtgcaggtcaccacgcccgggtaatttttgtatttttagtagagacgggatttcaccatgttggtcaggctggtctagaactcctcatctcaggtgatccatccacctcggcctcccaaagtgctgggattacagacgtgagtcactgcgtccaacccagttatagtgtattctaattcacatttcttcatcttgccctataaacattcaaaataactttatcagatacctttcttaattaaaatactttctttttacaatttaatctcagcctggtagccctgtaaaatgggattaatttgacatgggatggtattattgaagctgtgtctcactttgaaaaacggaacatttgccccttttttttcgagactgaatctcactctgtcgctcaggctggagtgcagtggtgtgatcttggctcactgcaagctccgcctcctgggttcacaccattctcctgcctcagcctcccaagtagctgggactacaggcgcccgccaccacgcccggctaattttttgtatttttagtagagacagggtttcactatgttagccacgatggccttgatctcctgacctcgtgatccacccacctcggcctcccaaagtgctgggattacaggtgtgagccactgcgcccagcccatttgcccatttttaatatttctcttattctgtgtgattaaaaattattcatactgagtctctaattatatctttttagaactctagagtatatttcatatttaacatccctatgattactttagagaaagtataacaagtgattttgccaaagaataaagtgatgtctagggaattgtaaggtctgacccagtatcagagagtaacttagtagagattctccactggatgaaggaccatgctattggaaattgagagtaatatatgcactaagatttacagtaggcatttataaataacagcaagatgatataaacagaccacattataagtttgaaacaaagaaatacacattccagctctgggttttacaggctttgtgagaggtcctgggattccatttggggatacaattttgactgcaaaaactgtttttaattttttctgggctcactgcagccttgacctcttgggctcaagcaatcctcctgcctcagcacacgaccctcacccccaagtagctgggactacaggcgtgtgccaccatgcctggctaatatttatattttttttgtagagatggggttttgccatgttgcccaggctagtaatttttaatctcaaaaacacttcatgggtaactacccaggaaccccacagcaaataggattcattgaggaaagccaccttaaaattgtggacattgaagctagagaaaaagaataaaatcatgtcaaatagttgggacttttatcttggtagtaggtagccactaaataatttaaagtagacaaatgtcctaattattttagaacagtaactgacagtagtatgtaagataaactggaaggaggtcagactgatatagtatcctgtgcttcagcagtcaaagtagcattggaaagaagatgttgatatgcttattaagcatatagaaccaatacagtgcactattgttaagttggaggttagaggaggctaattggagatgttggaagatgactacagagtatctgtcctggatgtctggatgggagtggtgctgttagcagaggcagagaaataagaataaaaaataataagtttgaaaagattatgatacataatagttttggacatgctcatttaaaaatagctatgggatatctcaggtagatatatgtctaatgggctattgaaagcatgggggtttagtgctagagatagggattgagatgtcatcaatgtggagtaggtgataggtaaagcatgtagttgtgtttaattctcttttacccaatctgattctttgtgttttgttttgtttgttttgttttgttttgttttttgagactctgtctcactctgtctcccaagctggagtgcagtggcgtgatctcactgcaacctccacttcctgggttcaggtgattctcatgcctcagcctcccaagcagctgggattacaggtgcccaccatgacacccagctaatttttgtatttttagtagagactgggttttagcatgttggttaggctgattctttgtttttaaataggggatcctatcccatgcatttattttcactctgttgtccagggtggagtgcagtggcttactacatccttgaccccttgggctcaagccatcatcccacttcagcctcccgaatagctgggactataggcgtgcaccaccatgctcggctaattttttttgtttttagtacagatggcatctccctatgttgcccaagctggtttcaaactcctgagctcgagcgatcctcttgcctcggcctcccaaaagtgctgagattatagacgcaaaccatcatacccagggccatgcatttattcttaaaactaaactatttggccatcttgttctattcttcctgttttgtattggtcccttgctgtttcctttgttgtctgagttttgatgtgtggacaatgtatactgtctgtgaccccaactgtactccacaacagcattcaggactgtagaggagaccaccactgcctgttttctggagagtttagtttagacctgggatctaaatggagggacaggatacgttgtggggcaagtatgaatcatgctgcaggcagtctgtgtttcttaaagaaatagtttataccatgggctataaagcatgaatgggtttttcttaattcagctctattatctttataatttgtatatttctttacaaattcaggcattaaattctaaccatattaattttcagttgtgtattgtctttttctgtgtctttagggatattttagtgacggttgagggactctacattgagtgctaccagctagatatcattttgtaccagaaaaattcagtccatttatatattttctattgttcctttttaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggctgtaagttttgtttttgtcttatttcagactttgtcatgactattgaactgcatttttaatgttgtcctttcatctttataaaatgtagtaacttgtggacttagtgacttggacatgtttggtttttaaaaaataagcttagaagtaggaaccacaagtctcctgtctttcctgaaagtcaagcagtttcactttactagagaaatatttgacatgagaccccccccaccacaggaaagtattgttgaattgacataatgatggtaattctcagtatcccttaattgctgagaaaatgcacgtgtaaagcagctacctgaagaaagcgaacaaatactggagtaaatcctttttttttttttggtgacagagtctcgctctgtcacccaggctggagtgcagtggcatcatctcagctcactgccctcccgggttcaagcaatcctcctgcctcagcctcccaagtagctgggactacaggcatgagccaccacgcccggctaatttttcatatttttagtagaaatggggtttcgccatgttggccaggctggtctcaaactcctgacctcaggtgatccacttgcctcgggctcccaaactgctgggattacaggcgtgagccactgtgcctggccttggagtaacaaagtaaacaaaataaacttactatgatccaaaagtgggttatctaatttgtggatcacccagactttactgttttggcatttgcttttcttccaacgagtttgggaaagcaataagaagagaaatataaatgaatcattttggcttctacttagttgcctcttacaaacatatgtatatattacttttaaaaatatacttaatggagaaatcagttgatatttttttccagttataaatgaaagttgattttacatagaaaattaatgtgaaacaaaccagttgatgacagttaggatggatgtatatatattacttcctgaaaagaagtgtaagagttgggatagaaaagaaattgtcatcagcctttcattgtgtccatactttttgcttgggtttgatttttttcatctaatttagatcgcaaatgccttgggtagtatataaattgcataatatttgtggatataaagctttctgaaagatgctaattaatcccttttagtgcctccagaaaaacctaaaaatttgagttgcattgtgaacgaggggaagaaaatgaggtgtgagtgggatggtggaagggaaacacacttggagacaaacttcactttaaaatctgaatggtacgttattttaaatttgtttcatgttagatttattaaagttagtcatttttgctggaatttttattttaccaagtaataatattaaatgctattttaaaacatttaattttttattctgtaacatttcaaatatatgtaaaagtagaggccaggcgcggtggctcatgcctgtaatcccccaggcgcggcggcccatgcctgtaactccagcacttacggaggctgaggtgggcagataacttgaggtcaggagttcgagaccagcctggccaaccagagcaaaaccctgtctctaccaaaactacaaaaattagccaggcatggtggcgggtgcctgtaatcccagtgactcggaggttgaggcaggagaatcacttaaatccaggaggcggaggttgcagtgagcccggattgcaccactacactccagcctgggtaacagagtgagactccatctcaaaaaaaataaataaataaaaaataaaagtagaaagaatagtagaatacccatacatacccatcactcagcttcaacactggtcagctcatgaccagtcttatttcaaaggtactctttgcctatattgtcttgaagagagaatcgcgggcatcatatttcatccaaagatatttcagtatgcgtctctaaaagatgaggacattttaaaaaaaagcataacaacataccactgttacactcagatataaaatattacattttcagttagtgttgatttcccctattgtctcatgaatatgcctatatgtataattttttttacatttgtttcagtcaagattcgaataagctccatactttgtgaatttatgtcttgtctcttaaattataggttctatttgttcttttttcttacatttcagttgttaaactgttatacattgtacattgtttaacatattcccttgtctttttttttttttttttttttttttttttttttttgagatggagtcttgctctgtcacctaggctggagtacagtggcatgatctctgctcactgcaacctccgcttcccaggttcaagcaattctcctgcctcagcctcctgagtagctgggattacaggcatgtgccaccatgcccagctaatttttttctatttttaatagagagggtttcaccatgttggtcaggctggtcttgaactcctgacctcgtgatctggctgcctctgcctcccagagtgcttagatgatagacgtggccaccgcgcctggcccccttgtctttttctttccaaaaaattgcttttagatctacagatttcatcagatttgggtttgattttttttttttccccaaaaaaatattttgtaggagtgatgtgtacttctgtcaggaaagaccagataatgtttcactgtttttcttttttctgatactaagattgagcagtggtttcgggtgttgtcagccttattcctttatttactaagtttcccatttgttttttccaaacagaaaagttgaaagagttttacagtgaacactcttgcataccctagattctacaattaacattttactatctttgctttatcacctatttatctatgcatccttctctccatctctcaatctatctcttttttatgtatttcatagtgagttgcagtcattaatatacctcacccttaatcacttcagtatttcatagtgagttacagtcattaatatacctcattcttaatcacttcagtatttacatgaactagagttcagtattatgtttttaaataaaatttacatatagtgaaaacacaaatcttagtgtatcattcagtgagttttgacaagtacagacacctgtgtaactcaatcagtatcaagacatagaacatgactaacacacctaaaaagttccttcctgctccttcagtcaatcccagcaagtgccccaccccatgagcaactacctgtctgatattcttcaccatagattattttttcctgttacagaatgtctcatataaatgggattatatagtatatactcttctgtgaaaagttttataactcaacagaatgtttccgaaatttaatcatgttgttttcccactagtatttcccttacagctttgagcagtcatcagtgattataatttgtatataaattacaaaactatggtattctgtgttttgttttagctgaaatacttaaagaaaaacttgcctttatcaactgtggtttaccctgaagtacagttcagataggagaagcaagataggtttaatatttttccttaattaccagttttataattagttgattccctagtatcctccaaaggtagaataatgagggcttttctttctcattataaatttatatttaaacatatttgatatgttttaactcattatggattgtcccatctttgatcagtggcagtttactcaaattggctcattcatccttttttttttttttttttgagacagagttttgctcttttgaccaggctgtagtgaagtggcgtgatctcggctcactgcctcccgagtggctgggattataggcacccaccaccccgcccggctcattcatcgtcttgacacaacttccttagcctttgatagctctctgatataacatgcttttacagggtcatcatgtatttcctcacccagacctggaatcaaccttttcccaaaactctctggtttcatttagtgtgaaataatatttacagactacaatctgggtgctacaggaattcatcactactggtttgtcatagtttttagattttttagattttttcagtcgaaagagctaggacatgttttgtggtttgagatataatactatcttttaaaaatacaaattcatactgatattttcagtttaaaattagggctataggtttttacataattatatttacctgacgtctacatcttctttcttatgaactgaaaaacatagttgacaacaacactaacataattattcatttgctttatcctacggttaatacagcagctgcagaataataacaacagtattagcaccaacaaaatgattaccaagaatgattttaagattgtttttctctgtgaaggatgtgtaatagtcagattactgtgttttaatgttacttggaatagttcttttctatgtggttatactacatactcagtacacaagttcatatgtttcattttgcttttaatttttaggaatttttcttaataattatataaaacaatccaaaaagtcaaatctattaatagtattaaggcttgttcagaaaagtctatattctattcctgaatcctctaccttatttccttctccttagaggctaaccatttttgttttggttcaatttggggtttggtttatcctatttttaaaaacagtgttgtatatgaatatttttaattgaggcataatttatataattgtaaataaatatagtaatattacttgaaactttccatggtgatagaaatcagaaagtagttgcctaagtttgactagaaagaggctaagagattttagccctaagactaaaggctaaggggtaatagaaattcttacccctaacctcctgtcaccttctagcatattgtgcttaaagaaatttgtggtacagtaagggttctgttttaggaaaaagaaaaaacagcactgggatcacaaggaaatagataatttttggagaggagtaagtggggatggagcataaaattttaaagcacaatatttttagactacaaatttgaaaataattttatgttttaagatatagatcaaagttaattttaaagaaaggtttatttttaagaaattttgttagtgaccagcagttatattgcaaagtttgctacaacaatctaggtctcatcaaactctttgcaagtaatttttttcactctaattttttcagatgtgtttttaatgactgattcttcaattttttgtatttagggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaaggtagttataaacctgaatttgagagtttatttgacactgtagtcgtttacaaattaaagtagtttttatatttagattttttaagattttaatgtagatttttagattttaattaatgtagtttttagattttacttttttagattttaattaatgtagattttagattttaattaatgtagaaacaagcatttatcttagtgatttttatgaagtcattttatcaataatatcaaatagaatttggaaaaagaaaaatatccataatccaaccacacttaacagctgttttcactttgaatgttttctgttctcaaacatcttacaccattgtaattacagtatgtatgttccatttttattcttttttaaaaatttgatatcataaatatttgtcttttgacatatgaacctgaagagattaacaaatgtaaattaacaaggagaactgaagattctttagaaatctttttttttccattataaggtatatagcatagcataattttcagagaaattagttcatttggtaaggataaattattgtaaaataaaggaaggacaatataaagagtatatttgagtttgtatatgaaattggaaaacataataaaccttaggatttattttatttttcagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccaggtaaattgaaagttaccgtttattcaaatagtccttctttcaaccctctaatcttaaaaagtttcagtcattttctaaatgtctttaagtttctggttatgtgaaatattttgcttgataacctcttctgggttgttatttcaaacaaggggaatcaggaagatatccagatagaaaatacagctttgctaaatacagtagcctttaagtaaaacatgaaaatgatatagggtgataggaaatggcttttttttttttttcttctagagacagggtctccatttgcccaggccgctggctcactgcaattttgaactcgagcttaagtgatcctcctgccttagtctcactacaggtgtgcaccaccacacctggctttttaaaattattattattttttgtggagatggagtctcgccgtgttgcccaggatggtctcaaactcctggccttaagcgattctcctaccttggcctcccaaaatgctgggattacagatgtgagctaccactaccagcctagaaatggcatttttgatgggtgttacaaagaatacaagtaataaagcaaattaagtagaggagcaaaaataaagagattataaggataaggtagctagtgtagggattggtgtgctgcagtccaccaaaatcagcctgtgacttgtttttgtaaataaagttttactggaacacagccacactcatttctttacatattgtctctattctacagtggaagagttgagtagttgcaaaaagagtctctggcccacaagcctaaaatattagtaaatattttatctacctttttatagaaagtttgccaaccactgaggtagaggaagggattgatagggagcttgtaagactgaaaatgatagtatacccaaagatgatgctaccagcaaaagaaatacttggagcttttaaaaaggctatcaccatagcattcagctatccatactcttctctgttttgattccatttatcacaaacagtatgtctttgcttttgttgctctggtcacagtgagcttgttagggaattgggctaatgactttactacttctctccttaccccacttatctaaagtgctcagaatacaatcagaaaaagcaataaaacaaaattggattaatgcttcatgttgtacagagaatatacatacctgaagttcttcaaaatgtggtattaagtatagaatcttaattcagtgctacaaaaaagactgatgtttattttgtatctaatactaaattatcagagtaatatgaccagttatttatctgtatttaatctcctctttttttctgaaagccaagtttaaaagccaggaaaacttttgtttttcttgattgggctggatatcttccttttgcctgtccacatctacgctctacccttctctttgttgtgtcatgctgacctgtatagatttcatctgtgggtttccattctttctagcttccttgtgactgtggttaatggaaggaagggactaggcaggagagaagacagaagaaaagtgaaattggcatgttgattttccctgcttccttccaggaactggctgtctttttttttttttttgagatggagtttagctcttgttgcccaggctggagtgtaatggcatgatcttggcttactgcaacttccatctccctagttcaagcgattcttctgcctcagactcccgagtagctgggattacaggtgtgtgccaccatgcccagctaatttttgtgtttttagtagagatggggtttcaccatgttggccaggttggtctcgaactccagacctcaggtgatccacctacttcagtctcccaaagtgctgggattacaagcgtgagccaccgcacccagccggctgtctttcaacttagggtcactacctgtcaagacagccctctctagctgaccggcttctttcaggttctggtacttcccctcatccctttgggcctagaggtagaaacagctctaagccccagagtactaactgcactgtctaaggattccatatactctgcatgtagtccctttatgaagccctccttgaattattctaaatggagtgtgccatctgtttcctgcagaaatcctaagttatattacaggccctgtggaagaaataaagggaaaaaaggaaagataatagatgtttccatacttctaaaaccaaataactttactgatttggactgctttttaacttacacttatttctctccagaggttgagtttaatgtattagtcttgtgtcaataaaatagtttcaagaggctgaggcaatagaatcacttgaacctgggaggcggaggttgcagtgagctgagatcgcgccattgcaccattgagctccagcctgggcgacagagggagactctgtctcaaaaataaatagtttctaggctgagcgcagtggctcacatctgtaatcctggcactttgggaggccgaggcaagtggattgcttgaggtcaggagttacagaccagcccggccaacatggtgaatcttgttgatactaaaaaagtacagaaattagctgagagtggtggcgggcacctgtaatcccagccactcaggaggctgaggcaggagaatcgcttgaacctgggagaggtagaggttgtgttgagccaagatcgcaccactgcactccaacctgggcaacagagcaaggctgtgcctcaaaaaaaaaagtttctgaattttaacacaatttagaagaccttactaattgaggttttctgttgtttggtttgctttgtttcagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagtaagtacataagtatatgaagaagtaaagctattggaattccagatgtgaactggttctggttttaataatatagcctcattgcttcttagtttgtgatcattttattcaaactgcagtattttaacgttttaatttttaaggacattaagatgtaaaattgaatatggatcattgatagtataagtctatttgatacctaattaaattatcatggaggccagatgcggtggctcacacctgtaatcccagtactttgggaggccgaggtgggcggatcacaaggtcaggagtttgagaccagcctggccaatatggtgaaaccccttctctattaaaaatacaaaaattagccgggcgtggtggtgggcgcctgtagtcccagctactcgggaggctgaggcaggagaatcgcttgaacccaggaggtggaggttgcagtgagccaaggtcacgccactgcacttcagcctgggtgacagaacgagactccgtctcaaaaaaaaaaaaaattcatcatggaatggtgacttagatacatctatcagaaaaccgttaactgttgataagtctagaacattttattcaaggagacttgtccagagatactcctaactagagaatcatatcctgaatcattaaaaccacactgtctagcaaactacaccttagatccccactatcaaaaatatacttgtattataccttttattcattttttttctaatagcacttgataagcccctgggaagcggttgatcctggaattttggttggttagtttttattttccttttttctcctatagataatatatatgatatagaataaaaaaggcacaaaaagagtgtacagtctaaagtaagatcctcactgcaaagcatctgatgttactaagttcaagaaataatcccgtggcatagatttttcattttgagaccttcctatcacagactcatctcttagttatcaatggcagtagctgtggctgaaaaaatcccctaccacctatatccctttacttccagctcttctagaggtttaggtcatgtgacttgagaacatcaaaggcagaaaagtacccttctgccctaagatttctctcataaatgctgagaaagaaatcaattttgctattgctgctgtgggagtcctcagccagattgctttgtcttgaccaggaattcttaaaatgagatacatggggaggagttcatgaaatagtttaaaatgtaggtaaaatattgtggttagtgcctgtgtgcatttttaatggacaagtgtacataatctttgtcaaatcaatgcgtgaatgaagtctctgggttccctttatgttaggaaatatttccagctcataatttttttttaataatttcatgttctttattctgtttgagtgctgcactgtactcatgtgaatttatctattttaacttctgtaccagcagcctttttcccagccttcctggtctgcctgtcctatcctttctgttttgctgtctgtaattgcctcttcatgattaacatatcagtacttaaatttttttttttttttttttggaaatagtgcctcactctattgcccaggctggagtgcagtggcatgaacacggctcgctgcagcctctacctccaaggctgaagcgatcctcatgcctcagcccccaacatagctgggactataggcacgtgtcaccatgcccagcaaatttttgtatttttttgtggagacaaggttttgtcatggtgcccaggctggtcttgaactactgaactgaagtgaaccacatccctcggcctcccaaagtgctgggatcgcaggcacgagccaccacacccagccttactgcttagattttattcaactcctgtcttattctactgactaccatatcttgttattatattcataaaaattttgagaaatcagttaatgccattgatttttttaagacaaactttttacaaaaagcttaacaatgataagtaaaaatgaaatgtcagttgatattacttattgctaaaaaattaaaaattatatgctacatttaatggctattataagttttgaaaaattaatactacaggtatttttaaaaccgaatttaattactggtatttaacaatttatgttttggctgggtatggtggccaaaccccagctacttgggttgctgaggtgggaggatcacctgagcctaggagctgaaggttatagtgcactatagtcatccactgcactccagcctgggcaacagagcgagacactgtctctggaaaaaaaccactatgttttatggattgctttttcagatggttagtgattatcacaacaatactgtgaatttgtttttattacatcccatcactctcaatcatccttatataaagtaataaacttattttagtacatttatcttaatttgttttattattcttgtgaatatttaggagtaagcaatgtgtttaaatagattttccagtttgattttcagcgataagtagtatcaacttatgtttatttcatttttattttttactgttaaaaactttattttaaaaagtttttttctttaaaaaatcatattaactaatttttcaaaatttttataaatataattagaagacctggtatttaatagaataagagaggagttgaataaaatctaagcagtgatgtgttgatcatgaagaggcaattacagatgacaaaacagaagtgaggacaggcagaccaggaaggctgggaaaaggctgctggtacaggagattcaagtagataaatacagtgccagcacacaaacagaataaagaacatgaagttataagaaagagtgatgcctctttagttgttgctcagaatacatttttacctttacaattttgaggttagaaaagagttccagtataattgatcaggctatcaccctgactaaaggaagagccaggtgttttgtgctgggttgggaaaatgctggtataaagaggtagagacaccatgcaattggagggcaagagtattaagaacaaagtaaaagaataatttgcagaattttattttactgttaaaacctttttattttaaggagtttatgtcttttctttaggaccatctaaagcaccaagtttctggtataaaatagatccatcccatactcaaggctacagaactgtacaactcgtgtggaaggtaaaaaatcacatttatattttatctcttataaatcttttttttttttttttgaaaccgagtctcgctccattgccaggcaggagtgtagtggcgtgatcttggctcactgcaacctctgcctcccaggttcaagtgattctcctgcctcagcctcctgagtagctgggactacaggtgtgcgccaccacgccccgctaatttttgtatttttagcagagacagggtttcaccacggtggccaggatgatcttgatctcttgacctcatgttctgcctgcctcggcctcccaaagtactgggattacaggcatgagccaccgcgcccagcccttataaatacattttgtatggtattatgaatggaggtcttttaaatagataaatttttattcattttaatagcaaagcatttgattactatttttactaaatagaaaggtaatgctttatatgtattaatattatatagaagtcaggttcataaactacaaataataccttataggtatttaagtacagttctgtgaaagtataagttctataagaagaggaatgttgtttttgtactttggaattttccagagtaactcagaaaataataaaagtttgtgataatcaaaatgtatgctggtaagtgcatgagtagatcatactaaaaaagaaggtagaaaaatactcaagcataaaataaataatttagacctacatagccacagtgcagaattgatacagaaccaaaagctaacggaatgatgctacttacccttttttagttgaggtcatgcttttactcttcatttagtatgtactagttttattttagaaccaaatttaaaatggagattgtgaatcctttccagttaaatatttagagatttgacataatggcatgatttgtgaatatgaagaaaaactgattttttattcaagatttatgagattatttttaaaaataaactattttattacagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaaggtttgtatctgtgagatggagcctgactcttgggtggaaaaatggtggttaggtatggacagggctcccataaaaaacacaagttatctaagactgtctcctcagtatcagggataatcacttgtttattttttaattttttaaattttataaataatgattttctttttttcagagactgggtctcgccaggttgctcaggctggtctcgaactcctgagctcaagcgatctcccctggcctcccaaagtgctgggattaacaggcatatgccaccaaacccagctagtgatcgcatttttaggaatcagtcagcagacaaatttcatcaggatgcaagaacatttccatcactacatgctcacttaaacttcacagtaagctacttcattcatttaagcatattctgattacttacctggtttttaaaatattatttcaagattttgagaactttgtatacatatgactgaaacgtttatctgtagctttattcgtagctttcaaagaagaaaaattgcaattacaaaccgaaagcatttgaagaatttagggaaagcaaatttttttttttctttttgagacagtcttgctctgtcgcctaggctggagtgcaatggcacgatctcagcctctgcctcctggcttcaagcgattcttgtgcaccagcctcccaagtagctggaattaaaggcacgcaccacaatgcctggctaattttgtatttttagtagagacggggtttcaccgtgttggccaggctggtttcgaactcctgatgtcaagtgatccacctgccttggcctcgtaaaatgttggaattacaggaatgagccacagtgcccagcggggaagcaaaatctaagtttaaaaattgactactttacctgtaagttataataaagtgcttttaggcaaggaagtatatgctacaaaaattgataaatcacatgttttggaaatgactgtaaaatatggaaatttcaaatttgttaatatttattatttcaatattcaaactttgttttaaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagaggtatacctggctagaaacatctaaattgatatcctttttctaactctttaggcagctttttcttttgcttatagtgttttggtccgttgaaacgacttccaatttatcatagcctcactacttactagatgtgtgactttcagcaagtcatacttaacctctctgaattacagtctctttatgaacagagtggggttaatactttcttctttttgtaccccaatatgattttatcgtcaagggaaaactcctaaaactatagagtatagagaaatataagagtccaacctttgctgctgattagttatatgttctctgtacctcatccttcacatgagaaaatagtttcctagagcatctggatgacttgtgtaatgtcttagaaccatcagatagaggaagcagaactagaactcagatttccttatgtctttcaattggaagtagtaacaaaggacagaagtaatgaatcgtagcgctccagtctgtgtgttatggtgctgcttaagtggttataaagtgatacaacaactttgaagagaaaaaaactcagtttatagtcttttgttgataattaataattagaattcagctgtgaataatatggttaattagagaaaagccctaagcagagagattcctgccataaagtttttgagctttagtcataatacaggctgtttggacttacatgttattagtgtacagttttaataagcttggttatctagtttactgactttatcaaattaaaaacatggtggagcttaggaagtcctgaaacaggctggaaataactatagaaacttcttaaaaaaaaataaatacagggtctcactctgttgcctaggctagagtatggtggcatgatcatggctgactgcagccttcaactcccaggctgaagtgacccttctgcctcatcctctggagtatctgggactacaggcacatgctgccacactcagctaattttatttttttgtagagagggaatctcactgtgttgcaaaggctgatctccaacacctggcctcaagcgattcttttacctcaaactcccaaagtgctggtattacaggcgtgaaccactgctcagagccaatagaaactttttaaagcagcagccgatgcggtggctcacgcctgtaattccagcactttgggaggctgaggcgggcaaatcacctgaggtcgggagttcgagaccagcctgaccaatgtggataaactccgtctctactaaaacaaaatcagctaggcgtggtggcacatgcctgtaatcccagccatttgggaggctgaggctggagaatctcttgaacccgggaggcggaggttgcagtgagccaagatcatgccattgcactccagcctgaacaacaagaacgaaactccatctcaaaaaaaatagaagctagcataagttgtggagacattaagtttgggtaggtagtcgtatgttgctcagtaaccctgaaagcatcacattagagtagaatataaaaattgttcattttttggtaatattgaatcattaagaaaaggtaaaatctgtttaagaaggtaaaggagcatgtaacttcatgagtaatagttaaggaatatacattcttattgaaggtataaatttcaataaaacattttctaatatgtacagataatatactgtataaataagaaaaattttagtggtgcatgctaaaaaagataaaaataaaggaagtttgttttgttttttgtttttttgagacagagtctcactctgtcgcccaggctggagtgcagtggtgcgatctcggctcactgcaagctccgcctcctgggttcaagtgattctcctgccacagcctcccaagcatctgggactacaggtgcccaccaccatgcccagctaatttttgtattttcagtaaaggggggtttcaccatgttggccatgctggtctcaaactcctaacctcaagtgatcctcccaccttaacctcccaaagtgctgggattacagacgtgagccacagcgcctggccgaggaaattttttaagatacccttttttccaactcgcaaactaggaccgttagtgctttcccctaggtcttactgctttagtcgtcttgctccttaggctgttctctcttgtaggtaagacatacaaaaattgtcagactctataaaatccagagtaatttgagatcattgttttataaattctaaatgtaaataccatcattgttcttaacaatgtattttttatccactgcattggcaatacttttacagacagttttacctgattaagcttgaatccagtacacaaaagacaatgcttacttagaaaactgcagttttaaaagaaaattaagtggtcatgaaattataatgtaaaaataaattacggtattaacttgactttttcattatggaaaaacatgcttaatctgctattcttgctttagggaacttagcagagagcaaatgctatttgataacagttactccagtatatgctgatggaccaggaagccctgaatccataaaggcataccttaaacaagctcgtaagtccaaactcacttctttgaaaaaaaaagtttagggctttgtattaacagaaacattttatcgcttttaaataaagatgtatctcattatgttcaaatgattttatgacaaggaaattttactagattgtaaatgattttcagttagcaaatgtgttcactctgttacagcaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactggtaataaaactgtatcagttattaagaatcagttattttttccttaagcttttaagtactaatttaagtctgttcttcttatacatcttatagtatattggcctcaggagacacctgagaatttgccttatggttactttcatggatttattgaaaaagtattgtgttgtgctttagaacataaaattatgtcagaacattataaaagttgttttccaacaaaaatacttcgcttcttttttaacactttcacaatgccaaatataggccaaataagcaaaagcattgaatagttgaatgaagcacagttcttatttcttccagctgtgaatgtggattcttcccacacagaatatacattgtcctctttgactagtgacacattgtacatggtacgaatggcagcatacacagatgaaggtgggaaggatggtccagaattcacttttactaccccaaagtttggtaagaaataatgaagtttggttttttttctttctcaaacttaggttagaaatgaacttagtttatgtgctaaaattgtgttaaaaagtacatctttggattcatgatgatttttatattatctggctttggttggtggtttctttatagaaagtgttattcctcacctttttggtattttattaactgcttctgactatattcagctgtactaaaaatcctaaaagaatttgtgtatctttccatgtgggttcatttttttcactggtttgggtgtgttctttccttctctatcctcatttctttcttttattgagagattacttgaaggactagtccactttacagtcttcacttccgtacctcccactcagtatttaacatactgaaattaggggtcctaccccacccctgcactgaaacctctctggtgtcactcagaagacctcttgatcatcatatgtactgcatgctttttagttttcatcttttttctactttttttttttggaggcagggtcttactctgttgcccaggctacagtggagtgcaatggcatgaacatggcacactgcagccttgacctcctgggctcaagtgatcctcctacctcagtttctcaagtagctgggaccagtgccaccacatccagctaattttttttatagagatggctggtctcaaactcctgggctcaagtgatccttctgccttggcctcctaaagtgctgggattatagacataagccactgcctccagccttttctgcatttgactctgttggccttccatccttgaaactccctcctcccttgggttttctaaccatactttttctgctagcacagtctcctgagtctccttgttctttggtgttttcttcttcttctcctttttttgctttttttttttttttttttttttttgagacagagtctcgctctgtcacccaggctggagtgcagtggtgcgatctcagctcactgcaacctccacctcccaggttcaagtgattctcctacctcagcctcccacgtagctggggtagaggtgcccactaccatgcctggctaattttttgtatttttgtagagacggggtttcaccatgttggctgggatggtctcgacctcctgacctcaggtgatccacctgcctcggcctcccaaagtgctgggattacaggcatgagccaccgcacccggcctcttgaccctgttttcttacttgcctattcaaactctgtccatggctttagccatcttctctttccttcccaaatacattttccctccctcgttctatgccaaagccataaatttaaatgtgattacaataaatgtatttgtatatttttctctcacataagctgagtgtcaagtcctgttgattgtgcgtaccctttcatcatcattttcttcaactgcaagctcctcatgctaacttctcttttcttagtgcattgcccccagtgaggtcttcacctcatcatctggctcttctgtatcttccctaaagcaaacttaaccaacattctttcttgctccccctacattttgaatcattatagaaaattaccttattttaccataattgtaacccccacccccaagtgccagcctagttaatgataagtagtaaattccatgtgccttgttggttgaatgcttgctgaatgagggaataaatgaatgagtgactacataaaataaatgataaaagttcctgagctttgctgttagggtcagtaatgaatatagtttctgggataaggttggtcccatgtggtggtatgttaataggtatgttatttaaaataaaactttataccataatcttgagaaaaattaaaaaataaacttaaaaatgtatattttatgtatttctgtggagaccagccatctctacagagctttgtatatatgtatgtgtgtgtgtacacacacacataaaagcccatatgtatattttttgtttgtttgtttttgagacagagtcttgctctgtctcccaggctggagtgcagtggtgcagtcatagctcactgcaacctcaaattcctgggctcaagcaatcctcctgcctcagcctcccaagtaactaagactgctggtaggcaccaccatgcctggctagttaaaacaatttttttggtagagatgggatctcgctgtgttgcccaggctggttttgaactcctggcctcagtcctcctgccttagcctcccagagtgccggattacaggtatgagccaccatgctcagcctaaaatttttttattacataggtgttcattatagggaatttagactgtacagtaaaatgtagagaggaagaaaaattagtcctagtcccttaccccaaaataacatatttgtgtatccttttagtgtcttctttgtatatatttttttcctaaaattaaattatacttagtattattttataacctaccttttttcaattctctatctgtagtctcatggatccattatggcttcttcacatggcatgagtcttgccaacgaggaccttacagcttagttgaagaaattttgcataagtaaatcagaaaaaggagaacctgtggactatgtagacagtaaatagagtaggaatttaaatataccagtagtggataattttaccttcaaaggttttatgaagaagaaaatacttgagccttgagttagtatgtggacaaataggaagaaggtggcatcttagagagcagcatgagcaaaggcacaggcttgaaaacataaaagcagatgtttaataaagcaaagtttctgcctaaattagatttggcattttatatatatatacacacatacatacccatatcaatatatatatacacacatatatcaatatatacacacataaatatatatacatacacccatatatatatatatatgatgcttagcatttaagagttaatatttgccaacccatagtttattctcaagcatttaactgatttcttgatttctactgagcttcataggatgttagttacttacaaagggatatgtgtggtggaaggataaaattaagtgaatagtatatggctgcaatattactttcatacattttttactgtaaaagactaagtaaaattcaaaattaatcaggacagtcatttaaaaaatctccaatgttaattatcccaattagtgattaatttgatgaacaagtcctcttttaaatgcagatgaggatttgtgtggtatttagggatcttaggcttgtttactttttagtttattcctactcgtgccactcctcatgcccattgagcagctcctaaagttcttagccctgtaccagctatatcctccttttgaaaaatggtaaataactcttaaaacttctgagagttgcatttttattttttagaaggttaaatgtgtagttcaattatgtttttatagcttttccattttacccagtatttatatttgttctgacataatttctctgttatacagtattagaactcagagataaacttttactaagattctaccaaatgcagatcataaatgttacaaatggttatgtttgaaagctctaacccagtagattacccgatacactgatcatttttatcccccaaccaacatatattttatgctatgcggccaggttaatgtataagacataaatggttgggatgtgatttaccaaagagagaagagggtaaaaatcatcaagtctgaagagaccttgaaaaataattaggattgtattttatcttttcaacagtaagtctggttgggaagttgtattatgtcttcttagttcatatgtcaacattatttcccatcacacctctttttttttttttttttttttttttaagctcaaggagaaattgaagccatagtcgtgcctgtttgcttagcattcctattgacaactcttctgggagtgctgttctgctttaataagcgagacctgtaagtaactttattcatatttttgcattttcccccagctttattgagctgaatttacatgcaataaaatttatccattttaagtgtacagtttgatgaatttttgtaattacatacagatgtataactaccaccataatcacaatatagaacattttcatcacttttataaagcttccttgttctcctttgtaatctgtcttcttctcagcccaaccccaggcagtcattgatctgcttttctgtaactgtagttttgccttttctagaatttttatttatctatctattttgagacagagtttcactcttgttgcccaggatggagtgcagtggtgcgatctcagttcactacaacctctgcctccctggttcagactcctgcctcagccttcaaagtagctaggattacaggcgcccaccaccacacccagctaattttttgtatttttagtagagatggggtatcaccatgttggccaggctggtctcgaactcctgacctcaggggatccaccctcagcctcccaaagtgctgggattacaggtgtgagccacggccaagaattttatataaatagaatcacatagcgtgtagtcttttgcgtatgtcttttacataatatttttgagattcatccatgatgttgcatatacttctccctttttttttttttgagatggagtctcactctgttcccttactggagtacagtggcatgatcttggctcactgcaacctctacctcctgagttcaggtgattctcctgcctcagcctcttgagtaactgggattacaggcacttgccaccatgcccagctaatttttgtatttacagttgagacggagtttcatcatgttggccaggctggtctcgaactccggacctcaagtgatccacccaccttggcttcccaaaagtgctgggattacaggcatgagtcaccacacctggcctacctttttcctttttattgctgaacagtattctgtagtatggatatatcaaaacttagactgatctgttatggaagtttaggttgtttctaatttttagctattataaataatgttgctatgaatattcacatacaaaactgtgcgagcatatgttttcctttatcttgaacaaataataggagtgagagtgctgggtcatatggtaagtatatgttcaactttataagaaactgccaaactttttcagagtggctacaccatcttggattgcctccagcagtgttccatattatcaccaacacttagtgctgtcagacttctttcattctagtgggtgtgtagtactatatcgttttaattttcatttctccgatgactagtaatggatcttttcatgtgtcacttacatattttcttttgtgatgtgtctattgaaatcttttacccattttcaaattgggttattttgtttataattgagctataagagtgctttatatgttctggttacaacattgttaaatacgttttgcaaacttttgtcccagtctgtgctttgtttttttgtcttaactgtggctttagaaaagcagaagttttacgcctgtaatcccaccactttgggaggtcaaggcgggcggctcacaaggtcaggagattgaggccatcctggctaacacagtggctaacatctctactaaaaatacaaaaacttagccgggcatggtggcacacgtcagtaatcccagctactcgggaggctgaggcaggagaattgcttgaacccaggaggcatgggttgcagtgagccaagatcacatcactgcactccaacctgggtgacagagtgtctgaaaaaaaaaaaaaaaaaaaaaaaaaaaagcataagttttttattttgatgaagttcattttatcagttttttttctgtggttcctgagttttgtgtcctgccaaacacagtatcaaaatattttctcatgttttcttccataagttcaatagtttcagctcttagtctatgatccatttcaggttatttttgtgcatggtgtgaggtcagggtcaaggttcattttgttccttcagatgtctaattccattgtcatttattttgaaaagagtgtcttttccccattgaattgctttggtacctttgccaaaagcaattgtctttataagtctgtatctatttccatactctcacttctgtttcataaatgtatatatgtccgttcttatgccaataccacattgccttgatgagtatagctctatagtaaattttgaaaataggtagaattcttccagtgtgttctttttttaaagaagttattttggctaggttctttgccttttcatatacattttaattcagcttgtcaacttttttaaaactatagttttgattgggattttattgaatctataggtcagatttaattgaatctataggagagaactgcagtctttttttttttttttttttgatttaattcctcagctaaaacagcggaagaggtgatttattatatggttgttacactcggccacaaataaacacagaaatagtccagaatgtcacaggtccagggcagaggaccaacatgggcattttgtttttgagcaaggtgggtctcagaggtgatcggcgatcagagggcgatgaagttctagatccattgagacaagctctagacagtagcatgcagtcccacaacttgtaccagcatccccagcgtctggcattccatgtttctgctcctgtggcctccacggtgcaacaagctagcggtttacttggacctctgcctcatctttcttcttttgcgcttcagcctgcgcattcgcttcttcctccacttggctctcatggcgccgaggtttccaaaaaaatggcgctaaggccgagagagaactgcagtcttaacgctactgagtctttcaatccgtgaacctggtttatttctttatttatttgggttttgtttaatttacttttgcagtgttttgtagttttcagtagacaggccttgcataactttttttgaattcatgacaaaagtattttttgttattataaatgaaatgtttaaaaatattttctaattcttagtatatagaaatgcaattgattttttaaaatatattcatcatgtatactgagactttgataaattcatttattagtagctttttggatccttaggattttctagatacacaatcatgcttcttgggagtaattatagttgttctaatctttatgcttttagttctttttattgtcttaatgcactggctaagacctctagtacatatagtacatctagaccatataagagcattgctttgttcctaattttagaggtgaaagtatttagtctttcaccatcacatgtgatgttagctgtaggttgaagtttttgctttgtggggtttttttgttttgagactgagttctactcttgttgcccaggctggagtgcagtggcacaatcttggctcactgcaacccccaccttctgggttcaagcaattctcctgcctcagccacccgagtagctgggattacaggcatgcaccaccatgcctggctaatttttttgtatttttagtttagtagagatgggggtttcaccatgttggccaggctggtcttgaactcctgacctcaggtaatccacccacctcagcctcccaaagtgttgggattacaggtgtgagccaccgcgcccagccgctttgtgtttttttttcccctttactactacttgcaggggggaagttcttatttctgttttgccttgctagcaatttttatcatgaatgggtgtcacaatttggtcaaatgctttttctgaatctattgagatgatcatatggtttttctccttccttccatgaatatggtgcattttattgatttttcatataacatctttgcattccttggattttgctgcattcagtttaatactgtttgcatctgtgttcatgagtgaagttagtctgtctttatgtgccttatctgtctggttttaaaatcaggataatactggcctcataaaatgaatgggaacatgttacctcctctgttttctgaaagagtttgtatagtattaatacaattgtttccttttgcccagagttttgtgggaaggtttttaattaaaaattcaatttctttataaatatagctttctttttcttcaatctgttttggtaatttgtgtctttcaaggattcattcattggtttgtctaggttgtcagctttactactttttatattacttccaaatgttataggtatttcctacaggagagtcagtctggtaggctctcactctttgaagcaccattctcagtcacttttttaaatttgatttttatatttgaacttttttggtatcagtgggaacattaatttgttatctggattcttttaattggaataccacaacatgtggcctgggtaaagattttaagtggttttaattgcagaattttgagagtttaaaaaaaaatttgaacactgattagatttagctttgttaattcattatgaatacattataatccttatgcattttcaacagtatttttctattggttataagaaaaataatttttgtttggggtagagtaggtattttttgttcatttaggtaattggtttggtttgtaagagtctttgatgaacatgtttagaaatagggactatttattgtttattatgtgtggttttacataggccatttttcttttctcttcagaattaaaaaacacatctggcctaatgttccagatccttcaaagagtcatattgcccagtggtcacctcacactcctccaagggtaagagaaaatgcttctgagttgtttataatatacagacatgttagtaggtatattgagtatctacagttagtaggtatattgagtatctacaaatgtaccaaaagataagatattcaagctgaatcaaaaagtaaatgaagataaaacagtacataactgaaaattttaatcaaaatttaatatgtatgacatattttaggggttttatcaccatcatagtatatttgttctgatattttaaattgtttagtacacattacagatgtttggttgaacttgcaaactgaaaacttgaggtgctgaaactgctatgtgatggtaactacctcaagcattttgggttgagtattaaaaccaagttcaacagtttatcattttagcactgatgaaatgatctctgggaacctactctaaactctgaattttaaatatgccccaaaggggaactcatttatatttattatcctccggtagtccttaaattttatattaacagattaaaatgtattatgtatttttatattctacaaaatctctgtcattcaggtttgattttccttaatgttttctagttttctgtccagttaatcctaggctgcctagtctaggcatgaaatattaaatactacttgtagaccattagcttatcaaaatgtaacaccaacaatattgatttagactacttagactcattttatagtatctgcattttgggtagttgacagtgacttagtgacataatacaggttatttctgtaccactgagagttactgggaagtttcagagatgcattagctctgtggctttaactaatacttgccatatacaattttttctcttccttagcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatacacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttc

SEQ ID NO: 823 - DNA, 28052 bp, Human
caatgaaccattggtcagaatagggaacccagaaacaaatccacacacctacagtgaacttattttcaacaaaattgccaaaaacatacctttggggaaaggccagtcttttcaataaatgttgctgggaaaactggatatccatatgcagaagaatgaaactagaccctcatctctcttcatatacaaaaatcaaatccaaatggattaaagacttaaatctgagacctcaaactatgaaactactaaaaggaacattggggaaactctttaggacatgggactaggcaaagatttcttgagcaataccccaccagcacatgcaaccaaagcagaaatgatagatgagatcacatcaagttaaaaggcttctacacagcaaaggatgcaatcagcaaagtgaagagacaacccacagaatgggagaaaatatttgcaaactatctgacaagggattaataactggactagataaggagctcaaacatctttatggaaaaaaattatagaaatcccatcaaaaattgggcaaatgatctgaatagacagttctcaaaagaaaacatataagtttatgaaaaggtgctcaacatcattgatcatcagagaaatgcatgtcaaaactacaatgagatattatctcacctcagttaaaatgacttttatccaaaaggcaggcaataatgaatgctggtgagggtggggagaaaagggaactctcgtacactgttggtgggaatgtaaattagtacaaccactataaagaacagtttgaagagtcctcaaaacactaaaaatagaactactatatgatccagcaatcccactgctgagtatatacccagaagaaaggaaatcagtatatggaagagacatctgcattcccacatttgttgcagcactgttcacaatacccaggatttggaagcaacctaagtgcccatcaacagatgaatgaataaagaaaatgtggtacatatatgcaatggagtactattcagccatgaaaaagaatgagatcctgtctttgcaaccacatgtttgaaactggaggtcattatgttaagtgaaacaggccaggcacaaaaagacaaagctcacatgttctcacttatttgtgggagctaaaaattaaaacaattgaattcatggaaatgggaagggcagtgatggagatgggaagggcagtgggggttggaggggtggggattgttgttgggtacgaaaacagaattagatcgaatgaataagatctagtatttgatagcataacagggtgactttagtcaacaataatttattgtacatttaaaaataactaaaagagtatacttggattttaacacaaagaaaggataaatacttgaggtgatggataccccatttaccctgatgtgattattatacattgtatgcctgtatcaaaatagctcatgtgcctcatgaatatagacacctaccacatgcccacaaaattaaaaactaaaaaaaacagtcatctctgaatgctaaacggagtaaggggcttcctggaaggctgggtgaaatgggagtctcggaaagatggtgtgttgcaggctgggaggagggtgagacgctggggtcacctagagggacctgcttgtgtgaagcctacgtattagtgggtatgtgtgtgaccggatggaggcgtcagaggtgttgggtagcctgtgtgagttggcgtgggggtgatgtaggaggggagagagggagggcctgcgttcccttggctcctgtgtgcagctaggcccctatttgacaatgtgtgtctgtgtgtgtgtgtgtgtgtgtgtgtgtgtgtgtgtgtgtgtgtgtccgcccccagcgtaggaggcagatctttatctggccctgggtgcttgaggagtttcaggctttctcataagcctcgtctccccgcctctccaccccaggccttgcccctctatcctctgcacaggaagtgggctggctctgggcttttagtctttgcggccccagcagccagagctcagcagggccctggagagatggccacggtcccagcaccggggaggactggagagcgcgcgctgccaccgccccatgtctcagccaggtgatgtccccctgcctccctcccggcccctgtggaccagccagagggctgggagtgaaagtcacagagaagactttcagctctgactcagttcccccagcagtttctgcctgaactcccatcccccaactttgtcttagaattcccctagggaggggttgggcccagctctcatggctcctggctggaggaaaaagcggtccccagtcccaggtcagctctccttcccaacccattcaggggaggctagggactgctgtgggatgaggggcttccctgggctctgtgtgctgggcccccaacccggagaggtggagaagggatgggtggatagcctgggtgcccggagagggtacgggatatggggtgggacaggcgggagccccctcctgacctctgtggagtggggcccatataccgggggaggcagccctgtgttgcgtgctcatcaggaggcttgtggagtaagtggggacagaagggtccccttggagagccatctatgaagtgaagttgctgcgaggcctctgggagccccaggctggaggcagagccctgggtttgagtctgggtttgtccctcccttggctgcatgactggacaggtcagaagcatctccggacattggggatgggaccctatctttggggctgcctggagctcatgctctctcctctcctgggggccgaagcctcccactcttaactgtgtttgtagcacctcgggggagggaggtggagtgaggagctgagctatccccaagggtccccttccttcccccacagccagggtcccgcacccagctggagaagcccctgaagttaaatagcaagagacaagcactgtgtatgggagcaggggggtggcaggtggaggtggccagagaggacgaggggacataggccccattgagttcagaggtcaagttggatgcaccatgggctcccgagctcctgctttaccaccctgccccagccaccatatacccctgatggcagcaggggccccgaactgcacctgaccaggttcaaatcccagctctatgcccttctcgcctgggtgagaggttgacccgtttcttagtctcctcatttggcaaaaaggaggcatactagagcctcctcatggggctgtagggagggctaaaagctgaactacccccgagcgctcagggcaggcagtgtaggcagagagagagcaggcaccagtccctgtccccagcagcatctctctgaaaatcagatggctggggtcagccgctccgggcttcagttctggcatggatcaaatggggcagcaagacccaccttgcagggctgtggtggggacgtaggcatccgtgggtgtgaccagtttcagagtcatgaacgacagggcacgtgtgggtgtgcctgaggacccaggagggggtgctcaaactcgaggtcctgggctccacttgctgtcacccgaggctgggcttctcctcaccgtgcaaccttaagtgggttccttggcctccctgaggcacagcttccccattgcagaatgagggtgcagcctcagtgactgccaggcgctccctcagctctgtgcccctctggcacccccacaccatcctcccgtggactctgccctctccgagcatcgctgcacctctgagctccaggcggcgggaagcagactccagatggcgctttctcctcctgcccggctgcctctaggctgggcctgtggtttacccctaaccttcctttgaccttgcacccctttgtccctcagcaccttcctcacacactggggctctctgcagttcctgtcctgggcatggggtcatcctgaggctgggcccgacctggggtgacacccacacaaaacattgatggtccccttgccccagggccaggttggcatgattgagcgtgaaggggcataggggctatgggagtcccctggttgggctatgcactctttggggtcccaaccctgtgccctctgctattgggggatcccaagaaagaggtgagcagcccccaccctggggagctcaccctcctgtggagacggtaggccaggcaaaggcgagcccatggtaccccgaataagcacctgccagtctgtctgtgagctgctgggtcctgactcccaggacagagagggtggcagccttacctctgggaccagtgtctggcagggtgggacagcatgagagagtgagcctggagccctagctccacctcttactgtgtttatgaccctgggcaagttaggggcttggagccttagtttcctcatctgtagaatgggataataaagccattgggcagcttagacgagctggcatatgtgaggcacttggccccaggcctagcatagagtatgtgctcagtacacagaacgagtattattagttcaccagtgcatatttactgtcgtgtgagctgtcgtggtgggaagatgcgtctggggagttccaggaggggaggatccctgcctgggcactgggcagtctgccctgactcagattccagaaaggcctcttatccactgcatgaccttaggcaacgcacttcacctctgtgtgcctccgtttcctcattggaaaatggggataataagagtatccccgccagaggccctgattgctgcatttaaagagttttaaatggagcctggcttacagtaacctgtcagccgatggttttggtgtgattaagggggtggcagagcggcgtggagttgggttctgatcccagctctgtgctgggctcctgatgtaaccttcagcaagtctttcccacttcgggacctcagtgttctcaaatgtagaacaagggactgtgcttgctcagagagcctttgcagctttgacagtgcgtgggcctctgactctcactcctgtgacatctgccttaggagatggaacccatggctcttggggccagggtgtgtgtccctgctccatgctggctctgatgtaagccacgagacaatccagggccacctaaagagctctgctttttttttttgccgtactgaggcctctgaccacactcattcatttcactacatttattgagcaccgactgtgtgcccggccctgtgctcagcagtccctggagcgagtgtgctggtgggccagcccctggtcaacgccggccctgctgctgccagcctagagggaggagcaaggcgctcagaagaggaagccctcgccctccatcacggaaatcagggaaggcttcatggaaaaaggcatgagggcccgtttgaaatgggcttgaaggatggcaggatctgtaggggacccagggaaaggatagacttgggaaggacctttggagggtgagtgtcggtttcctggtcacctggagccactggcttgtgcaggcaggtaggtgcggtgtgtgtgtgctttggcctgggtacatgcacctgctcctgtgagggcagggtctggaagggtgggctgacctcattccggtcccagaaagcctcgaaaatgggaatttaggctttgattgcaacagggccactgcaggttcctgggcagggatgtgggtggttggaggcgggcttcagggaaggcaggtgagagcctgcagatggggtggtgccgttgtctgggctggaacggcacgaggctggcctggtgagggtggggaagagacaacaagtagtcactggagtgtcctgctgtctgaggagagtcctgactggctaggtatgggggcaaaggtcacctggaataggaagggtacagttgtcccagaactgaaagtcagacaggagaagagctggggatgagctgggtttttgccgggtccaggagcatcccctgtgagggggtcctgcagaccatcgggagggacgtggaggcttggggctgagctggagaaagaccctgggaagctgagggctggagccagtgagaggctcaagagagagaagggaaggggagtgagagctcgagtttggagccgctggagaagggggaacagcgggggaaatgcccaacgctcaggagccttggaagctctcgagatggaagagcaggagggagggaaggatgttccacctcctccacatctcttgactcacctgctcctctcccctctccccctgcccctctgactgaggctaccctcatctttccctggaagctccctcctcatctccctgcctccccctttgcctgctccaaacacctctcctggaagcagtccccttatcttcccgaagtgaccatgtgctcactttctcattcccctccgcacacccagcccctgcagagggtgggggcagctacttttctttcccatttccgctgcgacagttgtggtcttgcctcacgggagcttccacggttggctagaggttccctgagaagcaagtctttgtctcaaaaaaaaaaagtaaataaataaagcactggccagtggccagtgcataataggcactccgggaaaacttttgagcctccctctgacagggctggcttagagatttcatgtctctttcctccctggggtataatctgggtgaccaacctggccctgcctccagggagcttccaggcaggtaggggagtacgagtgtggacaaggtcctccgtaaaggctactgcagccctctgtgcctcagtttcccctgtcctctagggctcttcagtgtttgggtcagagctcctatctgcttttctgcttttccgagttcgcgtcctgatgccttcacaccattgcctcagctccctcgagggacagtgaggggcagaggcaggggctagcctcagagccctctggaagcccctctacctgctgactttagctctgtctatatttattccatcacttgtttgttcaagaattttttttggccagatgcctactatgtgccaggcactgttctaggaattgtggacctagcaatgaacaaaacacaaaaatacctgtccttagtgagcttacgtgactctgtgtgtgtttgtgaagagagatagaggaaaacatgaatcagtcaataaacgatgaataaataatgctatgatgaaaatgtaggggggtggtgagtaacaaagggtgcttcttttatttttttctttgagacagagtcttactctgtcgtccaggctggagtgcagtggtgccatctcggttcactgcaaactccgcctccaggttcaagcaattctcctgtcttagactcccgagtagctgggactacaggcacccaccaccttgcccggctaatttttgtatttttagtagagacagggtttcaccatgttggtcaggctggtctcaaactcttgacctcaggtgattcgtctgcctcgacctcccaaagtgctgggattacaggcatgagccacacgcctggccacgacgggtgcttctttatgtagtctagtcaaagaagacctctcaaaggaggctgcagttgagcagaaacttgaaggaagggtgtgagcatgtgtagggtggtgggattagcaggtgcaaaggccctggggctggactgagctggcaccgaggagtgcagaccatgcacactgagggggcgggcccagcctgcctctaggggcagcgaggcctgggatgtgtatttacgtgtgctctctctttctcctctcccaccagggcttccttcctcggctccaccctgtggatgtaatggcggcccctgctctgtcctggcgtctgcccctcctcatcctcctcctgcccctggctacctcttgggcatctgcagcggtgaatggtgaggaccctgacatctgaacagctctgctttccctatggagagatggctaaggccctgctaaagcctcttcccagaaggggatggggccagagaccaggtgtccacctcctgcctcaccctctgtcctggacccctgccctggcatgcatgcatgaatgcgcacacacacacacacacacacacacacacacacacgcctctccaagccacaggcttgtgctactttctgtccctgccttgccttagtttgcctgtaggaacttgcaggctctggagctccatttcctcctctctgaagtgggtccatgaatcccttctccgcttgccagagttacccacctcctcctctggcaggtgtgggtgccaggtgcaggggcagtgggcgtgtcttgggggggctgtgggcacctacagtcagcactcacacctcatcttgcccggcaggcacttcccagttcacatgcttctacaactcgagagccaacatctcctgtgtctggagccaagatggggctctgcaggacacttcctgccaagtccatgcctggccggacagacggtgagtccactggccacactgcagaatcttaggatggtgggatctcatattctggatcctatgcactggactccaaggagtcaacgtttacagaatcttggactaatgggacccacagactttttgaatcacaggagttggggcccaggcctggaatcaagggatcgtttaagagaatttgggagtcagctatttagacttctagaacctgggtggagtccaggctgcagtggaggggctggggatgaactggacagggtagtttggggacactgagctgcaagcctgctatgccaaggctggactccactctagaggcaagcagagaggaagtggggagaaaggagggtccccaagctttttggataagctcggattttgagagaccctgtaggcagctgtggggacagggaacctgggagtggtttgggtgcctggtggatgggagagagatgtcactgtgatgtaaacatccaggcggccagtgagtgagggactgaccccaggtaggcttgatggggtcagggagaagaggaagaccacagagaggtggctgggcccaggtggattccatagggtgtggggtgggggaaaatggggagggagatggaggggtaaggcaggttcgggccctggcttctgggtgggtggtgattccacacggctctgaaggcctaattaaggatctatcttcatcctaagcctcatggagctttggagggctctaggtggggaggactgcctgtcttgaagtggtttgtgtttctagatcactccagctgccgtgggaccaggctgggatgagggagcaggacaaggtgcccatgagggaggaatgccatggagccagtgggggaggcagtgcccctcacagtggttggcacaggggccccagcctggccttgctgcctggtgccatcctggcagcagagagatctgagaagagtcccttgggccagctgtgtgggtccttcctgttcttctaaagagggtcttttgccatgaaaggcggtggaaccaaacctgtgagctgctccccgtgagtcaagcatcctgggcctgcaacctgatcctcggagccccagatgtgagtagcccacccagggagagagtgcagggagagggtggtctcccagctccgggctgcgatctcagggtgggccggatgccaggggaagagctgaggcccaatggctggggctgtggctaagcaggatgcccagcgctgagcaagaggcagagaaaaacaggtgacaccccagggagtggactcaggcctgccccagggccgacggaccctctgtatgtgaggcatctgccattctgcctctgctcctgctgtctcccctgcgctttgtgggtcctgtgacacttgtgttccttatcaagtaagacagcactccagtaactgtaatgaccacacccagctcttcccgggggcttggcagtgcagtgcagtgtggggggtgaagggtgtagactctggagctggatgctccagccctggctcaccagctgggtgacattgggcaacccctgtgccccagtctccccttctgtaaaatgggcataataatggcacctaccttgttgggtcaaggcccaacaagggccttgtttttcaggccctccccagcctgaaggtgggacctcaccagggacccgcctccttctgcccaggctgctcgggccaaggggcacctgcaggccagtgccaagctgtcccctgcacccccgtggcttcccatccccctgtgctcattggtgcctaaagtccagagggggccgaggcagctggggccagtgagtcagtgctgcctcgagcgtgccaggctgtggtagtgcctgggcttggtcccgctctgagattggagtgggcactggagcaggaggaggccagacagtgggagcagacacccctgagcttgtgggggcagtagagatgcctgggtcctggcttgggcagctgcagctgccccaggagagctcctggctacctcggaaggggcaggggtcccgcttgtccccgactcacactggatccacagagtgcgtagccccgactgtgcctccaggatcagatcgggtgccagaagcaggggagaggccaagcagtgggaacagacagctctgagcctgcggaggcaaggggggatcttcccagaccctgagagtgcagggatgcctgggtccacagccacaacttgggtagctgcagctgtgcccgggagggtgggtctcctgcgtgctccctgcttgcaagatcacctggaggcttgggtttggaccagggcccctgagagtgcagggacacctggctctgtggccacgacttgggtggctgcagctgcgcccaggagagcggggctcttgcctgatcccagcccccaacagcaccaggaggcctgggtccacagccaagacttaggcagctgcagccctgcctgggagggcagggctcctacctgctccgtggagcaggagaccccagctacgcctcccggctgcagccagagttttagcagcggccactccggatgggcagctgcggccttcacctacagccccatgggtcaacatcagcactgtccccttcttaccaatgaagacactgaggctcagagaggtatggtctctgcccaaggtcacacagccaggaagtacacagctgggattgaacccaggcctgcgggctcccagttcaggcttctcaccgttgcattaggctgcctcttgcagggcatatggccatgtccatatgagtgtacatcaaattattgtctgtcaaagcctcctgggcggcagcgggctccaaggacacccggaccacatcttccatcaggttatatgtcttcttgaggggcaggagagtgtgaagatggagtcacacagtgtagctgataaaatcacagcctctggaaccggatgctgttccccttgcagggagctctgtaggtggcctggtttctgatcctggctccaccatttcttagctgtgtgacctcaggcaagtccctaaggctctctgtgcttcagtctcctcagctgtagaatggaaatagtgacagtgcctgtgcccaagttgagagaattaaatgagacaatatatgtaaagtgctctcaagagtgcccggcacagtgtgagtgatcacgcgaatgtatgattggcaatatttttataacaataatagtaataataataataataataataatgagactactatcatcggggaaaatctagcccccatagcagctataagaaggctaggacagggtctatagggtggagaggaactggccagtttggggaattccaacgatcaggtttaaggtttgcccatagtgggtcttatgcagaccagagggacggtgcccaaggtcccggccctgaaatcagcatcctggaccccagatcctaagaggcctgcactagagcttcctcccgcagggctgccgggctgtagggttggcagctgcacagtggcaggatgccttaagctgctcactcggcagccctctgtcaggcatgacaagccaggactcggagatgcagtcaccctgtagggggacacagagggcctgggtttaaacttgggctcccctgctgttcatctgcatgacctggcgcaggtcccttgaccagcccaagcctcaggcttcccacccataccatgggatggatgctgtgtgcattgaggggctaaggcatctgagcagtgactgctcataggaaaatgctcaatacctggccattttcttccagaaaattcaaggcgtagggatggggagagataggggaggggagggcctttcacactaaaaaatgttaaacaggtatagttccagaactgtacctttgtgggggcttaccagcttgcatgcctcctgtaacagggagctcactccctctcaaggtagctcacttcattttagatcaagtgttggtaaactaccttgacccataggccatatccagcccactgcctgtgtttctaaataaagttttactggaacatggccctaatattcatttacatgttgcctatgtctgcttcatactacagtggcggagttgagtcatcgtgacagagaccatgtggccccataaagccaaaaatagttactatgtggccttttacagaaaacatttgctgcccctgccttgggtggcggggcatgtggagaggctgccatccttcccaggtcatcccggtggcctcccccttcccctgcctgaagctgctagaagtttcacccctgccctccttcccttgcagtctcagaaactgaccacagttgacatcgtcaccctgagggtgctgtgccgtgagggggtgcgatggagggtgatggccatccaggacttcaagccctttgagaaccgtgagtgaggaagccagggtggggctggggcagggctgggcacctccttccttccacctcctctgggatcttccctgctccagcctttctccccggcagcttccacacccacatctgatcacctcaccgcccgctgttctcgggatgacgtcctggctccttcctctggcattcaaggccgctcaggatccagccctgggcctcctccccggcactcctcctcttgaggcctatatttctgctacagccaaaggccaactctccaaacccaccttgcctatccctgcctctgagcccttgcacatgccgatcccactgcctggaaggccctttacacctggaaaattcccactcacgtttcgaggcttagttgaaagtcacttcctccaggaggccttcctagactcccctagccctttgtacctcctctttctgggaatgtatgtcctgggttgttactgcctgattgtaggtctgtctctttcactgggctgtgagcaccctgaaggcagagtctctgccacccctgtgtctccttgccacgcacccagcactaggtctcatcaggacagtggtctgggaaggtttgttgaatgcctgagcgactgcctgctgaccttgggggccatctccagggaagcagtggggtggaaagtgagagtcaggcctgaactggatgtgatctgactggcagaccatcgaaactttctgagcctgagttttggggagaatcggagtcacctacctaccaggcttgtaaggcatctttgaactgagacatagaaactgcttaccatgtagtcagcactcagcatctgcttatcacttatgtggttctatagagtcttagaagtatagaaactgagattcatttaacttcagaatcacagtgttataatcatcacacttaaaataaatgagatgatccatggaaagctctcaggtcaattgtaagtgcagagaaaagctgccgtgagtcattcatccagcagctactgaatcaagtgccaggtaatcttccaggtgccaaggacacagcagacaaccaagtccctgccctcaaggagctcacagtctgctgggggagacagaaaatgagtaaagaaaccaaaccatatatttcgtaggtcaggtgatgataagcactgggaataaaagtgaaacaggcaagggggatgcagagtggtgagtggtcagggaaggcttctctcaagaggtgatcattgagagaggcctggaggcagtgagggagcgggtcctggggctttgggtcggggggtaggggaggtggtagcatgtgccaggagggaggagtggcaggtacaaagtgggaggtggaggtcatggctgactgctctcccgtaccccctcttgtctccagttcgcctgatggcccccatctccctccaagttgtccacgtggagacccacagatgcaacataagctgggaaatctcccaagcctcccactactttgaaagacacctggagttcgaggcccggacgctgtccccaggccacacctgggaggtgagaatgtggcccagtccgtacctgccttggttcctccttcctgtcctggtccatgtcctgtccctttttcattgtgtcgaggtcccctcagccccaggtggatggtgggtggctgagtccagtgctctttctgcactgcctggggctgcctccccgacttccacgtccttatctagcccccttaatcctggggatccagctggcagcaggttccaggctgacaccagggaaagattcagaaagccaggagataggcagctgcccagccccatgggctttcagaggccagggaagccaaccctccacgtgtcaaagcccatctgctccacatccgtgcgggcctgttgcttattcattcacttacactcatttcttcattcactcaactgctcactcaataaatatttgctgagcacctactatgcgctgaatgatggggagagagcggagggtgagctcagcaaacttccactctcaggaatctcagactggggcagggcaggcaggcagtcagtcagcagatgtagcgacagggtctgggatagtgaggcacccggatagtgataagttccatcaagaaaacccaacggggcaaggaatttgacagtgactggcacaggctacttcagactcaggtgaccagggaaggccccttggacacctgggtgtccagaaggagctgacctgcaaagatctggggagaagttttgcaaaattagaaagacctgccacggcaaaggcaggatgctgctatgtgtctggggagcaggaggaggcaaaaagagtgacccagggtgggagaggtgtgcggagacgtcccactttctggtcctgtggagactagactgcagcggggcacgggtgggaaccagagaccagctgcaggcttgggagagggcggcagctcaggcctggggtgagtgcagcggggagagagggggatggttctggaatggctgtggaggtggaaccaggttctggaggtggaaccagctgattagctgatgacttgggctttaggggatgaccctggggtttgaggccccagcaactgggtagtgagggagctttgggtggcaaggaagtgggggtgcagctggcaggggttgggggggggttctgtgatgctcagcctcctggccctgccatgggaggtgaggtgggcgctgacagtcctgtctccgacccaggaggcccccctgctgactctcaagcagaagcaggaatggatctgcctggagacgctcaccccagacacccagtatgagtttcaggtgcgggtcaagcctctgcaaggcgagttcacgacctggagcccctggagccagcccctggccttcaggacaaagcctgcaggtactggtgggcggcaagggtgagagggggctcaggcaggagggggcggctggaggaggagctgctccattctctccctgcctggggtgagggtatagcagtcagctccatccctcacttgctgtaaccctgcagggggctcgcttttcagacaggaacaggggttcagtgaggggacggggcttgccatgggccttgtgagttggggaggggtcgaaaggctgttttcactcttctccaccctgaaatctccaactcctggtttcttctggggctgggggtggctgctttcacctctcggcctgatctgtgaaatgggtacagtgaccgtgaggcagagctgctgtgaggaaggcgtgtgatgtcccggcagcctggccctcagcaggtctgctgggcgcctgtccctcatcgcaccacatttcgagttcaagcccaagcaagacctggggtcctctaagtggtgcttggagggaggtggagagaggggtgcagccagctggagcccaggctgctgtgggggtggtggggggctgtaggctcaccaggggggcccatgggatctgtctggagctggaggagctcttagaatgccaccgtgtcatttctttttagcatgaaatctggcttcccagaggatgggcttagcagaaccctgtccccagccccccagacgcaggcctgcgtggcagggccctggatgggggtgttggggtgaccgacccagggtgagtgagggcacttctctaacccctctccttgctgtttctcccacccctgggcagcccttgggaaggacaccattccgtggctcggccacctcctcgtgggcctcagcggggcttttggcttcatcatcttagtgtacttgctgatcaactgcaggaacaccgggccatggtaagaaggttctcctccccttccttcatgctcccacccctccaacgtgcacacacatgcacacacatgcacacacacgcacacaagcacacatacacacacacacacacttacatgaacacatgccaccttgccaggtcagattctggaccgaaccccctgctctgatacacccgtgcttcgtctaccctccaaagagtcctccctgtccaaaacctggcctttccctgtgtcgcatccccacagggggaccctgtggaaccaacccgaggggaaggtgggaggtgcagccctccagggagagccccggggccctgtccagaacactgctctcaggactggggatgcccgtgtgcacatgtcagctgtctctgtgtctgggtccccgccggtccatctaggtctgtcattcgcttattcccatattcactgagtacgagctgcatgccaggtacagctcaaagagctgggaacacagtggcaggccgcatgcatgcgccccagctccaggcagctcacggcccagtgggggaaggcagacaatcatgcaggtgtgtaatgacacaccgggatcaggatggcagaggaggatgtcgacgtattgccattccttaggatccatggaaaccagttccaggaccctccctaccccctacagataccaaagctggtggatactcaagtctctgatttttgttttattttatttatttattttttgtgagatagagtctcactctgtcacctaggctggagtacagtggcgcaatctcgactcactgcaacctccacctccagggttcaagcgattctcctgcgtcatcctcccgagtagctgggactacaggcacacgccaccgtgctctgctaagtttttgtatttttagtacagacggggtttcaccatgttggccaagctggtttcaaactcctgacctcaggtgatccactcgccttggcctcccaaaatgctaagattacaggtgtgagcccccacgcccggcctcaagtccctgatttaacacagcagaatatctgcgtgtaacctacacacaccctcccagagactttaggtcatctcctagattacttataatacctaataccatgtaaatgctatgtaaatagttgttatgctgtattttaaaaatttgtattattttttattattgtattgctatgagggtttttttttcctgaatatttttgatcagagattggctgaatccgtgagtgcagaacccacggatcctgagtgctgactgtatcaggagcagaaaacagggaggggaaacttggctggggcgtggccagggctggtttccctgaggaagggatgattctgttgaaatctgtagtgggagcccatggggggtgtggaggggatggggagagtgtcccaggcagaggaaacagcatgtgcaaaggccctgggcaggcaggagggaagaaacttccaggaacagagtgcaggggcgctggtgtggctggagacagaagtgggtggggcaggaggctgaacttgagcctgggcctgtggcggcagtgatgcttcctggggcctcaggctgtggtgaggacctgggccgtgtgccgagcagtcatggagggtttccccagaagtgggacaggatccacttcgccctctgtagccctggctgctgtgtggagcgtggcctggtggagggcaaagcggtgaggaggtgacacttctgaccgggggttgtggccccctgatgagagccctgcttctcccaagaggtttgcaaagcgtgcctagctgtgtcacctcactcgactttccccagcactgggaaggcagtgagtcaggggctaccattgccttttaactgatgccaggactggccagagaagtcagctgacttgcccaaggtcacatagccagttaggagtgactgccgctctcctgaccctcgtcctggagcagtggttctcggcagtgttcggagccccgtttcctctttcctcccaagaagacaagcattcctccacccacccgtcccctccgcccacagctccctgcaggccttcagggaaaccatgtccctgtagagggagaggtcctctcccaggcatgggttcagtggcctccagactgccctcctccttgtcgttcttgcgccccttcagtgctttctccaccatgtcattctcctgtttaacactcttcagaggccgctcactgcgctgcagtacaccctggcccttgagggcctccaccagctgtgtggaacctttgggcaaatcaaaaatggtgcctctttcttcacggtgatgtacacagcttccaggcactcagcttagcaagcagaacatgggctggaattcagcctcactcaccaccacctttcccactccctgcccaagcctaatgcccttgggcagtgtacaacctgaaccaccatccatggcagccctgacaagaaagcccatctcctctctcccgcctcctggttcattccacttcttctagccatctccgtccctgaccactctggcttgtgtgttcacccccatcgacccccacctccccgtcttgtgtagcactgtgctctctgtctccacagaatgaatggtgatgttgcaacatgctttgtgtccatctccccatgagaatgtcagctccttgagagcagggacctcctttgttggccattcttgtctccccagtgcccaacacagcgtcctcccacagtgaacacttagtatcggcggaagaaatacataagtaaatgtggtgtggctccgtgcctggcatccagagctgtggcgccgatggcataacaccgcggtccttccctttctcaccctcctccttccctcctctcctctgtccaggctgaagaaggtcctgaagtgtaacaccccagacccctcgaagttcttttcccagctgagctcagagcatggaggagacgtccaggtaggaggccggggcggggagacagaggtgggcaggggtgtgagtgggatgagggggtggccggttagtagctaattttgtgttttgtgagaggagacaaaacgccgaagtgagcagcctccggggtgtgcatgggtctcttctccagctctggcactttccatctgagccagactgcctgggttctaatcccagctccaccacattctggctgtgtgaccttgggcctatagagcctccctgggcctcagtttccccacctgttagatgaggagaaaaacagtgttactatgtgtcctgccctgagtacattgcctggcacgcaattagtgttcaaaagaaccctatcaggctgggtgcagtggttcatgcctgtaatcccagcactttgggaggccgtggcaggtggatcacgaggtcaggagttcgagaccagcctgaccaacatggtgaagccctgtctctactaaaaatacaaaaattagccgggctggtggcgcatgcctgtaatcccagctactcaggaggctgagacaggggaatcgcttgaacccaggaggcggaggttacagtgagctgagatggcaccactgcactccagcctgggcgacagagtgagactccatctcaaaaaaaaaaaaaaagtaccctatctggtattaccgttgccggtgtgctgaacgaacaggacctgccagcacaagctctctccaccccactgtctgtgcagacatgctctgtgcttctcctgtccctgctcaaaattcctgagcaggctccataacttagcgtggatactaacaagtcttcccgtcactttgagtcacaaaacaccgattcatttttaaagtgccggcccgcagatcagtaacgctctaaactccatctcagattccgtcgtctcctcttccccagcccatgcccccttcaggcaggaagcttcaagaatgaaggggggacatggggggtactttttaccaccctagccccactctaggctcccaagattggggggtggggatgaggtaggggcagagggaggtcaagaagagtggcggaggaggaaagccatgccggaccagagctgtcatgacctggctttggagttctctatcagggctgatcaagggccccttctggaactccttggaaaactcccaagatgagaatatcttagttgcagtgcttttatttatttatttatttattttttgagatggagtcttgctctgtcgtccaggctagagtgcaatggcacgacctcagctcactgcaaactctgcctcctgggttcaaccgatgctcctgcctcagtctcccgagtagctgggactacaagcacacaccaccacacttggctaattcttgtacttttaatagagacggggttttgccatgttggccaggctggtcttgaactcctgatctcaggtgatctgcccgcctcggcctcccaaagtgctgggattacaggcgtgcgccaccgtgcctggccattagttgcagtactcttaatgtgcgggaatgtatttccttaaaattcttccctcagccttgagggtagcaagattcccatctataaaggtattcaagcaagccatggttgcctatgtgtcagaagcatagagattctcccattgaactggttggaggctgcggtagattagctgcatgctcagataccttccagcttcaagtcctgattctatgaacctacaacatcgtgaggtgggagctgcaaaccattccagcttcccatgagggtatggtatccttgggtctagtgtgtggagcggggtcctgaggaagaaggcatgatgtggctgggggttggggatggcaaagcaggccccaccttttctgcatctgggtgagagacctacccctccaccctaggacccacaggggccacaaggcccacccccacttcccaggggatcgtggaacgtgtgtgcgagtgtgggagtatgtgtgaggggcgtgagtgtctcctgaagcccctttcagggcattgtgggcagaggctcaggcccaggaagtagctggccacaggcagtgggcccctggctcaccggcactggccacaggcctggccgctccctctctggctgcacacacagggctgctgtctggccccgcccttgccctgggtatcatgaatctcacccgaccagtgcttcttcctctctgcccagccagcgaccctctttgccatcctcagtttatcctttctgcctctctcagccttttcttttgtgacataactcctggttgcagaaagggggcggatttaattgagtggtgtgtgcacgtgtgtgcatgtgtgcatgcatgtaagcgtgtgtgtgtgtgtctgcggagcagctggctcagcctcagggactctccctggagaggagaactgggcatttgttgctggttcattaattcatctgaaatagatccatgagacccgccatgctgggcacagaggcctggggagcccattgggcctggcccctgtgcttagggggccatagtccagctgctgagggttcccgggacagagggttgtcagggctcccaaactcacccacccgaggcccctgccacaccaccaggagggcctgctgtcccccactctgctgtgcagtctgtgtcttacccgttttgggtgtttacatctccatttgcttacctgatgtctccctggtgacctgatgggtgacagcaaggaagtcaggagagacgtggctgttgtggaaactgaggcccagagaggtgcaggggccctcccagggtcacacagttagtgagtgccagggccagggctagaacccgggtcttcccactccttgccagggctctctggaatcccgagcaactgagaagtgctctgatgggcactttcctctctctggggatgggaggcggagggggtgggggtggggactgcagggaactgggggaaaggtgaatcaggaaaccatcagctcccccaagagacgttcccaccacagtgtaagcggagaccctgggtcccagctctgccgcctgctggtctgtgatcggggccagggcatgtcccgtctctgggcatctgtagggtgaacaggctgtgctctcagtgcccttctgctttggcatgggtggatcgattcccacacttgtgctagtgcccactagacagtctgaggattctctcctttcctgggtccccagcatctagaacggtgccaggctcatagcaggtgtccaataaacagtcactcttgagcaatcagacattcctgggcactactggcagccaggcaggcctgtgctgggctgtgggtcaggcagtgtccctgggctggtggcccagagggcccccaagccagtgggtgggttgggggagtgcggggctataatcagggagagcttcctggatggggcagccctgggccaactgcttcaggaggaggaggagttaggagctgttgagagtccagaggaaggggtggagggtgaaggaagcccccactcacccacccctggcctttctcccaccagaagtggctctcttcgcccttcccctcatcgtccttcagccctggcggcctggcacctgagatctcgccactagaagtgctggagagggacaaggtgacgcagctgctcctgcagcaggacaaggtgcctgagcccgcatccttaagcagcaaccactcgctgaccagctgcttcaccaaccagggttacttcttcttccacctcccggatgccttggagatagaggcctgccaggtgtactttacttacgacccctactcagaggaagaccctgatgagggtgtggccggggcacccacagggtcttccccccaacccctgcagcctctgtcaggggaggacgacgcctactgcaccttcccctccagggatgacctgctgctcttctcccccagtctcctcggtggccccagccccccaagcactgcccctgggggcagtggggccggtgaagagaggatgcccccttctttgcaagaaagagtccccagagactgggacccccagcccctggggcctcccaccccaggagtcccagacctggtggattttcagccaccccctgagctggtgctgcgagaggctggggaggaggtccctgacgctggccccagggagggagtcagtttcccctggtccaggcctcctgggcagggggagttcagggcccttaatgctcgcctgcccctgaacactgatgcctacttgtccctccaagaactccagggtcaggacccaactcacttggtgtagacagatggccagggtgggaggcaggcagctgcctgctctgcgccgagcctcagaaggaccctgttgagggtcctcagtccactgctgaggacactcagtgtccagttgcagctggacttctccacccggatggcccccacccagtcctgcacacttggtccatccatttccaaacctccactgctgctcccgggtcctgctgcccgagccaggaactgtgtgtgttgcaggggggcagtaactccccaactccctcgttaatcacaggatcccacgaatttaggctcagaagcatcgctcctctccagccctgcagctattcaccaatatcagtcctcgcggctctccagggctccctgccctgacctcttccctgggttttctgccccagcctcctccttccctcccctccccctccacagggcagcctgagcgtgctttccaaaacccaaatatggccacgctccccctcggttcaaaaccttgcacaggtcccactgccctcagccccacttctcagcctggtacttgtacctccggtgtcgtgtggggacatccccttctgcaatcctccctaccgtcctcctgagccactcagagctccctcacaccccctctgttgcacatgctattccctggggctgctgtgcgctccccctcatctaggtgacaaacttccctgactcttcaagtgccggttttgcttctcctggagggaagcactgcctcccttaatctgccagaaacttctagcgtcagtgctggagggagaagctgtcagggacccagggcgcctggagaaagaggccctgttactattcctttgggatctctgaggcctcagagtgcttggctgctgtatctttaatgctggggcccaagtaagggcacagatccccccacaaagtggatgcctgctgcatcttcccacagtggcttcacagacccacaagagaagctgatggggagtaaaccctggagtccgaggcccaggcagcagccccgcctagtggtgggccctgatgctgccaggcctgggacctcccactgccccctccactggaggggtctcctctgcagctcagggactggcacactggcctccagaagggcagctccacagggcagggcctcattatttttcactgccccagacacagtgcccaacaccccgtcgtataccctggatgaacgaattaattacctggcaccacctcgtctgggctccctgcgcctgacattcacacagagaggcagagtcccgtgcccattaggtctggcatgccccctcctgcaaggggctcaaccccctaccccgacccctccacgtatctttcctaggcagatcacgttgcaatggctcaaacaacattccaccccagcaggacagtgaccccagtcccagctaactctgacctgggagccctcaggcacctgcacttacaggccttgctcacagctgattgggcacctgaccacacgcccccacaggctctgaccagcagcctatgagggggtttggcaccaagctctgtccaatcaggtaggctgggcctgaactagccaatcagatcaactctgtcttgggcgtttgaactcagggagggaggcccttgggagcaggtgcttgtggacaaggctccacaagcgttgagccttggaaaggtagacaagcgttgagccactaagcagaggaccttgggttcccaatacaaaaatacctactgctgagagggctgctgaccatttggtcaggattcctgttgcctttatatccaaaataaactcccctttcttgaggttgtctgagtcttgggtctatgccttgaaaaaagctgaattattggacagtctcacctcctgccatagggtcctgaatgtttcagaccacaaggggctccacacctttgctgtgtgttctggggcaacctactaatcctctctgcaagtcggtctccttatccccccaaatggaaattgtatttgccttctccactttgggaggctcccacttcttgggagggttacattttttaagtcttaatcatttgtgacatatgtatctatacatccgtatcttttaatgatccgtgtgtaccatctttgtgattatttccttaatattttttctttaagtcagttcattttcgttgaaatacatttatttaaagaaaaatctttgttactctgtaaatgaaaaaacccattttcgctataaataaaaggtaactgtacaaaataagtacaatgcaacaaaatagtgttgatattcattgcctgcggtaaacctgttgtctcttaaaggggaaatgagaagctgctggggagctgtcgaagacatcccagggccaaatgcaaacttcctccttgagagaaaggaaaaggattgtaaagggaatatctttttcactaataggagtcaggactgtctgtcttattctgtgtccaggtatcagctcatggccatatcccacaagtctatgcctggggaaatattgcacttgatgacgaatctctctctctctcctctctctctctctctctctctctctctctctctctctctctctctctctctcccccccctctctatccccctccctccagataggtagatagatgatagatagatagtgtcctgataaaagttggaccagaccagggatggcaattcctggcattcataaagccacactcatggcagacattactaatcaattgcacccatgcacggcagacatttctaattgaacacagctctcctcctgcagagcctgggtgcagcttcagattctgcaatgctgcgctataggcagcccccagttggtcacagctgatagctgatgacatctctggaccgcataattcctcaggttcctaacacaaaaggagctcttaggtttcccaactccgatttcccaggcagggaaaactgaagctgagaggatggagactggaaagctgagagggacctgtgagaggcaagcccagggagcccagctgtccccaccatgtctggtgagagacttgagctggcagggagcagagtcagggccaccttataccgggtgcagatgaagggatgggccagcggtcactgtgtgtcatgcccagtgtggatccgagtgtggatcttgggagaggagacaaagaggaagcagctggaggcaggggtggtggtcagattgcaggaggggcctgggtcagattcaggagacaggagcggcaccagctggggaccgggcagccgctggggccctggagaaccgtcaggtacagagcgggaagcaggaggcagccagggcagatcttgggggtaagagaaaaaggaggagaggtggggggaggggggggccttccagcctctcatgtttcctctttgttgaactaggtttgttattttgcttcctccgttcccccacctcccatctctcattcgaagcaacttcaggtgcctgcatttcccaagtaaattatggtggaaactgtaggcccaggtccaggatgaagcacccaccactgtcctcctcattactgacagctgaaaaaacagaccaaggaggacagtaagaaggggcaagagaaccaatacttccactctacacattgtgccagcatggcctgggcgtcatctctcatcatctggaaacaaccttgagaagcaggtgctttattccccattttgctgattaggaaacaggcccagggaggtggagcaacgcagctgatggttggtagcatcaggattcaaactcaggtacatctgactccggagcttttggcccttagcatacagaaggctacataggagataattatactaatgggaaaatacctggtaaaatttcattctaagcttcctggcagtcaacttcggggggaaaataagatgccatgatccattagtgtgattgtgggagaaaaagcaaagccctttgatagtttggcaggtagatggggctgaacggtggccaggagagaaggctgagggcgatgctggttggtcaggccgaggtggtcttacctcctcctcctccgtaactgctgagcccctcctactgcctccaccctccaagctggtccagtgtccctctgggccagcatttcactggcttctcccacccccaccctggtgacctccgtgccacagacctgacgccatcacctctcactcgtatgcctgctcagcctcctcctcggtctgcctgtccccacagccgcctgcccctctgatccttccacctctgagc

SEQ ID NO: 824 - DNA, 11789 bp, Human
agggaagtcgtcgaagctgttttaaaatatagcaaacttttgtatttagttcaggaacagcatggcccattttgccaatcacatcttaacagttggaaaagcaaacatattatctatcaggctttcctctaaactttaaatatgttttataagttataactccagagaaaatttacaaaggataaaccttaatatagaaggaattagagctgccacagcttctacacttttaacctctcaatattttatctgttgggctccactgtttcttcctggaattcacatcactgccaccactctgttctccttgtcctcatatcaatgtggccaaatattttccctgtatttcaatcaggacaagacatggttttttccccccatcaaaggaatggagaaccatagaatactagttttaaaatgtctttaggccaggtgccgtgacccatgtctgtaatcctagcactttgagaggttgaggcaggagaatcacttgagcccagagctcgaaaccagcctgggcaacatagtgaaacctctgtctctattttttaaataaaatttgaaaaagtctttagacataatctagtctaaaaatgaaggcttaaatgtgatgtatagccccctgccaagtggctatcacctgtgtgggcatcttcagtcatagggatcttattgccacagagaaatccctttaaacttattgggtaaaatctctccaatgtttattaagaaacacacaaaaaataaagcaaagaagaaaatgcaaaagagttataaatgagaggaagcaaaatgggcacttattaaaggtctaataaatgcacatttgtatccatcattctactgagttcttactcccaagatgttcttccctttagcaaacaaataagcaagtcagcaaagaaagaaagaacaaacaaaatgtggtgatcagggaagcattgaggagatggatggtggcaggtggcaagaggactataaaagttttacaaaatgtcttcctctgaatatgtttagagtcttgcattcaagcatttattatacaccaataatgtgagcaacactttacttgacaaagaaacagaaaagaaaggaaaggaagaaaacagaagagcatgaagagaaaatttaggatggattctgttcttcaacttcaaagcatctgctaatttgaatttagggaggaggggaaaaggttgaaagagaataagacatgtgtagaagacaaggacagagagaatttcagtccggtaagcaatgtaattcatttcaattctacaactatttatggagcagctacgtgggcccatcacccattaataaattggttacagaattaaaaccaacccaaagggaatatacttccttctttttcacagaccctctttgttctattctgcccatgaggttttcctcctcaagaaccagcaaatccaacgacagtcaatagcaggcattacaaatcagattcagaaaaataaatcaccccttctaaatttcttctagatattatcttttatgttttgagtataattgtatatagtatagactatagctatgtatgtacactttccacttacatcttttatttgcttttataatgtgtttcttaaaataaaactgcttttagaagttctgcacaattctgatttttaccaagtcaacctacttcttctctcaaaaggacaaacataaattgtctagtgaattccagtcaatttttccagaagaaaaaaaatgctccagttttctcctctaccaagacaggaagcacttcctggagattaatcactgtgttgccttgcaaaattgggaaggttgagagaaattagtaaagtaggttgtatcatcctactttgaatttggaatgtttggaaatggtcctgctgccatttggatgaaagcaaggatgagtcaagctgcgggtgatccaaacaaacactgtcactctttaaaagctgcgctcccgaggttggacctacaaggaggcaggcaagacagcaaggcatagagacaacatagagctaagtaaagccagtggaaatgaagagtcttccaatcctactgttgctgtgcgtggcagtttgctcagcctatccattggatggagctgcaaggggtgaggacaccagcatgaaccttgttcaggtaattaacactaactgacctggccaggtggggagcttccagagtaagctgaaaccattctgtgtgtcttaaaacccacatagaatgcttgagcttactgtgtaggaacagttcaagaatagagagttatagagtgttggaagtggaaaaggtctcattatcacaccatttgggcttctcctcttatgtaggaagaaacaaaggccagaaatattaggtgttttcttaagatcacacaacaccatagcagtagcagcactggggcttaaggcacatgagtaacaagtggagagtggatgaaccatatcttgctttggaacagcttcagttttttttttaatgcaacgtaattttagctaaatatttgtgttgctagtatcatattataaaatttggcattatttcagcaagctagagaaatactccaaatagattaagaagtgagcaactgcaaaaacttactataaatagatagctatagtaaaaattgtaagagtgacctaaaaactatacttattctgttagaaatatctagaaaactactacgacctcaaaaaagatgtgaaacagtttgttaggagaaaggacagtggtcctgttgttaaaaaaatccgagaaatgcagaagttccttggattggaggtgacggggaagctggactccgacactctggaggtgatgcgcaagcccaggtgtggagttcctgatgttggtcacttcagaacctttcctggcatcccgaagtggaggaaaacccaccttacatacaggtaatggttcagaggggttttcacataagattggaattttataaactatatcataggagaaaatagcatctgcttcaatttttctcctacaggattgtgaattatacaccagatttgccaaaagatgctgttgattctgctgttgagaaagctctgaaagtctgggaagaggtgactccactcacattctccaggctgtatgaaggagaggctgatataatgatctcttttgcagttagaggtaaaaaaaaaaaaaaaaaaaaaaaagcaaaacaaaacaaaacaaaaaacacatgaaatgtatccattcatctatctggtgttgttgtactggaaaaggctcaaaagggatccttgttacatatctttccaataaatttttttcctactagaacatggagacttttacccttttgatggacctggaaatgttttggcccatgcctatgcccctgggccagggattaatggagatgcccactttgatgatgatgaacaatggacaaaggatacaacaggttagttacacatctctcagaatgattttggcattaatttttttatatgtagaaatctgttaataaccaagaatgctcaagaaatgagatgttctggattttccagtggatcagagatcagcagaatatatttttgttttaattattattgaaaatattttcagatgctttaacagttttcctatattggtaagcacaatataggaaatatcattaagtatttctttaatgactggatctttgtgatctaggggtaaccattattaagaaaaatttctcatatcaaaatacaaacattcaagggatagtatattgcactgaatctacattaaaatgtgctctggatgttacttatgtaatttcctccatttacttctttactcttcaaaccagaaataagaattaaatttcagaaactgagattctcttttttttttttttctggctgaggcattattttagtacttttaggttaaaagaatttttatgggcttgttctgaaggaaaagactaactcccaaatacaacgttcaaactgtttaggtagaagaatgtttctcagttcataactgtatgttttggggaatgacatccaaagttttcaaaaaaatcagctaaaacaattaacactacttctaaaaaaataggaaaacaattaatactatgtctgaggtttaactgggatttataatgaaaatgtaaacctctgtaggacgtacaaatgtgagtttagtcctggatagaattcttgattggttgagttaacgaattcttgtaaagaaaccttcctgcaaactctcaaatgagattgttcctagcatcacaagttacacaagtaatactagcaaaagtaaggtagatttacttactatattgatcataattacccaatgcctcccaattttagcattatgggtgtttttaaaaatatgaaggaaaaaattttgaataaagccagtgtttatgtattctaaatctgttgtgtgacaaatgctagacatgattgggcatactgtgttttaaaccaattttgcaaatcctatgacatctatcattattcatgtttttagtctcaatatgtacttcatgatgatgaggctgagacattatcaattaacatgaatatagtttcctttaactgagactgcaaatggcaaatgtaaatatattaaaacagtgtttagctttgcattgacaaatgaaggtaaatatctgatatgctaagcaagtgggttcattccattcctgagtacaagaaaagggatctggttcttctggagttaatatgcttgtgaggctgggggtgggtttggggccatggggggcaagtggatgtaactgggaaatcaatctcaaagattgattacaggtatgagttttaaaatacacttagctttccattaagtgtgtaattagtcaattgttcaattaaccaacaaacaaggtgtaaaaagccctgtgtggttccaagaagtaaaaaccaatacaatgcacagcagacctgtgtaatgcacatgtatttaaaaaataagtaactattgttctcaatttcttaaatagggaccaatttatttctcgttgctgctcatgaaattggccactccctgggtctctttcactcagccaacactgaagctttgatgtacccactctatcactcactcacagacctgactcggttccgcctgtctcaagatgatataaatggcattcagtccctctatggtgagtgacactgggaaaatcagccattgtagttttgcaatgatggtcttcagaagagctttcaaatgctacataaagtatttatgatttagttcaaagcaccgtgagaatgtttggaaagcatacaaatgggcatatattgaaacgtatcacatttcccctaatgttccctttaggacctccccctgactcccctgagacccccctggtacccacggaacctgtccctccagaacctgggacgccagccaactgtgatcctgctttgtcctttgatgctgtcagcactctgaggggagaaatcctgatctttaaagacaggtcaggctgaaaaattatattttcctaccattttaatctacaatgtttagaaaggaaaacacgcagaaacttgatagagattcttagacatttaaaacaaaaacgtttcttctgagcttggaatcatttagatctggtgctgccttttcccacattttcctaaaattgtcaggttcatttttgaaggcacaggctgatctggttcttagcttctaattgctgtttccaaatgtcttaagtcacagttacttttcaaaaggcatgagtagatctttcgaataataattttatttttacttcctttaaaaatgacatcaggatcaacattacatttaatcaagtaatttacttactgatggatcaatatgcacatgacaaacattcaaagagcacaaatgagaagcaaattaaaaattttagttcccagttctccctgtactcatccagagtcaagactttttgtgcatccttccagaatctttctacacacatacaagaatatatttacacagcacatacacgtatacaaacacggcctagcttttggaagagggtatagcacacgcactgttttgcatacattgcaggtaattaaagcttatgctgggctaattcatttgcacgatagaataatttttctttcatagaagacattactctggaaacctatgacgggagactcactacagtcttctgaagaaaaaggaaagaaattttctaatggcaatatacctgatttctatctgtcatccagcctagaagatgagagaatgggggaagctgggtgaggcaagacggtgaggaaaatattctaaaggtgaaagattgtttttcaatttacatttctttttacatatattttaggcacttttggcgcaaatccctcaggaagcttgaacctgaattgcatttgatctcttcattttggccatctcttccttcaggcgtggatgccgcatatgaagttactagcaaggacctcgttttcatttttaaaggtaattactatatcatcatttgtttaacttgccaaagtaaaccctctcataagaaattgaacaacactttaattttccctactacaagttctggctaatacagtagtcaacggtaatgaagaaataaccagggctgatatcattgtatttatatttcatagatgataaaaataaagacaagaagataaattacccagagttgtaaattctctcatttgaccttagttcattcattcagtctgcaaatttttgtgaaaagcccactgtaagctggtgactaaatctaaaatttgggctactactttaccatgaaaatcaaagatgctaaagtgtatttctaaagcgaaagggcttaactgttataattcaatatgactctgaattatttatatttaacaggaaatcaattctgggctatcagaggaaatgaggtacgagctggatacccaagaggcatccacaccctaggtttccctccaaccgtgaggaaaatcgatgcagccatttctgataaggaaaagaacaaaacatatttctttgtagaggacaaatactggaggtgagatgcaagagaaatgactttgtatggagcctaattagggaaattagtttcttttactaaggaaatcccccaccccaaccttaggcctgcttctctcttagtaggaaggatgggacttcagacaactgtgggaaagttcttactttaaaacagcagcaccttaggctctcctgctttcagtcccaagtgcagttggctggtgcttcccttggtgctgtcaccccacctgcctggagccccctcttctctcctcaacctattcaaatcttgcccatccttcaagtcctggctcaagtctcatcacctccatgcagctttccctcgtggactttagacccattgggaaaatgttctgagaacccagaccgcaatttagcgttcccttcccattgtcttttagtttggctcactgtctcactgtgtgtttgtcactgtctcattgtgtgtttgttttgtcttcctaacactactatatgattttcaagggctacctctaacctcacccacttgtcacctctacctgataatgatggctcatttaagagatgatgatcaatagcagtccagtttatggatacaacccaacactcacagacaggttgattcctgggtcatttggccagactttgagacatcgaggccgaccatctgatatccagccaatgggctaaaaacacacttactgtgctttgcttcttatcctaatcccttttcccaggaggccaccagagaagatttagatgtgcaggggaggggacagcaggcatatatgggccaattgtggtagggaattaaaattgcattttagatgttgattcaattcactttatatatatgttcacactttcatgtctttgtgacagaaagatgattaaggttctttctgtccaggcttaagaaatatgatgacaaacagcatgtgctacatacagcaggatgcggcccctgttccggatggagatatggctttcagaactctttacagtaccattaaagtcacatatttctatagtcccaaatatgcttggcatttatttgcagtatttataaagtttagtaaaattccacattaaacctaacatgatctaagatgttcggtaacatggcctctatgcaatgctgagctgtttcttttacttggtacagatttgatgagaagagaaattccatggagccaggctttcccaagcaaatagctgaagactttccagggattgactcaaagattgatgctgtttttgaagaatttggtaagaggatacttactgtgttggccatagagcacttgaaacattttatgatatcagagggaagaggagcattgaaactttttaataacaagtgtttcttagggccagttccctcctcaaaattttgattcgcctacatttgtactcattatagaactacttcacaaaataacttgtttggaaccataaagataattacacaaatctcgctactttatcttatacatgcatataaaatcaaagtgctccagtgtcacttacatctcgagctaacatgtggagtcaagctcgactttcagattaccatgttagcataaaaatcccatcaagtggtgtggccaggtttaatgttggttagctggccttctcctccaccctatcttattgctgctactaattcccagggagattttttgtctgtctttcctgagttgtcagtcattgcccatgccagtcatttgcaaatacttacctttccatgtgcccaaagtttaaaaaaaaaaaaagattttgttttctactcaaggtaaggaagtggaggctgatgatctttattgaaaggtaacctgatcaccatgtttgcagagcactaaagggtcccctggtgttttgaaatagttgctgtgcttcctaggctgcaatgcagggaaaagggaggaggatttttggggaagaaagaaataggtgatgagagtttccaagcaagtggagaatttatctgatcggaagcagaataaccctgtaacctggaatctggctgtgttttcagacagagctggcaccgagtgctgtctccattcttccttgctgagtaaccttgaggaagcatcgaaatctgtctcaacctcaacttgctcaatctgtaaatggagttagacatacaacctcatagggttgttgcagaaataaatgaaaataaattcatgtaacaagcttggcatagtccctgacataaagtaaagctctataaacactttctatttttagttctctatgattctgagttttgtatattgtcaaatgtctttatttggaaaaatatcttactatttcccttgtctgtatttgcagggttcttttatttctttactggatcttcacagttggagtttgacccaaatgcaaagaaagtgacacacactttgaagagtaacagctggcttaattgttgaaagagatatgtagaaggcacaatatgggcactttaaatgaagctaataattcttcacctaagtctctgtgaattgaaatgttcgttttctcctgcctgtgctgtgactcgagtcacactcaagggaacttgagcgtgaatctgtatcttgccggtcatttttatgttattacagggcattcaaatgggctgctgcttagcttgcaccttgtcacatagagtgatctttcccaagagaaggggaagcactcgtgtgcaacagacaagtgactgtatctgtgtagactatttgcttatttaataaagacgatttgtcagttattttatcttattgttgtgtttgtttgtttcaagggcaagttgttctcataatttgggcactttatgggctgagcatgctcagccagtagactagagtctccatggcttggggttcacaatgggttccagaactgcagagaatctaccacttgccctcctcatgagccctgcaaacaggatgcttatttctaccacctagacattttatgtgtcctgacatacctaaggcaaaaaatctagaggggttgtgacattgtagagcaggctctaggaaaaactgtgaagggaatcctataatcatagcaaattgccttgtttgcacatctcattttacagggtgaggaaatcagacttgtttttcatcttttccttttacttataaattccctcagtgcaggtccctcccctgacctagcaagcaaacttcctcatatctaccctattcacatggtaaaatatactcttgtactcattttgtatctgcctgtgcctggatgtaaatgcccattggcaaatgacgattctaacattggtttatcatccataactaatgtctctagcacaatgcctcgtacatggtaagagccgtttttaacttatccattcatctgagagtaatttacaaatcatattccatatgccaggcattatgctaggttgcaggcataagaatatgaaaataatagacacaggcccctgccctcatcgagattataatccagcgaaaagaacacgtgtagataaccacaaatataaatacgcaattgtaaatttcataagagttataaagggaaaaaaataataggaggatctattttgaaccagatggttttagaagaacttttgagggaatggcattgaaggaggttttgaaaggaggtgtggagactaagaggggagatgatggcttggaccacatgggcacacgggagagttaggaatgagagtagactctatagatatgagatagataacagaacttagtgatggattagatatgcaatttgagagaaaaggaaatgttccgagtaaatcctaggtagcttgcttgagcataagagctgatggtgacggcatttactgagatggggaaagacttggagagaagaaggtttgtgaaggaagggcaagagttaggatgaattttttatgtttgcccatttttgaaatgtgttggagaaattcaagcacccaagagctaaaggaatctgaaatgcaaaagagacacacacatatatataaaacatatatgtatatggaaggtttcaacattgagattattcttaaagccagaagtatgggagagatcatatggggagagtttaagataaaactaatgaatagcaacatttggtcaaaatttacagcatttctttatttttaaaattacctaattttatttatttctaataggtactaccttagccacaacacaaaatccaaacgttaaaagacattatgcaatataaacaattttcctcccacccctgtttccaacatctaactccttttctcagaggtaaccaagcagatctttcttgaatccttccagagctattttacgcataccaagcattaatataatctttcaaaataaaaatggtactatgcaaaattacactgtcttgctctttgatttctttcacttaatgtatcttggcagctattccacattagtacatgtagaattgctttattcaatttttttttctttaggtgcacttaatttaatatcaagaccacaatacaaaaggcccaaatacaatgaaaaaacacatttgtccattaacaccaatgataatgctctttcagcacatgcctgccgaatggaatgcggatttaataaagctcactcctgaaaaaaataacccagtgagtctcaccacagccaacatccttaagcaatctggttgtgaaatgaatgtttataatgcttcaaacagcttaaacctgaagtttgataccacaccttcatgtttgcacagttctcaataagattatctac

SEQ ID NO: 825 - DNA, 45819 bp, Human
gttaagtagtttaatggagcacaaccgaaatactttctttactaatccttattcacacagcctcatccaaacttcccccaaaactgctttcttgccatttgagcaaaagcaattaacttagaaactgtggggagaagactgcttggtgaattctggagttcggggctcctcttatcctgacttgacctacctgggggcgatggctgggtccctaggcagctctatctcccccatcccacctatccctgggactgcaaagggagcttccttttggcactgagacaaggttctccgagagccacccgacctccgcagtgtctctgtcaccacgaggggcaccgcgcggcaggcatcctcacctttcctacaccgcgccaaggaggcaggagtgcactgggctacccgagcgaggcagagaacccgccgggatccagcgctggtttaccccacaccctcgtcgaaggggctctcgagggctcggtttctgcccaagccccctgcaaggtggaggcatgactcctccatcccttccccttgaattcaaacgtgaggatggtatctgcgaggctaaagcggggctcagatggcccaaacttcagaccactctcttctccactcggcttttcttccatcctcctggccatgtgtctccccgtgagtcgtggcccaagtctccccacctcggccagccgccaccctctggcctggctcccgccctcctgcccacctggccccttccccctcacccagcatgatggggctgagccgccgggccaggcctttggacaggtcgtacacgtagagcttcaccggatagagattcggcggctccattgggacccgtggcgacggcggccacgacggccctcgggcacccggcagcggcttggaccttcccgtacccgacgggagtgcgaagcggagggagagggggggaccgagcccgggcccgggctgaggggtgggggagaggccgccctgcgctgctcgcgcccccacacccgctaccggcaacgactactgtgaggtgacagagaggggacagggagggcccacacggaagagggggcgggggcagggatgcacttttgcgcatgtgcttacagtcctgacgtaggaaggggcggggctttgccgaagggggcggggctctcgctgatgggttggctttcgtcagggacataggtagaagctggttggggagtgtgcgtgccagcctgacgcgatatagtgcgcacatgcgtgatgacgtagggggcgttgattgggaccgagtacagggcccgcgcatgcgtggattgtcgtcttctgtccaagttggtcgcttccctgcgccaaaggtaagcgggccgttatccatttgtgttgttcgccagctaggcctggcctcgtcccgcttcgctcggtcggtctcgcgcgcccccatagccttgctagagggttagcgttagccttaagtgtgcgaatccgaggagcagcgacagactcgagaccacgctccttcctcgggaaggaggcggcacctcgcgtttgaggcccgcctgcgtttgaggcccgcctgcgcttgcggcccgcctgcgcttgaggcctgtctgcgtttgagatctcattgggcgtgattgaggaatttggggaggtttttgggcggtattgaggacgagggggtccgttagtcagcatagaatcctggagcgggaatccctcaccgtctaaatggcgtcgggggcgggacctccgggatctggcttccgcgggccgccgccggccctgaaacgtgagggatagctgagatgaggcagctactgggatggcccccatgcgcatttacatgcagtccgactgccgagctttcgaggcagcaggatttaccgtccacattcctcactactaaccaagcttttagaacagatctcacaagaacctagaggtcggtattttttcgatttaaatttgcctgttactgacgttaacgtctttcgcctagtgagcagtagccaacatgtcagggtgggagtcatattacaaaaccgagggcgatgaagaagcagaggaagaacaagaagagaaccttgaagcaagtggtaagtgacttcagcatgtagtgccattcggtgtgtggaagaaagaccttccctgcctatctctgctggatggactttgctgtttgatggcctgcccttctcctcccagataattctgaaattcttttcttcctttgaacttcgcagagctaccctaggctcttatatgcagatcttactctagtgtgccctaagttttttttggacactggtagtttgacatcttttggtccctgataaatggccatgaccataggtattttttgtcatcttaagtggttcaggtgagacccttctcatccaggaaagtagtgttaccattccaggacctcagtgtaaaaatgcccccaccctgcaataactacaccaaccaaagaataaacgcaagcaacacagttacaggaaagtgattgattccctcactatagcctccacgtttgggagtgtatgtgcaggcaacacagtaacacataaaacaaaggaagagaaataggggtacatgtaatcttcatactggttaatttaactcctgagcagaaaaattttgaatatttttattaaaaatgagaaacggccaggcgcggtgtctcaagcctgtaatcccagcactttgggaggccgaggcgggcggatcacgatgtcaggagatcaagaccatcctggttaacacggtgaaaccccgtctgtactaaaaaaaaaatacaaaaaattagccgggcgtggtggcggtcgcctgtagtcccagctgctcgggaggctgaggcaggagaatggtgcgaacctgggaggtggagcttgcagtgagccgagatggcgccactgcattccagcctgggtgacagaatgagactctctcaggaaaaaaaaaaaagtgagaaacataggaaatacaaaaaagaaaaaaatttgctataatctaccactctaacacaaccactaccagcattttgacatttttgtatttttctttcaagtatctttcaatatttatttcctaatgaaatatatatattttttaattttttaatagagacaggctggagtgcagtggtgagatcatcgtagctcactgtaacctcaaactcccgggctcaagtgatcctcctgcttcagctacctcagtagctgggactacaagtgccgccaactcccaataattttttaattttttgtagagacaggatcttgctatgttgatcaggctggtctcaaactcttggcctcaagcgatacccccaagccttggcctcccaaagttctaggtttatagtcatgagcctccatgcccagactgtatctgatttctttttctttttttttggagacagtcttgctctgtcgcccaggctggagtgcagtggcgcgatcttggctcactgcaagctccgcctcccgggttcatgccattctcctgcctcagcctcccgagtagctgggaccataggcgcccaccaccacgcccggccagttttttgtatttttagtagagacggggtttcactgtgttagccaggatggtcttgatctcctgaccttgtgatccgccctactcagcatcccaaagtgctgggattacaagtgtgagccactgcgcctggcctatctgatttcttgtattgtaacgatagtgcatatacatttatttatttattgagacagagtcttgctctgtcgcccaggctggagtgcactgactcaatctcggttcactgcaacctccgccaccccagttcaggctattctcccatctcagcctcccaagcagctgggatgacaggcgtgtgcgccaccacactcggctaatttttgtatttttagtagaggcagtgtttcaccatgttggccaggctggtcttgaactcctggccttaggtgattcacccacctcggcctcccaaagtgctggaattacaggtgtgagccactgtgcgtggcctatagctcattttaaatataccataatttggccgggtgtggtggctcacacttgtaatctcaataaatatactgtaatttgtctgggtgtggtggctcacgcctgtaatcccaacactttgggaggctgaggcgggcagatcacttgaggtcaggagttcgagaccaccctggccaacatggcaaaaccccatctctactaaaaaatacaaaagttagctgagtctgtggtggcatgcacttgtagtctcagctgcttgggaggctgaggcacgagaattgcttgaaccggggaggcagaggctacagtgagctgagattgcaacactgcactccagtctgggcaacagagtgaaactctatctcaaaaaaaataaaataggggccgggcgcggtggctcacctctataatcccagtactttgggaggccgaggcaggtggatcacaaggtcgggagatagagaccatcctgactaacatggtgaaaccccgtctctactaaaaaaatacaaaaaattagccaggcgtggtggcaggcgcctgtagtcccagctactctggaggctgaggcaggagaatggcgtgaacccgggaggcagagcttgcagtgagccgagattgcatcactgcactccagcctgggcgacagagtgagactctgtctcaaaaaaataataataaaataaaaaataaggccgggcgcggtggctcacacctgtaatcccagcactttgagaggccgaggcgggtggctcacgaggtcaggacatcgagaccatcctggcaaacacggtgaaaccctgtgtctactaaaaatacaaaaaaatagccaggcgtggtggcaggcgcttgtagtcccagctactcgggaggctgaggcaggagaatggcgtgaacccgggaggcggagcttgtagtgagccgagattgcgccactgctctccagcctgggcgacagagcgagactccgtctcaaaaataaaataaaataaaataaaataggtcaggcacggtggctcatgcctgtaatcccagcatttttggaggccaaggtgggcagatcacctgaggtcaggagttcaagaccagcctggccaacatggtgagatcctgtctctactaaaaatacaaaataagccaggcgtggtagcgcatgcctgtaatcctgctactcaggaggctgaggcgggagaatcgcttgaacacgggaggtggaggttgcggtgagccaagatcgcgtcatcgcatgtttaaggttcttgacacacattgccattttgttctccaggagacagctaattaaacttattaagaagcagcaggccatgcacagtggctcacggctgtaatctcagcactttgggagtaggaggctgaggcaggctatcacctgaggtcgggagtttgagaccagcctgaccaacatgatgaaaccccatgtctactaaatacagaaaatttgctgggcatagtggcacatgcccgtaatcccagctacttggagatgaccagacattatatacctttttaggaaaaaatatgttacttatgataaagtcatgctgaagaaagaaaacctgaatcagattaagcctctctaggtccttagtaggaaggacagaggactctgttaatctacaccaaaagaggtcaatcggcaggccaggcaaggtggctcatgcctgtaatcccaatactttgggaggccacggcagaggatcgctcaagcccagaagttcaaggctgcagtgagctatgattgcgccactgcattccagcctgtgtgagagaacaagactgtttctaaaataattaattcaataattttatttttttatttgagatggaatctctgtcgccaggctggagtgcagtgactaatctcggctcgctgcaatctctgcctcccaagttcaagtgattctcctgcctcagcctccctagtagctggaattataggcatgcgccaccacacacagctaattttttgtatttttagtagagatggggtttcaccatgttgtccaggatggtctcaatctcttgaccttgtgatccacatgtctcggcctctgaaggtgctgggattacaggcatgagccaccgtgcttggccatttatttatttttattttttttgagacgggttctcgctctgtcacgcaggctggagtgcagtggcgcgatcttggctcactgcagcctctgcgtcccagattcaagcgattctcccacctcagcctccatagtagctgggattacaggcatgcgccactacacgcagctaatttttgtatttttagtagagatggggtttcaccatgttgtccaggatggtctcaatctcttgtcctcgtgatccacatgcctcggcctcccaaagtgctgggattacaggcgtgagccactgtgcccagccaaaataattttttattttttatttatttttttgagacagagtcttgctctgtggcccaggctggagagtagtggtgtgatctctgctccctgcaacctctgcctcccaggttcaagtgattctcctgcctcagcctcctgattagctgggattacaggtgggcaccaccacacctggctaatgtttgtttgtttttttttttgttttttttttttgagaccgagtctcactctgtcacctaggctggagtgcagtggcgtgatctcggctcactggaagctccccctcccgggttcatgccattcccctgcctcagcctcccgagtagctgggactgcaggtgtccaccaccacgcccagctaatttttttttgtatttttagcagagacagggtttcaccgtattagctaggatggtctcgacctcctgacctcgtgatccgcgcgcctcggcctcccaaagtgctgggattacaggtgtgagccactgcgcccagcctaatgtttgtattttcagtagacacagggtttaaccatgttggctaggctggtctcgaactcctgatctcaagtgatcctcccgccttggtctcccaaagtgttgggattacaggcatgagccactgtgccccgcctaattaatttttttaaaaaggcaatcagcaaaattcagaatgtggaaaagtgtataacacaaagcatcttggctcttcagaagataaattacaagggaaaaaagagagggtatctgtagatgaagaggctttagaaaattaagtcaaagctaatgtttagaaatgtaggtttgggtgataaaattataaagaaacgtaaggggtgggtgtgtggtagatcatgcctataatcccagctcttaggccagggcggggtggggtgcggtggctcacgtctataatcctagcactttgggagtctgaggtgggtggatcacctgaggccgggagttcaagaccaacctgggccaacatggtaaaactgcgtctctactaaaaatacaaaattagctgggagtggtggcgggcgtctataatcccagctagttgggaggctgaggcaggagaatcgcttgaacctgggagacggaggtcgtagtaagccgagattgtgccactgtactccaccctggcaacagagcgagactccgtctcaaaaaaaaaaaaaaaaaaaaaatagaggcctggtggggaggattgcctgagctcagaagttttagatcagcctgggcagtgtagcacaataccatctctacagtaaacttaaaaaattagctggtcatggtggcacacacctgtagtcccagttgctcaggaggctgagtcaggatgatggcttgagcccaggagttcgaggttgcagtgagctatcatcgcgtcactgcactccagcctgggtgatgggagtgtgaccctatctcagaaaaaaaagtcaggatattgacttttttggggaggtgggtgttgtaattgggagggaatgtaagagggatttctggggtgtctggcaagactcaatttcctgacataggtggagattttatggttgttcaccttataataatttattaggttatactttcctttatggcctttatttatcttatatggtaaacaaatacgaaaacaaggacaaacattttcttccatttttttccccataggagactataaatattcaggaagagatagtttgatttttttggttgatgcctccaaggctatgtttgaatctcagagtgaagatgagttgacaccttttgacatgagcatccaggtaagactaccttttaatttaagacaaatttaaaaacagtattggctgggcatggtggcggctcatgcctgtaatctcaggacattgggaggccgagacgggcagatcacttgagcctaggagtttgagaccaacctggtaacatggagaaaccccgtctctacaaaaaatacacaaatcatccaggtgtggtggtgcaaacctgtagtcctagctactcaggaggccgaggcgagaggcttgcttgagcccaggaggtcaaacagaaaaaagaagtaggctcctcctcttgcagagatggaagtataaaggaagaagggaagttcccacagttatagtgtggaaaagagtgagtgatacttgggagttgactactgcctgtggttggggaagatggctacaataaaaaggcaacttcaattttaaaacaggcacaggacttgaaaagacatttctccagctgggcgtggtggctcatgtctataatcccagcactttgggaggctgaggcaggcggatcatgaggtcaggagaccagcttggccaacatggtgaaaccctgtctctactaacaatgcaaaaataattagccaggcatggtggtgcgcttctgtagtcccaggtactcgggaggctgagtcaggagaatctcttaaacccaggaggcggaggttacagtgagccgagattgtgccactgcactccagcttgggcaacagagtgagactctgtctcaaaaaaaaaaaaaaaaaaaaaaaacaattctccaaagatatgcagatgtccaacaagcacaggaaaagatactcagcatgtttagtcattagagaaaggcaaatgaaaaccataatgagctaccactcacacccactatataaacaaactaaaatttaaaaaacaccagcagaaaataagtgttggcaaggctgtggagaaattggcgtgattgactgtacctgacctgttcttgtttctttaaattgaggttgtgtttcatgtaacataaaattaactatttgaaagtatacaattcagtgacacttaacacattcacaatgttatgcagccaccacctctatcttattccaaaacattttgaatggctaaacagtggcatatagatatacattccatgaaaaggaatgaataattgatacatactacaaagtagatgaatcttgaaagtattatgctaagtgaaagaagccagatacaaaaagtcaaatattgtatgatttcatttacatgaaatatccagaataggtaagttcttaacgcagaggggtggttggttacctgaggcacagggaagagaggaacagggagcaactgctcaatgggtatggggtttgcttttggggtgatgaaaattttttggaactagagttggtagttgcacaacattgtgaatgtttgtgtgtgtatttatttatttatttatttttattattatttttgagacggagtctcgctctgtcacccgggctgtagtgcagtggcgtgatcttggctcactgcaagctccgcctcccgggttcatgccattctcctaccttagcctccagagtagctgggactacaggcacctgccaccatgcctggctaattttttgtgtttttagtagagacggggtttcaccgtgttagccaggatggtctcaatctcctgaagtgatccgcctgcctcggcctcccaaagtgctgggattacaggtgtgagccactgcgcccagccttgtgtgtgcatttatgctttttttttttttttttttgagttggagtctcgctctgtcaccaggctggagtgcagtggcacaatcttggctcactacaacctctgactccctggttcaagcgattctcctgcctcagcctcccgagtaggtgagattacaggcacgtgtcaccatgcccagctaatttttgtatttttagtagagatggggtttcaccatattggccaggatggtcttggacccctgacctcgtgatctgctcgcctcggccttccaaagtgctgggattgcaggcgtgagccatggcacccggccttgctttttttttttgagatggtgtctcactattgctcaggctggtttggaactcctgggctcaagcaatccacccacctcagcctcctgtgtggctggggttaaggcatgtgccactatgcctggcacattgtgaatgtattaaatacctcttaattgttcacttagaaaatctaaatttcagcttaattaaaaagattagtgtttctttttttttttttttaatttattttttttattgatcattcttgggtgtttctcacagagggggatttggcagggtcataggacaatagtggagggaaggtcagcagataaacaagtgaacaaaggtctctggttttcctaggcagaggaccctgaggccttccgcagtgtttgtgtccctgggtacttgagattagggagtggtgatgactcttaacgagcatgctgccttcaatccatttaaccctgagtggacacagcacatgtttcagagagcacagggttgtggggtaaggtcacagatcaacaggatcccaaggcagaagaatttttcttagtacagaacaaaatgaaaagtctcccatgtctacttttttccacacagacacggcaaccatccgatttctcaatcttttccccacctttccccgctttctattccacaaaaccaccattgtcatcatggcccgttctcaatgagctgttgggcacacctcccagacggggtggtggctgggcagaggggctcctcacttcccagtaggggcggccgggcagaggcgcccctcacctcccggacagggctgctggccgggtggggggatgacccccccacctccctcctggacggggcggctggcagggcggggggctgacccccccacctccctcccggacggggcggctggccaggcagaggggctcctcacttcccagtaggggcggctgggcagaggcgcccctcacctcccggatggggcggctggcctggctggggctgaccccccacctccctcccggacgggtcggctgctgggcggagaggctcctcacttcccagatggggtggctgccgggcggaggggctcctcacttctcagacggggcggctcccggacagaggggctcctcacttctccgacggggcggttgccgggtggagggtctcctcccttctcagatggggcggctgggcagagacgctcctcacctcccagacggggtcacggctgggcagaggcgctcctcacatcccagacggggcggcggggcaaaggcgctccccacatctcagacgatgggcggccgggcagagacgctcctcacttcctagatgggatggcggctgggcagagacgctcctcactttccagactgggcagccaggcagaggggctcctcacatcccagacgatgggcggccaggcagagacactcctcacttcccagacggggtggcggccgggcagaggctgcactctgggcactttgggaggccaaggcaggcggctgggaggtggaggttgtagcaagccgagatcacaccactgtactccagcctgggcaccattgagcactgagtgaaccagacaccgtctgcaatcccggcacctccggaggccgaggctggcggatcactcgcggttaggagctggagaccagcctggccaacacagcgaaaccccgtctccaccaaaaaaatacgaaaaccagtcaggcgtggcggcacgcgcctgcaatcgcaggtgctcggcaggctgaggcaggagaatcaggcagggaggttgcagtgagccgagatggcagcagtacagtccagcttcggctcggcatcagagggagaccgtggaaagagagggagagggagaccgtggggagagggagaccgtggggagagggatagggagagggagagggagagggattactgtttcttttgtgtacttcgtagagaagaattttcacagatttattatatatctcatgtctcataattttagaatttggaactgaacagaaacttttcatgttctaatttgtgtacaaatagttcttggtaggcagggtgtggtggctcacgcctgtaatcccagcactttgggaggctgaggtgagtgaatcacttgaggtcaggagttcgagaccagcctggccaacatggtgaaattctgtctctactcaaaatacaaaaattagccgggcatggtagtgcaggcctgtagttgcagctattcaggaggctgaggcaggagaattgcttgaactggggaggtggacgttgcagtgagccaggatcacgccactgcactccatcctgggtgacagagagagactccatctcaagaaaacaagaaatagttcttgtagttggcacaccagaatatcttgcaccaaaaaaaaagaataagctgggtgtggtggtgtgcacttgtagtcccagctactcaggaggccggggtgagaggattgcttgagcccaggagtttgaggctgcactgagctatgattgtgccagtgaactctagcctgggcaacagagtaagaccctgtctcttggaaaaaaaaaaaaaaagaaaaggctgggcgcggtggctcatgcctgtaatcccagcactttgggaggccgaggtgggcggatcacgaggtcaagagatcaaaaccatcctggccaaaatggtgaaacctcgtctctactaaaaatacaaaaattagctgggtgtggtggcgtgcgcctgtagtctcagctactccagaggctgaggcaggagaatcgcttgcacctgggaggcagaggttgcagtgagccgagatggcactattgcagtccagcctgggcaatagagccagactctgtctcaaaaaaaaaaagtgtatgtaaaataaaataatagaactatgaataaaaacaatcgttaatttaaagtggttctcaaacagaattacttgcaggacattaaaacacagactacagaaccttgccccacaatcaaaatttctgattctctatgtctagaatggggaccaagaatttgcatttctagtaaattgtcaggtgatgctgatgttactgatttggagaccattactttgaagagcagtgctttaaccttttttagaccgtggacctatttttttttttttttgagacggagtctcgctttgctgccctggctcttggctcactgcaagctctgcctcctgggttcacaccattctcctgcctcagcctcctgagtagctgggactacaggcacccaccaccacacccggctaattttttgttcttgttttttagtagagatggggtttcaccatgttagccaggatggtctccatctcctgacctcgtgatctgcccacttcggcctcccaaagtgctgggattacaggcgtgagccaccgcacctggccaaccgtggacctctttgaggatatgatgacagctacataccttcccctcaaaaaagatagtactcacaattctacctgtaatttcagagagttaatggaacccttgatgcctaaagacctcagaagaaaatgtagtgttaggtaggaaggaaatgagacattcatagatgagcacaatttgataaccgataataagtattcagtagttgataagcaatagaaaacattttctaaaattctgttttagtttttgtttttaatttttagaacctaaaaggagcccttaccagattcttttaaaagtttgtagactcctcagagtagattaaaatatttatggaaatgactacttgccatgtggattgttgtcagtgactagctatagtacatgttctgcatttaaggagagaatagctgtggacgaaggccagctagagctcaggcaggacatggaggggatcaccatggttggtttattcctcagctttgcaggttccaaaacttaatttttttttttttttttgagacagggtctcgctctgtcatctaggctggagtgcagtggcatgatctctgcccactgcagccttgacctcctgtgctcaggtgatcctcctgcctcagcacccctgagtagctgagtagtggggactacaagcatgtgcatgcccagctaatttttttgttttttgtagagacattgttttgccatgttgcccaggctagtttcaaacttctgtagcaatcctcctgtgttggcctcccaaagtgctgggattataggcatgagccactgtacctggcccgaagacttaattttgttagtgctccagaattaggtaggcccctagaactgatgaactctcttttttttttttttttgagatggagtctcgctctgttgcccaggctggagtgcagtggcgcaatctcagcccactgcaacctccacctcttgggttcaagcgattctcctgcctcaacctcctgagtagctaggattacaggcacgtgctaccacatccaactaatttttgtatttttagtagagttggggtttcaccatgttggtcagaatggtctcgaactcctgacctcgtcatctgctcgccttggcctcccaaagtgctgggattataggcatgagccaccgcgcctgggtgaactgatgagctcttacaagacctgatgtaccagatgctgacattagtttatatagaggggtagacctttcctgttactggaatactgatgtctttaactgggtagttaaacagttttatttcaaggatgcgcttactggtagttattgacttattttcaggtcacatgtacttaagcattgtaattattttatatagtcatcccttgttattgagggaattggttgcaggactccccgtggattccaaaatccgaggatgcccaagtcccttaaataaaatggcatagtatttgcatataacctacacacatcctcccctatactttaagtcatctataggttactcatagtacctaatacaatgcctatgcatcacttcattcacatggcttcaatgtagtacttggcacatggcaaattcaggttttgctttttgaaacgggaatttctttgtttttcctgaatatttgagatttgaggttggttgaatacatagatgcagaaccagcagatatggagggccaactgtgtatataaactctgtttcctgataccaaggtacttgaaagatcacatgacctgtccaaattcagccagttaagtaagtgacatcagtaggactcaactccaggttttctgattccaatgctttgcttcgccccaactcccatagcacaatttcctccctctgatacttcttttccttttttcttgagataaggtctcactctgttgcccaggctggactgtagtggtgcagtctctgctcactgcagccttcacctcctggggtcaagcgatctttcacctctgcttcccaagtaactgggaccctgtgctgccatgcccagctaatttttttgttttttttttgtttggtagagatggagtctcactatgttgcccaggctggtctcgaactcctagggtcaagtgattctcccacctcagcctcccaaagtgctgggattgctacagatgtgagccactgtgcctggcctgaatatacgtattgttaattctctgatttcaatggcagggactgcttatacttctaatgtatacttactgcattctggtttttgttaaaatttgatatttatggccattactttcactgattcattacccctgaaggtagggatcttgccttattttagtgccatatacaaattcagtgcacatattttgagcaactaataggtactgagcacttatggagcttccatttagtggtaagtaaatattaattgaattttttttttcagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtcagtaatattttaagatcagcttttcccttatatatgagaatatcagtactctgatcaaagaggactgtggagaaggaagcaagttacatcttgtctaggagtatgctttcctccataaggggaccttgctcgatgtggactttgttaaatgggttaaacagctctggggtgaaaaagggtccttctgttagtcttgtggtaaaggcagccactgacattcttctgatttttctttccatttgactccctgcctctgatcaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggtgggcatatttccccgttctcttaaattggcacttaattattgtttttttattttttatttttttaggagttcaggagtcttggctcagcctcagcctcccaagtagctgggactataagcatgtgctgttgtgcccagtgcagttttattgctttctgtgtacctgacttcaggcatgtgctttttaccatttagaataaaataaaaaaataaagtgaagccagaagatgcctgtgtaacattaacactgcagatggccatgccattagctgtctaaaggactctgtcagaacaagattgtcttgattttttttttttttttttttttgagacggagtctcactctgtcccccaggctagagtgcagtggcacaatcttggctcactgcaacctccgccttccagattcaagcgattcacctgcctcagcctcccaaatagctggaattacaggcatgaaccactgtgcctagctaatttttgtatttttagtagagatgggggtttcaccacgttgaccaggctggtctcgaactctggacctcagatgatccaccacctcgccctcccaaagtgctggggatgacagatgtgagccactgtgcctggccagttgtcttgactttaatattaccacgaatggtgattatttgaaaagttgtctgaagtcattatagcagttggtttccttagtcactttttctaagtcctgaaaatgttaatagtctagttttcagggagcttttaaaagcatgtttcagttttaactgaaagaacttctcacttgctgaaaattgttttttcctccctcacttttgtttacccttgcaacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggtgtgcactcagcccgggtcagctgcctacactgcccttaaatcagaagcaggctgggcgcggtggctcacacctgtaatcccaacagtttgggaggccaaggcaggcggattgcttgagcctaggagttgagaccagcttgggcaacatggcaagaccctctctctacctaaaaaaaaaaaaaaaaaaaatcagaagcaatgcactgctacacattgcttaacaaaccagaagcaatacattgctctgacctgactggctacttaactcgactatgccactgcctcactgtcttcctctaaaatagtttatttcaggatagcagaagctatttgctgctttatctctggcaagagctggcatgatatttctctaaagtaacacagccctccatttcgtgggggtagacagttatggtctaagagtatccttagctgtactcactagtacagtcatgtgttaattaatgatagggataccttcttagaattgcgtcattaggcgattttgtcattgtgcaaacatagagggtacttcacacacccagagagtacagcttgactacacacctgggctgtgtggttagcctgttgctcttaggctacaaacctgtatagcatattaccatactgtttactgtaggcaatggtaagtatttgtgtatctaaatgtatctaaaggtatagaaaaggtacaataaaaatatgatataggccagacacggtggctcacgccttgtaatcccaccactttgggatgccgaggcgggtggatcacaagttcaagagattgagaccatcctggcctacatggtgaaaccttgttctctactaaagatacaaaaattagctggacgtgatggcgcgcgcctgtagtcccagctactcaggaggctgagaatcgcttgaacccaggagtcagaggtggcagtgagccaagatcatgccactgcactccagcctggtgacaaagtgagactccgcctcaaaaaaaaaaaaaaaaaaaaaagaaatatggtataaagataaatggtatacctgcatagggcacttaccacgaatggaacttacaagactagaagtggctctgagtgagtagtgagtgaaagtgaaggcctaggacatgactgcatacttttatataactggcagcacagtaggtttgtttacacagcatcactacagatgcatgagtgatgccttgtgcgacaaacttacgacagctatgatgtcagtaggtgacaggaaattttgagcttcattatcatcttaacagaccatcattgtatgtgcgccctattgttgaccaaaatgttagtggtgcatgagtgtgcattatttgctttattcttctctgtaaattggtgacaacaatacctgcctcattaggttactgtgaagagttagtgaagagcacaaaacagagcctgttagggagcaaaaactcataaatgttagttatgatcattgttaaaattgtgtcattctgatttcttataaacctgagaccaatgggaaccagattgctagattctttttcttttttttttttttttttttttttttttttgagacaaagtctcaccctgttgcccaggccagagtgcagtatgatcacagctcaccttagcctcgacctcctgagctccagtgatcgccccatatcagtgttctgagtaactgggaccacaggcgtgtgccaccatgctctgctgattattttttatttttatttttattttttgggagatggggtctcactgctttgcacaggctggttgcaaactcctgggctcaagaaatcctcccatttaggcctcccaatgtgctgggattacaggcgtgagctaccatgtgtccatgtgtagcctagattctctctctttttttttttttgagatggagtcttgctcttttggccgggctggagtgcagtggtgcggtctcaggtcactgcaagctccgcctcccgggttcatgccattctcctgcctcagcctcctgagtagctgggactacaggcgcctgccaccacacccggctaattttgtatttttagtagagacggtttcaccgtgttagccaggatggtctcgatctcctgacctcgtgatccgcccgcctcggcctcccaaagtgctgggattacaggcttgagcctctgcgtccggcctagattctgttttttttagagagccttgatattagaatcctaaaggttactcattgtttcttcctaaagacctacagccttttatttattaagagacggtgtctcactcttgcccaggctggagtacaatggcaccacagcctacaactcctgggctcaggcagtcttctgtggtcttcctgtctcagcctcccaagtagcttttttttgagacagagtcttgctctgtcgcccaggctggagtgcagtggcgtgatctcagctcactacaagctccgcctcccgggttcatgccattctcctgcctcagcctcccgagtagctgggactacaggcacccgccaccacgccgagctgatttttttgtatttttagtagagacggggtttcaccgtgttagctaggatggtctcgatctcctgaccttgtgatccacccgcctcagcctcccaaagtgctgggattaagggcgtgagccaccacaccctgccccaagtagctttttttgtagacttggggctcttggtatgttaaccaggctggtctgagactcctggcctcaaacgttcctcctcaagctttcattctggagtggtttcctcagtataggggtccatgacctttggtaacttttaagcagtttttaagagtttactgacaattctaccagaaaacccaagaaatttttttgaggagaccttgaatcactcattgccacagttgtagttttgtcattgttctccttttcctcttggaaactatttttctttcctcagacaagtatcttgtcacctcttcacctgtcttgaaatgatgcgatgttgtttatactacagtttggaagtctactacacattttggtggagatggatggggaggatagaatagtgggtaaatgtaggccttgttgtcagattgtttggattctagtcctggtccctttgctatgcgacctgacttctctgagccttagtaaaatgggagcaaaaaatggtacctccttgggtaggtgcagtggctcacgtctgtaatcccagcatgttagtaggccgaggcaggaggattgcttgagtccagaagcaagaccagcctgggcaacccagggagaccctgtctctctttattaaaaaaattaaaaaactgtactttcacataggattgccgtgagcattaaatgagataacctaggcatagtgcttggcccgtggtaattatttataaatgttagctgttcttattttgtggaacagtcattgtaggatggatacttgatataaataataataaattggagatattgagaactaacaatgccttagggctaaggcctagaaaaatattaaacttagctttttaaaaaatttttaatttttgtgggtacatggtaggtgtatatatttataggatccatgagatattttggtataggcatgcaatgcgtaataattacatcagcatagatgggttatctatcaccttaagcactaatcctttgtattataagcaatctgattatactcctttagttattttaaaatgtactgttattattgactatagtcaccctgatctgctctaaagtattagatcttattcattctttctattttttgtactcattaaccatccccactgccccatcactacccccttacccttcacagcctctggtaaccatccttttctgtgtccatgagttcaattgctttactttttatctcccagaaataagaacattcaaagtttgtctttctgtgcctggcttatttcacttaacatagtgaaacaacattgcatagtgaatgcaacaacatttatgttgttaccaatgacaggatctcctttttttttgagcctgagtcttgctcttgttgcccaggttagactgcaatggcgcgatctcggctcactgcaacctctgccttctggattcaagcagttctcctgcagcctcccaagtagctaggattacaggcatgcaccaccacgcccgactaattttgtatttttagtagcgacacagtttcaccatgttgaccaggctagtctcgaactctggacctcaggtgatccacctgcctcaggatctcattttttatggctgaatagtactccattgtactacactttctttatccattcttcttttgatggacacttaggtcgcttccaaatcttggctgttgtgaatagggctgcaataaacatgggagtgcagatatctctgatatacagatttcctttctttggggtgtatacctagcagtgggattgctggatcatacagtagttttctttttagtattttcaggaacctccaaccattttaactgaggtgagatgatatctcagattatgttagagttttttcctgtagagttgtttgggttccttatatattctggttcttaatcccttgtcagatggatagtttccagatattttctcttctctttgtcgatcatttcctttgttgtgcagaagctttttaacttgatgtgatcctatttgtccgtttttgctttggttgcctatgcttctggagtattacttaagaaatctttgccaagctcaatgtgctggagaatttcccggtatgattttgtggttccacatacattttaggattgttttgtctatttctgtgaagaatgtcattggtattttgatagggattgcattgaatctgtagattgctttgggtagtctgggcattttaacaatatttaaacttactgtagcaatctatagagtgagaccctgtctacaaaaaaaaatagttacttttgaagattgtgcagttttgtaattggttgcatttatcgtcaactctccttcaagcagcctttagacactgattttcacatctaagaagccaccaaatggttgatgttgttagtaatgcatctgttaccaacactcatctgtgagtcacatcatgcatttccaagttgatctgaaggtatattaggtgcttgccccaggaaccaaaatttctatttgtggctctgctcaaaaccagtgttgtctccacggtgtgaacctgtatatcttcgaactatacagacacttgtctaaacatgttcttttctttaaatactgctaggtgttccacaacagtgaagatttggttattggagactgttcttttctgataaaagtgttatagctggccgggtgcggtggctcacgcctgtaatcccagcactttgggaggccaagggggcggatcatgaggtcaggagttcgagaccagccacaccaacatggtgaaaccccgtctctactaaaaatacaaaaattagccaggcttggtggtgggcgcctgtagtcccagctactcaggtgactgaggcaggagaatcacttgaacccggttggcggaggttgcagtgagccgagatcacaccactgcactccagcttaggcgacagagcgagactccatctcaaaaacaaaagaaaacaaaaaagtgttaaagctgtaaatttgtctctgagcatggctttagctgcatcgtatacattttgatatattgtgtttttactttcatgcagttcaaaataattttaaattttctggccgggcgcgctggctcatgcctgtaatcccagcactttgggaggccgagacgggtggatcacctgaggtcagtagtgccagaccagcctggccaacatggcgaagcaccgtctctactaaaaatacaaaaattagctgggcgtggtggtgggcacctgtaatcccagctactcaggaggctgaggcaggagaatcacttgaactcgggaggcggaggttgcagtgagctgagattgcgccactgcactccaccctaggcgacagagtgagactccatctcaaaaaaaaaaaaaaattagctgggcgcagtggcatgtgcttgtagtcccagctacttgggaggctgaggcaggagaatctcttgaacccgggaggcggaggttgcagtgagctgagattgcgccactgcactccaccctaggcgacagagtgagactccatctcaaaaaaaaaaaaattagctgggcgcagtggcatgtgcttgtagtcccagctacttgggaggctgaggcaggagaatctcttgaacccgggaggcggaggttgcagtgagccgagatggcgccactgcactccagcctgggtgacagagcaagaccctgtctccaaaaaaaaaaagaaaaatgttttcctcgtgatttcttcttgggttttttataagtgtattgtttaattttcaaaaatttcaggttttcccacatttctttctgttgtggacctctaacttagctccattgtggttaaggaacatactttatgggatttcaacctttttccatgtactgagacttgttttgtggcccaacatatgatctctcctagagaatgttctatgtgcttgagaagaatgtgtatcatgggttattttacgttctttttttcccccataatataagaattttttgcatattgtaaatatatgtgtacattgttattattgcagaacacattttctttttttggagatggagtcttggtctgtcgtcccaggctggagtgcagtggcacgatcttgcctcactgcaacctctgcctcctgggttcaagcaattctcctgcctcagcctccatagtaactgggactgcagatgcacaccgccacgcctggctaatatttttttgtattttagtagagatggggtttcaccgtgttgcccaggctggtctcaaactcctgagctcaggcaatccgcccgcctcagcctcccaaagtgctaggattacaggcatgagccactgcacccggcctgcagaacacattttcaagaggtcctgttgctgcttaagctgttggtataagtgctctggagtaatatgtcatgatggaaaagtacatgagctttgaaacagggatacttgagtttgaatatggatttttattgtgtgtccttgggcaagtcatgtaacttctctgagccctcacttatagaaggtcaataataaggttcttgagtggcaagcaataaaaactgaccttgagctgggggctgtggctcacacctgtaatcccagcactttgggaggccgaggcgggcggatcacctgaggtcaggagtttgagaccagcctgaccaatatggagaaagcctgtctctactaaaaaatacaaaattagcctggtgtggtggtgggtgcctgtaatcccagctactcgggaggctgaggcaggagaatcacttgaacccgggaggtggaggttgcagtgtggagatcgtgccattgcactccagcctgggcaacaagagcgaaactccatctttaaaaaaaaaaaacaaaaaacaaaaaaaaacaaacaaaaaaggctgaccttgactaatttcagcgtatgagtcaaataattagttctaggaatctacgtagcaggaactaatgacagtgtctttagggtgccattatgagaagaaagtatcctctggaatcacatcctttcatggccactgctcagagaccccgactctcagatgagaacgtcctatggccttctccagggtcagatatgcccaccacttggccagaagaaggcacagcaacttgagtttgactaacattctcccaaaactgtagtcggggaagggtaattcccaaagaaaaattggggtgtttttttgttttgttttgttaagtaacccttattttgatggggctttattctttcttcttttttttttttttttgagatagagtctcgctctgtcgctaggctggagtgcggtggcacgatcttggctcactgcaacctccaactccctggttcaagcgattctcctgcctcagcctcccgagtagctgggattatagactgtgcgtgcgccaccatgcctggctaatttttgtatttttagtagggatggggtttcaccatgttggccaagctggtctcgagctcctgacctaggattacaggcctaagccaccgcacccggcatgatgggtctttattcttcaaagcaggaggaagggatcctagaaaaacagagacaaggccaaacatggtagctcacacctgtaatcccagcactttgggaggccagtgcgggtgaatcacgaggtcaggagttcaagaccagcctggccaacatggtgaaacaccgtctctactaaaataaaaagaaattagctgggtgtcgtggcaggtgcctgtaatcccagccacttgggaagctgaggcaggagaatcgcttgaacccgggaggtggaggttgcagtgagccgagatcacgcgactgcactccagcccaaccaatagtgtgagactctgtctcgaaaaaaaaaaagcagagacaagacaactagtacagtacttacagggttattatgatgattaaatgagagaatagctgtgaggtgattgatatagtgctgtgcttaatacaaactatcattttattatacgggttgagtgtttctaatctgaaaatccaaaattagaaatgctctacagtctgaaacttttttgagcaccgacctaatgttcaaaggaagtgcttattggagcattatgggttgttagatttttgggttgggaatattcaaccagtaagtactataaaatgcaaatattccaaaaaaaatctgaaatctgaaacatttctggtcctaagcaagcattttgcaaagggatacgcaacctgtagtacgttctttatcattgttttaagtagttaatatattgtggtacagattctgaggtggtatagcaaattcgattgtattattaaaaagcatatttatattttgagagcttgcttaggattattggagagaataaaacagtgaagctttggtgttatgagggaattttagatagaaaagtgcagtttttcagttcatgctctttcattttttactccctcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcaggtaggtagagatgccttttgttgttgttgtttttgagacagggtctcattgtgtcgcccaggctggagtgcagtggggcgaacatgactcgctacagccttgacctcctggactcaagcgatccttctgtctcagcctcccaagtagctgggatcacaggcatgtgacatcacacccagctaatttatttatttatttattttttaagagactggatcgactgggcacagtggctcatgcctgtaatcccagcactttgggaggccgaggcaggtggattaccgaggtcaggagttcaagaccagcctgaccaacatggagaaaccccatctctactaaaaatacaaaatgagctgggcatggtggtgcatgcctgtaatcccagctactcaggaggctgaggcaggagaatcacttgaacccgggaggcagaggttgcggtgagccgagatcacgccattgcgctccagcctgggcaacaaaagcgtaactccgtctcaaaaaaaaaaaaaaaagagacggtgtctcgctatgttgcctgggctggtgtcaaactcctggtcttaagtaatcctcctgctttggcttcccgaagtgctggggtgctgggattacagacattggccactgtgcccagcgtttttttgtttcgttttgttttgttttgtttaatagagatgaggtctcactatgttgctcaggctggcctcgaactcctaggctcaagcagtactcctgcttcagcctcctaaagtgctgggattataggtgtgaaccaccacacctaacccaagatgctttcttactgaattttctccaactgaagagttaactaggaggagagacattgatcaggctgaccagttaaataactttcatatgtgcatctttcctttccttctccttccctttccttttcttttttctctctccgactccctcccctcccctcccctcccctcccctcccctcccctcctctcccctcctctcttctgtttcttttctttccgctagtcaagtgaagcagtgggaatggaaaaggaacaaagaaatctgtaactggttgtgatcaattagttgtaaacaccaccgcacttggacgagccatgtgcacctttcttgctaacctgttaaaccacaaagacttaactctttgggactgtggtatctggatcagtgatattttgatagctagaaagttaaactgggccagtgtctgaaagagatgtcagtgaaaacctcaccccttcatcactcagtacatgctgctgtcagtctaacagtcttgctcaggtacaatagcagaaaatactttatagttaattagggagataaggagttaggaaaagtatgaagtgtgaagtgaactcattttttttagggagagaatttatttttgctagtgatatttttcctgtgccttgggatgacatacatctccctttctgcatctgaaagacagatgcaggacgcagaacattgtcttttctcatcctcttacctttgctcagtctatagagggatttaacatcaaaaattaaaattgaatgagtcatgcttcctgtatgcaaaatgtggaagaatctgagattttacataagtttagggcctataaggatgactaaaatattattttgattcaagccagagagttttgccctactctttgaaggagaaaaagataaggaattttcttttccattttggaagtaactaattttttatattgatttattcataggcagtaagctctctggtcactgagtttctttcttggtccagtatgtttgaaaaaaccttgagagttcttttgttcataaaacccaaatttgaatctgctactaagctgttattagtcacatatccaggataaaatacaaacatcattgggtatggtggctcatgcacttttggaggctgaaacaggaggatcacttgaacccaggagtttgagatcagcctgggcatcatagcgagaccctgtctctactaaaaaactaaaaattagccaggcgtggtggtgcacagcctggggaagagagtacaaaaaaaaaaaaaatatatatatatatatatatatatgtatgtatgtgtgtgtgtatatatatatctctctccaaacaatacaaataatctttgcagtagcgccatcatggttgactgtagcttcaacctcttgggttcagttgatcctcccacctcagccacctgggtagctgggactacaggctcatgccaccacgcctggctaattttttgtatttttttttttttcatagagacaggatctcactatgttacccaggctggtctcgaattcctgggctcaaacgatccagctgccttggcctcacaaagtattgggattacaggcatgagtcaacgtgccctgccttggaagtagtacttatatgtgtgtgtctctgccttccacattgagacctagcacagtacctgacataggtcctctcatttaataaatagatgtggtggccgggtgcggtggctcacgcctgtaatcccagcactttgggaggctgaggcgggcggatcacgaggtcaggagatcgagaccatcccggctaacacagtgaaaccccatctctactaaaaatacaaaaaaattagccaggtgtggtggcgggcacctatagtcccagctactcgtggggctgaggcaggagaatggcgtgaaccccggtgggtggagcctgcagtgagccgagatcgctgcctgggtgacagcgagactgtctcaaaaaaaaaaaaataataaataaataaataaatagatatggtttgggctgggcacagtggctcacacctgtaatcccagctagtcaggaggctgatgcaggagaatcacttgaacctgggaggttgccgtgagtcgagattgcgccactgcacgccagtgacagtgtgacagactgcatctcaaataataaataataataaatagatatggtttaagcatgctttgtgtgtcagggatggtgctgacaggtcagtacatttttttttttctttttttgggttggggggatagagttgctctggtacccaggttgcagtgcagtggcgccatcttggcacactgcatcctcgaactcctgggctcaagcgatcctccagtctcagcctcccaagtagctgggaccacaggtgtgtaccactataccgagctaatttttaatttttttatacagatagggtcttgccatgttgtccaggctggtcttgaactcctgggctcaagcagtcttgcctcagctctcaaagtgctgggattacaggcatgaggcactgcacctagcctattttattgtttttgcaaagaggatctcactgtgttgcccaggttggagtgcagtggctattcataagcacagtcccactctaaaacagtttgaacatctacctcttgggattgttacagaagataaagtagttggtgtaaagtacctgcagtcactcaataaatgttaattccctgttggagaaggaggatgccccaggtgagccatcttcctgctccttagaagagagctgattttaacttgctagtgtcatcatcttcgagttattttgcatctcctcgtagccttcccatttgatccttgtcgttcttctccttcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattggtaagtagcgtggaccatggatgagtgactctaacacacagtgcagtttacggagcagcgctttgtaaatgggcactgcttggacactgtacaggaaatgttaatggagtatgttgaaagtgtttcaagctctgcctggtgcagtggctcacacctgtaatcctagcactttgggaggctgaggcggatgggtcacctgaggtcaggacgagcctggccaacatggtgaaacctcgtctctactaaaaatacaaaatttagccaggcctggtggcttgcgcctgtgatcccagctacctgggaggctgacgcatgaaaatcgcttgaacctgggagacagaggttgcagtgagctgagatcacaccactgcactccagcctgggccatagagtgagactctgtctcaaaaaaaccaaaagtgtttcaagctcaaattttggaaatgtgggaatgaagaaagttaaacagattttttttttttttttttttttttttttttttttttttttttttttggagatggagttttactcttgtcacccaggctggagtgcagtggtgcagtttcagctcactgcaacatctgcctcccgggtgaggactgtggaatttagctttatatatatatatttttttaatttaattttttttttgagacagtgtctcaccctgtcacccaggctggagtgtaatggtgcaatctcggctcactgcaacctccacctccctggttcaaacgattctccttcctcagcctctggagtagctgggattacaggcacctgctaccacgtctagctaatttttgtatttttagtagagacgaggtttcaccattttggccagtctggtctcgaactcctgacctcgtgagccactgcacctggccttatttatatttatatttttattcatttttttgttgttgtcgcctaggctggagtgaagtggcgcaatctcggctcactgcaatctccgtcccctgggttcaagcgagtctcctgcctgagcctcccaagtagctgggattacaggtgcacgccaccacgcccggctaaattctgtatttttagtagagatggggtttcaccatgttggccaggcttgtctcgaactcctgaccttaggtgattcacccgcctcggcctcccaaagtgctgagattacaggcgtgagccaccacgtccagcctggaatttagctttttaaaaacaatttcccatgtaattctttgaagcatcagatagcaaaaagcaaacaaaaccaaaataagtccacagctttttctccagtgttggaaattaaagaggatgtgaaccttgccgttgtgtttatttgtgcagtctagaccctatcttttgtgctatggctcatgaacaccccagatttgactcgattggttttcattagtaactggggtcatgtcattaacctagtgtcagtaaaagtgaactgacattaataatttgctttttttttttttttctggagacagtgtctcactctgtcacccaggctagagtccagtggcaccatcttggctcactgcagtctcaagctcccaggctcaggtgatttcccacctcaccctctcgagcaactgggactacaggtccacaccaccacgtccagctaatcttttgtaatgttagtagagacagggttttgctatgttgggcaggctggtctcaaactcctgggcttaagcaatctacctgtcttggcctcccagagtgctaggactgtaagcgtgagccacctcacctggccaataattcactttctgtttgtttgttttgaaacagagtctcactctgtcgcccaggctggaatgcagtggcaatgtctctgctctctgcaagctccgcctcctgaattcaagcgattcttctgcctcagcctcccaagtagctgggactacaggcgtgcactaccatgcccagctaatttttgtatttttagtagagatggggttttaccatactggccaggttggtctcgaactcctgaccttgtgatccacccgcctgtgcctcccaaagtgctgggattacaggcgtgagccaccatgcccggccataattcactttcttaagtggaatgtttggggcttctaaacctcttattcctttttaaattttcctttctgtgtctctgctgtccccattttcccctcagctgtggggtcctccaacccttacctgttgagatattataagccctttaaaggcttggtgtggtggctcatgcctgtaatcccaacactttgggaggctgaggctggaggatcacttgagcctaggagttggagaccagcgtgggtgacttagagatactttgtctctacaaaaaatcttaaaactagctgggtgtggtggtgtgtgactgtagtcccagctattcaggaagcagaagtgggaagattgcttgagcttgggaggtcaaggctgcagtgagttctgattgcagcactgcactctatcctgggtgacagagcgagaccccgtctcaaataaataaataataaaattaaaataagccctttaaagaaaatggaagagaaactttagggctaaaagagaagaaaggaggaaacctttttaggaggctagtcactgggctttttgttttctagggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggtatgtggcagagatatttccagggcttctgaaccttgcccatactttggaatcatccatggactcctaatgcagacctactgaatcatagtctctgggaatggggcttaaaaatgtctatttttaagctttcttgggtgaatttagtgcacagccaggtaaggccactaaatatggtgatggggtgcacagcatgcgcagccgtacaaggctgatctgcagctaggatagagaaatgtctgcctaggggactgtttgcagattactgacacaagttcttgggacctcactgccgacacctttctttccaaagccattgtttggcacccttgtaatgtctaatgtttggtttagttcctatacaaaccaaccatggggtttgccaagatagtgaggtatagcggaaagaccatggattttaaagtcagatttgactttatcttgtgcttatgtgtctggaagcttgcttgcttttgttttgggcccatctctgctgcttgttagctggtcaacgtgggcaagtaatttaacctttctgtttaatattccttagctacaaagatgggcgttctggagcacctttccctcggggtggttttacatttgagatgagttactgtagttttaactttgatcctcagcatgctcaggagtgctcagttactaagctattgtatctcagctccaaattcacccttttatgctctgcactactgaggctgaaatgatccaaacctaatttcatctttcacagctggctctcaggctgtgtctatagtgggtgctagagggagaccaaagggcagaggagaggtgagggatttgcttcttcctgtttgctcagtgtggtcagcattgtcagcaaaggctttcacctggtagcagcagttagttacagggcgtagattttttagtccttccagaaccagccagtaactgaactaaaatcagcctgataactcttacctgtttccttttatttatcacgtggtagagggtaaggaaaaaaggggcgagggtgaagctcagagaaggcccccatggagctgggacttagccctccagggaggaggcactgtccggctagctctggatgtatcaaaaaagctggagactggaaccaactgccgccaggtaaagggtctttgctggggcaatacaggtaggaacagtaaatacaggagggccgcaaccacagttttgctttctgcagtttcagttacccatagtcaaccatggtccaaaaattttaagtggaaaattctagaaataacttaaaagcacaatcccacctggggcaggaatcatctgtttgttcagcatctccacactgtaaatgctacccaccagttagtcacttagtagctgtcttggttatcagattgactgtcaaggtaatcagtattgcggtgcttgtgttcaggtcacccttatttaataacggccccaaagcacaagtgtagtggtgctggcagtttggatatactaaagagaaagtcataaagtgcttcctttaaatgaaaaggtgagagttcttgactttaaggaggaaaaaaatatatgctaaggttgctaagatatatggtaagaaggaatcttcgaaccacaaaattgttaagggaaaaaattcattttagtttttttttttttttatgctgaggttgctaagatacatggtaagaaggaatcttctatccacaaaattgttaagaaggaaaaagaaattcatcttagtggccaggcgtggtggctcacgcctgtaatcccagcactttgggatgccaaggtggcggatcacgatgtcaggagattgagaccatcctggctaacacggtgaaaccgtctctactaaaaatacaaaattagccaggtgtggtggcaggctcctgtagtcccagctacttgggaggctgaggcaggagaatggtgtgaacccgggaggtggagttagtgagctgagattgcgccactgcactccagcctgggtgacagagcgagactctgtctcaaaaaaaaaaaaaatagttttttcccccccttctttttttacataaattgagacaaggtctcactatgttgcccaggctggtctcgaactcctgagctcaagtgatcctcctgcttcagcctcccaaagtgctgtgcttaccgacgtgagccaccatgtccggcccaagctagttttcctgttgcacctcaaactgtaaaagttactgccacagtacatgagaagtgcttagttaaaatagaaaaggaggccaggcactgtggctaatgcctgtaatcttagcactttgggaggctgtggcaggtggatcgcctgagcccaggagttttgagaccagcctgagcaacatggtgaaactctgtctctgcaaaaaaataaaaaaaagtagccaagtgtggtggcattcacttgtagtcccagctacttgataggctacttgagccggagaggtagaggctacagtaagctgtgatcacaccactgcattccagcctgggtgatagcaagatcctgtctcaaaaaaaaaaaaaaaaaaagatgaaggctgggcgcggtacctcacgtctgtaatcccagcactttgggaagccgaggtgggcagatcccctgaggtcaggagtttgagaccagcctggccaacatggcgaaaccccatctttaccaaaagtacaaaaattagccgggcgtggtggcgcctgtaatcccagctattcaggaggctgaggcaggagaaccgcttgaacctgggaggcggaggttgcagcgagccgagattgcccactgtactccagcctgggcgacaagagtgaaactccatctcaaaaaaaaaaaaagatggaaaaaaacattaaatattaaatttatgaacgtatgacatggacaaacatgtttcaattgacggcagtcaggtttggtgctgtccgaggtttcaggtatcctcccgggttcttcaaacatattccccagggataagggatctactgtatacaggaaggggcacccctcctcccttgcagtcttctggaaactgcagagggagtctgttaggcagatgataacaaaaaccagctggtggagttcaagaaatggggcctacggggccccagccccagcaccacaggacataaaaggaagaatttggagctgagaaacaagtgactgcaacacttgaagtcaaatcaaagaaaatttatctcctttcttcaggcttccagctggtctttttaccctttgctgatgataaaaggaagatgccctttactgaaaaaatcatggcaactccagagcaggtgggcaagatgaaggctatcgttgagaagcttcgcttcacatacaggtgagtcaatctcaggctttctggaactgcctcctgagttgaaaatcttattagaaacagcttgggcataggccaagagaatggcactactcttttcagcaaactgacagattactacttgttattaatagttttttgaaagccatatagagaatggaaccttttattatgttggagactctgggattttgtggtttctctgttgtgctgtacttagccagattagttggttgaacaaatttgaaaaaatagcaggattcttattcgcccttctccttgattgtgtttgttattccacaatgagcaaaagtaaataaatctagtgtaaattgttaaaggcttaaaagaatgattaagtaattcaagtcattccctctcacatatataatagaccaactctcagagcctgcataatgggacactaaacgtaatttttttcacatgtcatttttaaaaatttattattattattattattattattattattattattattattattttgagacagggtctcttgtcacccaggtttgattgcagtggtgttactgtagttcactgcagccttgacctccctgggctcaggtgattctcccacctcagactcctgagtagctgggaccatacccttgcaccaccacacctggctaatttttgtattttttgtagggacggagtttcaccatgttgcccaggctggtctggaactcctgagctcaagccatccgcctgcctcagcttctcaaagtgctggattacaggcatgagccagggtgcccaggctggtttgctttctaagttgacttgagacaaagtcttgctctgccatccaggctggagtaccgtggcacgatcatggctcactgcagcctcgatctcctggactcaagcagtcttcctgcctatgcctcctgagtagctgggaccacaggcgtgcaccaacatgcctggctgatttttaaattttttgtagagacagggtctcaccatgttgtccaagctggtcttgaactgctagactcaagcattccgcctaccttggcctaccaaagtgctgggattacaggcatgggctactgcacctgacctcaactgttttacttggggtgtttttctcagctcaccccggacctgtagtatctcaggtggttttattctaattttttcaatgtttaaattgtcatgtttcagttgagttacattattgttttaacagaagtgacagctttgagaaccccgtgctgcagcagcacttcaggaacctggaggccttggccttggatttgatggagccggaacaagcagtggacctgacatgtaaggaggttgaatagagtagttcttttcatgggaggctttcttactggttccactctgcaccagtaatttgggtgcatttcccagtcctctctaaacacttaacctcattccccagaccccctctgtttggaagcttttccagaccagcttaaacagccagggaacagatttggctggttccatagtgagaggaggagagtgtcaggcttctgagacctgcctctgcactaggccgccctgtgactacatgctggtgaaatttaaaaaataatataagaggctgggcacggtggctcatgcctgtaatcccagcactttgggaggccgaggcgggtggatcacgaggtcaagagattgagaccatcctggccaacatgtctctactctgtctctactaaactctgtctctactaaaaatacaaaaaattagctgggtgtggtggcgtgtgcctgtagtcccagctactcgggaggctgaggcaggaagatcggttgaactcaggaggcagaggctgcaatgagccgagattgcaccactgcactccagcctggtgacagagcgagacgctgtctcaaaaaacaaaacaaaaacaaaaaatcaataaataatttaagaggaaataagtggtggatttgggtttagaatccagcgactcgcagccgggcgtagtggcttacgtctgcctcctaggttcaagctattctcgtgtctcagactcccgagcagttggtccccgcccggctaatttttgtatttttagtagagacgggatttcgccatgatggcccggctggtctcagaatgatctattttagacaaaatagccccagtgttaaaagcagaagagttattggaccattgttactgtggtgcctgcttagctgtgtctggcgaaagagaaacgttttgagctaaacagcccatctcctcctttcaggccttaggcaaattcagaagtcggtggcctagtgcctagcaaggtagtttaggacacaggtgcctgccaccaagcccggttaatttttttgtatttttagtagagacggggtttcactgggttaggatggtctcgatctcctgaccttgtgatccgcccgccttggcctcccaaagtgctgggattacaagcaggaggcgctgcgcacggcctattttgtgtttttattagtgattgggtttcaccatgttggccaggctggtgtcaaattcctgacctcaagtgatccacctgtctcggcctcccaaagttctgggattataggcataagccaccatgctcactacttttatttttatttttagtactgagcataggctggacctcagtacattcattcattcatttgagacaggttctcactcttgtcacccagactgaagtgcagtggtgggatctcggctcactgaaacctttggctcccaggctcaagcagttctcctgcctcagccttccgagtagctgggattacaggcacccgccaccatgcctggctgatttttgtattttttggtagagatgggggttcaccatattggccaggctcatcttgaactcctgaccttaggtgatccacccgcctcggcctcccaaagtgctgggattacaggcaagagccactgcacccagcttctctgtacttttaaaactctacagatgattcccagattgggagccagtgctcttgcagaggttcccatgatgtggaccaggggacttctgatgcagcaggagcacagtttggctccagcattgtgccatctaggtacaccagcaagagctcccctccatgcttggcaaatacgggcatgtgagctgcccatctcatcacccttgcccttgatgtgacacagctcatgtcagaagcttgatttaacaatatagttgtaagctaacaaaaaaggaaacaaaagtatgatctttcctccaaagttgccttttcctgtcatacttgctccccctgtttcagccagtcatctccccatcccactcctattcttcttacattctggtttccagctctgtgatttcagttaaataataaatcctattctatcagtaagtcctgccagttctgtcacttctcatgtttatgggtcctcccacccacaccccacttcacctgtcttatcttaccctctttcagttcaccctccatgcagctatcaggggattctttggataaggcctaattccttggcaggcatcccagcttccatgacctcatcatacccatctttctcacctctctgctggccctgtcctccttaacaccctaccttccagctatatgtcacctgctatttctctcccagtgccttctgcttcttatctttcaccacccctcctgtgttccagtgtgcctgtacagtcgcttcttgcatggtgttgcccaactccactgcatcgtttttatccacctcctctctctcactgggctgtaagctcaccgcaggcatgagcacttgtttgaattcccagaatctagcttagtatctccactgtaccactgccctttgggaaagtcatgtaatctctctccttttctcctctgtaaaactggggacaaatcaagaggctgaggcaggagaatcgcttgaaccagggagtcggaggttgcagtgagccaagatcgcgccactgcactccagcctggcaacagagcaagactccatctcaaaaaaaaatctaaaaaaaaaaaaactggggacaaatttacctatcctataggttgttagaaggagtaaatagagtaagtttaaagcatttacaacagtgcctggcggtagtatgtgtaattacagtaaatgcaggtgttggaaggtacttggtaaatgctggaaagacatttccctagacccctcccaccttagcagttaggtgctctctcttctggttctcagagagttctggaagtggacagcaagctggggctcgtgactcaccaggccactcttctgtgttttgattttctagtgcccaaggttgaagcaatgaataaaagactgggctccttggtggatgagtttaaggagcttgtttacccaccagattacaatcctgaagggaaagttaccaagagaaaacacggtgagaagctgaatgtggacatgtgggctatttttaaaaattgcttttatgatagtcttatcacagtgggcaatatcctttcagaaatatctattcacagtctagttaaaatggcttttatccaaaaaacagacaataacaaatgctggcaaagatgtggagaaaagggaaccctcatacactgttggtgggaatgtaaattagtacagccactattatggagaatagttgggagtttcctcaaaaagtgaaaactagagctaccatatgatccagcataccatatgatccagtcagtatatacccaaaagaaaggagatcaatatatcaaagagatatgtgcactcccatgtttattgcagcaccattcacaatagccaagatctggaagcaacttgtgtccatcaacagatgcctggtaaagaaaatgtggtacacgtacacaatggagtactattcggccataaaaaagaatgagatcctgtcatttgcaataatatgttaagtgaagtaagccaggctcagaaagacagacatttacatgttctcacttatttgtggaatctaaaaatcaaaacaattgaactcatggagagagagcatagaaggatggttaccagaggctgagaagggtagtgaggcattgtggggttggtggggatggttaatgggtacaaaaaaaaaatagaatgattaagatctattcgataatacaacagagtgactatagtctaatttaattgtacatttaaaaataactaaaggaatacaattggaatgtttgtaacacaaaagataaatgcttgaggggatggataccccatttatgctgatgtgattatttcacattgcatgcctgtatcaaaatacctcaggtaccccacaaatatatatacctagtatgtacccacaaaaattaaaaatgaaaaaattttagaaaagaactgtctatacaaccatacatatttacacataccaacatacatatttcagcacaaatggaataatacattgttttctagtttgctatttttgttactcagctatatatgttggacagttatttatatccacacttacctatctcattttttaaaaaatgaggctgcagagtagttcattggatagatataccaggttatttaaccagacctgtattgacaggtggatatgctgcagtgaacatgcatttccatcgtgttcttgtgtgaatagatccacaggatgcattcttgcagtgaattgcttccaaaacagtgatttaccctctatccaagaaggagtgaatgttttcctgcactctcacccttccaggacttaatttttttaatttctatttaaaatgatacagaagttggccaggtgcggtggctcacacctgtaatcccagcactttgggagcctgaggtgggcggatcatgaggtcaggagttcaagaccagcctggccaacacagtgaaacctcgtctgtactaaaaatacaaaaattagccagatgtggtagtgggcgcctgtagtcccaactacctgggagactgaggtaggagaatcccttgaacccgggaggcagaggttgcagtgagccgagaccacaccattgcactccagcctcggtgatagagtgagactccatctcaaaaatgatacagaagttatatcctttttttgtttttagacagtcttgctctgtcacccaggctggagtccagtggctcaatcacagttcactggctcactgtagcctcaacctcctgggctcgagtgatcctgcagcctcagcctgctgagtagctgagactgcaggtgcacaccaccatggccggttgattttattactttagagccagggtctcactgtattaccaaggctggtcatgaacctgtaaaagattttcaaaggaaggaaggaatgacttacccagagtgagcaacagttttgggtaaactgatggcattcacactacttgtaatttcctcctaggtgtgatctgtgttttattttgcactttaaatgaagctaccttatcgagataagtcttccccatggtgtcctaggctggcatcacagctttatggttaattgcagcccagattatacgaggtcccccatgccatgtagctgggatgccacttgtatgtagcatttccagtcactctctcctgacctttccccccagataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtggtctgaagaagcaggagctgctggaagccctcaccaagcacttccaggactgaccagaggccgcgcgtccagctgcccttccgcagtgtggccaggctgcctggccttgtcctcagccagttaaaatgtgtttctcctgagctaggaagagtctacccgacataagtcgagggactttatgtttttgaggctttctgttgccatggtgatggtgtagccctcccactttgctgttccttactttactgcctgaataaagagccctaagtttgtactatatactgttcttttgtgtgaaggagaaaggtgtgtatgccttgcatccaaaacttgctagccatcacttagcttaattttctctttcattgggaacactcatcaccacaatggaaacaaaacaagtatcagaggggcgggtgagagtgtgacgggtcagggcaggcgaaggcattttgggagtaagaagccctagcaggattatattatccttatcctctgtcctctagcctgttttcctttaaatgtgtcatgttaaggtataaaaatcagatttctgaagcagtaagaaggtaacacttagttctggggccatttgcttcgtgagtaaacagcaactccttctcattgcattcctcttaatgcaacattaagtcatgcaaaaatatacccattttctgttgccctgagaatttgggttccagaataagtgaaatgaagagttactcctcttgtgtttcaggggagctgtaggaaattcaagatgagaaaatgtcctagtatttaaagaaggggaagaggacaggagtgtcttttaccttttcttcttctacatccctgctctgtcctccctgtccctttcctgctcattctactgccactgcttttgaagaattagcctgagggaaggaaggagagcatctggaattgttggtctcctctgaggatgtgagtaagggtttgcaggtcctgtgtccttcaggactagaatgagcagcacctcatgaggaagagtgtaggaggggccaaattactcctttcagctttggattcttggctctaagctttataggttttttttttaacctgttattgcttttgtttctgtttgaaaggagatactgtatttttttgtatttccttacgtgtctgggcaagaggggaagataattctcccattagatgcttagaaattgttgagaaattggaccattccccttaaatggagcaagtttggaaactggattctatagggggttaatctaccaaggtagattgaaattacactagtcacagccagtcacctgcaataggagggcaaggagtagccccactgagcccttggtatccgaccctggatgctggagctagtgaagagcagccctggggtgagctccaggctggctttgctgtgcacactatgcccaagcctacgctcctttgcctcctacttccaaaatggagagaatgagagttcagaggtcaaacacctaccagagccaggcaggtatgtgaatgttagacaaatcacccgaggtctgtgataaacagcaacagagtgatatttctctgtaaatcaatgatgccttctctgcctgctgagtcccccacccaggagagaagaaataccatgttccagtggaattggttaggcctttggaagctcacgaggctgatttagcaaatttacatcttagtgccatcatatatacaagtgaccttgggcagtttatgaggcattttgagccttagcttccacattcttataataacgtcacatggtgaaaatgagaaaatatgtaaaagaacatggcactcaatagatacagttggccctctgcatccgcaggctccacatcgatggattcaacctacgtggatcaaaaatatttgggggccaggcgtgctggctcacgcctgaaatcctaacactaggaggcccaggcaggcggataacgaggtcaggagttcgagaccagcctggccagcatggtgaaaccccatctctactaaaaatacaaaaaattagccgggcatgatggcgtgcacctgtaat

SEQ ID NO: 826 - DNA, 11589 bp, Human
ggtagctgggattacaggcacacgccactacgcccggctaatttttgtatttttcatagagatggggtttggccaacacgttggccaggccggtcttgaactcctgacctagagtgatctgcctgccttggcatcccaaagtgctgggattacaggtgtgagccaccacacccagccacttctgtcatattctgatggacacacagaacagccctaactcaatgtgggaagacaccatacaagggcatgaatcctaggtggtgaggatcaatgggggctgtctttgaggctgtctaccacagcatctttccatccttcctgccctgtttgctttgcttttcctatgtgtaggcttcattctcaaacaggccctccctagagagtgacaaaggtgatcatcaatgtgttcagacccacatgctctgtgcttagtaaccccagtgcaacttttttgctttcccaaaagttctggcaaaagtcccaagctagcactttaattggcctaaattgtgtatatgcttatctctgaaccaatcactgtggattagagatgtcatgctctgattgaccagacctaggccacatctctagccctagctctgagggtagagttggcagcactagagcccatggaagaagtaagagaggagtcgttgctaaaggaaaaatcaaagtgtcattaccgaaccaggacagatgctgggcagcacatgtgcaccccgtcttcttctcatgttccagctgcacatcttagtgccccttggtttagcacttttctcattaaatcatttgctttcttgcctcacttcctgtggttggtagaatgctaagatggccccaagatctctacccctggtgtttgcacacctcccagttattctgtcaaacatgaatgtagatgcttctgtgaaagaattttgcacatgtaatttaagtcccaaattgtttgaccttaaaataaggagaatggcagggccaggcatggtggctcatacctgtaatcccagcactttgggaggccaaggcgggcagatcacgaggtcaggagatcgagaccatcctggctaacacagtgaaaccccatctctactaaaaatacaaaaaattagctgggcgtggtggcgggtgcctgtattcccagctacccaggaggctgaggcaggagaatggcgtgaacccgggaggcgtagcttgcagtgagccaagatcgtgccactgcactccagcctgggtgacagagccagactctgtctcaaaaaaaaaaaaaaaaggagaatggctttggtgggcctgacctagtcaggtgagttcttaaaaggcgacacatggcccggtgcagtggctcaggcctgtaatcccagcactttgggaggccgaggcgggtggatcacgaggtcaggagatcgagaccatcctggctaacatggtgaaaccccgtctctactaaaaagacaaaaaattagctgggcgtggtggtgggctcctgtagtcccagctactcgggaggctgaggcaggagaatggcgtgaacccgggaggcggagcttgcagtgagcggagattgcgccactgcactccagcctgggcgacagagcgagactccgtctcaaaaaaaaaaaaaaaaaaaaaaaaaaaagaaaattaaaagtgggtattgttgtaagatgctgagtttatggtagtttgttacatgacaatagaaaatgaacacacttcacagtggactccaagatccccatgatctttgatctccttaacctcctgatctccacaggacccagagcataagaatgtcccttcttctgcttccagtcccactatctagaaaagagaggaggagcccagctcttcatttcacccccacccacaaactcccaactttccggccctcaaggggtgaccaaggaagttgctccacttggctttccacaaacagcctgtgccccaccaggctcaggagggcagcttgaccaatctctatttccaagacctttggccagtcctattgatctggactcctggataggcagctggaccaacggacggacgccatgagggctctgctgctcctggggttcctgctggtgagcttggagtcaacactttcggtgagtgctgtgggaaccaggattgtcccaggattgttctggggggtcgctatcacagccatgagccatggcctctgctcatgacctgtgggtccaggtgactaggaggcctatgtggaaaggtgaggccagcccggaaggcccaggcagaggagacagacaaccagactgggtggatacaagggcacagcctgcatttctgggggagatgggccttaagaagacaacggggggaggtagaaagggtttgggtcttgggaagaaatctctgcatttctgggctgtgagaggaagctgcagactagcaacagatcggtggcaggctatgacttatagtcagttccctgccttcttctctcccttgtagattccaccttgggaagcccccaaggagcataagtacaaagctgaagagcacacagtcggtaagtggcctggctcctcctcccgggaacccttgggtggggatgtgtatggtgcagtgtgtgcagtctcagggcagtctagtctagtgcctacctggtgctaggtcttatgcccatgggcactagagtgatcgtgagctgtgtgatccttgagggcagggtatgggctgtgtctaagtgcccacgagcctggctcggagcaggtgcttgagatatgtgctgctggcgccatcacacctgggctcctgccagccttcctcagtttccccagcttctccccttcttttcctttccccagtacgtctcatgggcatcattcatgccacacagaggccagggccttcaatgggcaaggaaggatcaagagcttgtctctggcatctgaatgcctctgaagcccagctttatcacttatgagctgggtgactctgggcgagggatttgagttctccaagcttcaatttccccttctgtgaaaccaggttgataacagtaaacctcttagggttgttgagaagggaaacccatgtgaggtattcagcccatcacctggtgcatggaaatgctttacaaatattagcttttattatgaaactaccttttagatgaagggtacctgccatttcccccttcctcaagctctgccatagctccccattgctttcattcttccagacactaaattacctacatgccaggcatggtggctcatgcctgtaatcccagcactttgggaggccaaggtcggtggatcatgaggtcaggagttcgagaccagcctggccaacatggtgaaatgctgtctctactaaaagtacaaaaattagccaggcatggtggcatgcgccagtagtcccagctactcgggaggctgaggcagaagaattgcttgaacctgggaggtgaaggttgcagtgaacgaagatcacaccattgcactccagcttgggcaacacagcaagactccgtctcaaaaaaaaaaaaaaaatttacctagagtgtggcacatagcagggcctgtgaaccagatggaccttacactggtgggcctgacttgtcttggcttgattctctaagcatggcgttgaggcccagcacattccaatcttgtactccctcagcctcctctcttcaccccacacccataagtttctcctctctcttgccttacccaaacttggtgccctatccttgcctaatcccctgcctaaggtccccctcctctctgtccgtccatcccatctgcatctttttttttttttgagatggagtctcgctctgtcccctaggctagagtgcaatggcgcgatcttggctcattgcaacctccgcctcctgggttcaagcgattctctgcctcagcctcccgagttgctgggattacaggcacacaacttcatgctcagctaatttttgtattttttagtagagacagggtttcaccatgttggccaggctggtctcgaactcctgccctcaggtggtccgcccaccttagcctcccaaagtgctgggattacaggcgtgagccaccgcgcctggcccccatttgcatcttaaaggtccatctcagatccatttccatttactgtcctagttctggtttggtccttggcaagtgcactttgccttgaacaaaatagtggcaaaagcttattgagcaggtactttgtgccagacactgctcagcatttcatggcattatctcatgaagccccacgacaattcctctgaagaagacacaggcaattctcattattcgcgatggttatgttctataaaatcacagtgaacattgaactagcaaacagtattaggttcctgtgagcctctggtcacaacattttcatcaaccaacagcatataatctggttttatgtatgattctgtttaaagacattttatttagtatatgtgttgctgattcatcaatgctaagctgatggcactatagcacacacctgaatcaagtgtctaacacacgctttctccctaaggtagccttcttgtgcttaggaactacacagctcttcagcaggaggctcagaggccatttccaaaagccaaatccccagcaaaagcacaaagtgtgaaaaacgttgcactaagtagactgagaaggacactcattcaataggagagctgaaacaagcagcagcagcgtgacgccttgttgaaccttaactgggaatgtgcaaatttttcactgctctgtgcatgcccacaaatggccatgaaaacatttcaagtattgacttgggagttacaaataaaattcagcaagtaggcacattctcaatgtagaaccagagaagaatgaggatcaactgtactattattactgccgttttacagataaggaaaccaaggctcagatcagagtggttaacagtgacttcaacattcaacaagtattattaagtgcctactttgtggcaagtgctcttcctggccttgggactgaagacttacccaaggtcacacagctagcaggttgtggagtcaggagtctactccagctatctgactcctgaacccaagtttttttttttttctttaagatggagtctcactctgtcacccaggctggagtgcagtggcgcgatctcggctcactgcaagctccgcctcccgggttcacaccattctcctgcctcggcctcccgagtagctgggactacaggcacctgccaccacccccagctaatttttttgtatttttagtagagagggggtttcactgtattagccaggatggtcttgatctcctgacctcgtgatctgcccgccttggcctcccaaagtgctgggattacaggcttgagccaccgcgcccggccctgaacccaacttttagagcagaaagtgttttcaatgcacagcgacctttttgagggtctgtccttttcctgaccagaccctgagggacagtgcctgagcagttgagtacaggggaagtcctcagagagtgtgttgtccctgcagttctcactgtcaccggggagccctgccacttccccttccagtaccaccggcagctgtaccacaaatgtacccacaagggccggccaggccctcagccctggtaagactacgcagaggagttggagcaggggcctgggagacatgtaccctgcctgtccttctgtccaaggaactctgcttggagagaggggactgtgatagggcagggtgggccaggcccctgggtagagcagggaagccttgtctctttctacaggtgtgctaccacccccaactttgatcaggaccagcgatggggatactgtttggagcccaagaaagtgaaaggtgctacacacagcctctggggtggcctggggctctctcctcccgcctcattactctcctggtatcaccagaccccacacacctgggattctggacccagccccttctctccctccacaataccctttggaagtccagagggagagttctgggaaggagtggtcccattttgcaggtgggtaaaccaagcttggaaacttggagtagcaaggtcacaaggcaagtaggttcaagaagggccttggcccccagctgtgtgactcagctccctgctcttccttccaccatgtccatctctcagaccactgcagcaaacacagcccctgccagaaaggagggacctgtgtgaacatgccaagcggcccccactgtctctgtccacaacacctcactggaaaccactgccagaaaggtgaggagatgtggaggacctgggcggggtgctgggggacaggggcaaccctgggcctacagaataggttgctggatactcggagacttggcatggtcctagactctcctgagaccactatccctctttgtccccagagaagtgctttgagcctcagcttctccggtttttccacaagaatgagatatggtatagaactgagcaagcagctgtggccagatgccagtgcaagggtcctgatgcccactgccagcggctggccagccagggtgagcagatggttgggaacgggccagggaggagcgtcaggaagacaggctggcaggaggccgggtggtgtgccgggaaggagagctctctgggggggtctttaggcccaggggtggctcactgcgttccctccccaagcctgccgcaccaacccgtgcctccatgggggtcgctgcctagaggtggagggccaccgcctgtgccactgcccggtgggctacaccggacccttctgcgacgtgggtgagtgagggtctggggcaagcagaaggccagcccccaggtgggacgggcttgccaggaaggaggagggagagtgcggaaagcagatgagagggaggcaggagagcccagccttggctgcccagggagccccctttctcctcagacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggtgcgccgcgtggggctgggtgacccctccgccccagggctccgggctcccggcgctctaacggcgccccgtcgtgtggctacaggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggaggttaggaagtggggggggaaggaggagccgagagggcgccgggcgagctagattccggccagccggccgcgggctccccgtcctcagcccctgctcctccacagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcgagtacccgcccgcccagagccgccccaggggccgcggctcctccgtctcccagcgcagcttccacgctgcacccgaacccgtgccctaccttctcccgccccacccttctttccacgcccctccggagctcccggggaggaagctggaacacgggattggggttcgggagcagggggcttccccagaacgcttgtggccaggtctgagagcgctgcctctcccctaccccccccgcaggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctgggtgcgtgggggcgccccgcggggacgggaagagagcttggggccccggcgtccccgcctcacgctcctctccgcccgggttagctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggtaggcacaactgctaggggcaggggtaggggaggagacctttgatcactgggttaggcggaagaagcccgcgactttggtatcgttccgggtgcctacagaatgggtggcgctgacctgatgggttgtgagaatgtgtaggtgaatcccaggtagaatcccagggcctgggattcactgctgggatccccaaatctcctggggatacagggagaatcgaacttgctcttggttccctctgggcgccgggctgcaaaggccaactaggacgctggccccgcgctccgggctagtgtgggagccaggttctgcgactctggatgggtggtgggggaggggtttctgtttccgctccgcccattcaaatcctggcttttctctggacctcagcctccttgcctatgaaattgaattaatggcacctcctccccttcgggcttgctgcgagagaggaagggcatgagtgggtttacaagcgcctggagcagctttgtccatcgtccgggcggcaagcgttgtcagatggggtgtgaagaaggcgctctgtgttcgcaggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccaggtgagctcttagcccggttggcgcccttccccgaggccgtcaggcacaaatctcaggtccacagcgctgagctgcgtgtttccgacccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgctgagaaggaaagctcttttcttcatgggtcccgccgggaaatgccaagacagaaaagcgattcacagcttctccacagctctcagagaacaaggtctatgagatcttaacgtgcaaaatctagatgccagcccagctaatgtttactgagcctaggatactgtataccaagccctgtgcaaggagaagctgcatgttattccttatgagaaactaacattttgtttacagagcagtagttctcagaccatacattaagatcacttggggagcgttttgagccaatctatgcccaagttccacctcagaccaattaaatcagtatgtctagggatggggcatgggtagtggtatatttgtaaaactccccagataattccatgtacagccaaggttgagaatcgtggttagaaatacttagcattggccgggcgcggtggctcacgcctgtaatcctagcactttaagaggccaaggcaggtggattgctcaggagttcgaaaccagcctgggcaacacgatgaaaccccgtctctactaaaatacaagaaattagccgggcacggcggcgtgcgcctgtagtcccagctactcaggaggctgaggcaggagaatcacttgaaccggcaggaaggaaggaaggaaggaacagagggagggaaagagagagacagaaagaaaagaaaaaagaaaatagaaaaaaagagcattgactgtggcgtggaccctaagggctgggtgacatatcgttgtccccaccccaacacgcactagtgtagtgggtctgagagtcccttggctagcagtaccatcaccagggaacttgttacacataacaaattctcgggctacactttatactgctgaacagaaagtctggggtggggcccagcaatctgtttaacagccttgcgggggattctgatgttctctcatgcttaagaaccacaatctgggggttgaatggttggttcccttacaagtgaaggtctggctgtccagacacaacatccttttttcacaaaaccagctttttaaaattaaaaatagattggccagatgcggtggttcacgcctgtaatctcgtcactttgagaggctgaggcgggaggattgtttgagctcaagacttcctgacccgcctgggcaacatagtgagacctcatctcaaaaaaattttttttaattaaaatttgtttttgcttttttagagacggggcctcgctctgtggctcaggctggcgtgcagcgacacgatcctataatagtttactataatctcgctactgagttcaagcgatccgcccgcctcggcctcccaaagcgctgggattacaggagtgagccgctgcgctctgccaaacccatcctacaggataaccttagaactgcgacagcactaaacgcccacgccccacgtgccccagcctgggtggtcgctccgggacggcgccttgtgtgacgtcacagccccgcccagcctgcctcacagcgccgcaggccttccccgcgtggcgcctctatatttccccgagaggtgcgaggcggctgggcgcactcggagcgcgatgggcgactggaaggtctacatcagtgcagtgctgcgggaccagcgcatcgacgacgtggccatcgtgggccatgcggacaacagctgcgtgtgggcttcgcggcccgggggcctgctggcggccatctcgccgcaggaggtgggcgtgctcacggggccggacaggcacaccttcctgcaggcgggcctgagcgtggggggccgccgctgctgcgtcatccgcgaccacctgctggccgagggtgacggcgtgctggacgcacgcaccaaggggctggacgcgcgcgccgtgtgcgtgggccgtgcgccgcgcgcgctcctggtgctaatgggccgacgcggcgtacatgggggcatcctcaacaagacggtgcacgaactcatacgcgggctgcgcatgcagggcgcctagccggccagccaggccgcccactggtagcgcgggccaaataaactgtgacctgggcgcggctggctcctcctccacttgcgcggtggggggagttgtaaataaggaaactggtctttgcaagacggttacctggtggagccgggattttgagtctagaggctgccaggcccctg

SEQ ID NO: 827 - DNA, 6007 bp, Human
acttacatgtccctccatgttacaccaagacccctcagggaccttgtgcctggggagagaagtggtctgccccatgcaacagtgggctttaccccgggtcaccaccagccccagctccaacccctctaacactctccaagtaaaatcacatcagtagcagtaataatatttgaggtgacaagttggtattatctcaaacttaggaaaagtgaataaagtcatctttagaaactgctttttttaaaccttgtaacttgcaagctaagtgaaaatgggctcatgtatgagaatgttcgtgttagacattttttgtgttagacaaaaactagaaacaaaccaaatccccatcaacagaatatattagaatatattgatacaatagaatattacatcataattttttttaaaaacattactgatacatacaaccacgtatatgaatctcacaaacataatgctgactgaaagaagtcaaacagaaatgagtacattctgtgtgatttcatttatatgatgccccaaaccaggaggaaataatctatggtgataaaagtgagagagtggttggttatctttggagggtatcagcagggagggggcatgagggaacctgctggggacctgaaaatacgtggagctgggtggtggctacatacagatggaaaaattcatcagctgtacacttaagaggtgtccacctcatacctaagttacatatcaataaaaaggaaaaaaattttggaaactttttttttttttttttgagacagagtcttgctctgtcccccaggctggaatacagtggtgcgatcttgactcactgcagcctccgcctcccaggttcaaataattctccagcctcagcctcccgagtagctgggactgcagatgcgcaccagcacgcctggctaatttttgtatttattatagagatggggtttcaccatgttggccagctggtctcaaactcctgacctcaagtaatccgcccacctcagactcccaaagtgccaggattacaggtgtgagccactgcaccaggcctggaacaattttaaaataatgtattggctctgcaaatgcagcttcagaacaagtcccttagctgtccccaccccaccctaagtcaccacccttaagcctcacccatgtggaattctgaaacttcctttgtagaaaactttggaaggtgtctgccacattgatcctggaatgtgtgtttatttggggttatataaatctgttctgtggaagccacctgaagtcaggaagagatggagggcatccttcaggagtgagatgagacctcatcatacttgactgtccagcatcatctctgagtaaggggaccaaaaaatttatcttccaaactaggacactttcaagagtggaagggggatccattaatattttcacctggacaagaggcaaacaccagaatgtccccgatgaaggggatatataatggaccttcttgatgtgaaacctgccagatgggctggaaagtccgtatactgggacaagtatgatttgagttgtttgggacaaggacaggggtacaagagaaggaaatgggcaaagagagaagcctgtactcagccaagggtgcagagatgttatatatgattgctcttcagggaaccgggcctccagctcacaccccagctgctcaaccacctcctctctgaattgactgtcccttctttggaactctaggcctgaccccactccctggccctcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccgcacagcaggtgaggctctcctgccccatctccttgggctgcccgtgcttcgtgctttggactaccgcccagcagtgtcctgccctctgcctgggcctcggtccctcctgcacctgctgcctggatccccggcctgcctgggcctgggccttggtgggtttggttttggtttccttctctgtctctgactctccatctgtcagtctcattgtctctgtcacacattctctgtttctgccatgattcctctctgttcccttcctgtctctctctgtctccctctgctcaccttggggtttctctgactgcatcttgtccccttctctgtcgatctctctctcgggggtcggggggtgctgtctcccagggcgggaggtctgtcttccgccgcgtgccccgccccgctcactgtctctctctctctctctctttctctgcaggttctccccatgacaccacctgaacgtctcttcctcccaagggtgtgtggcaccaccctacacctcctccttctggggctgctgctggttctgctgcctggggcccaggtgaggcagcaggagaatgggggctgctggggtggctcagccaaaccttgagccctagagcccccctcaactctgttctcccctaggggctccctggtgttggcctcacaccttcagctgcccagactgcccgtcagcaccccaagatgcatcttgcccacagcaccctcaaacctgctgctcacctcattggtaaacatccacctgacctcccagacatgtccccaccagctctcctcctacccctgcctcaggaacccaagcatccacccctctcccccaacttcccccacgctaaaaaaaacagagggagcccactcctatgcctccccctgccatcccccaggaactcagttgttcagtgcccacttcctcagggattgagacctctgatccagacccctgatctcccacccccatcccctatggctcttcctaggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaatgctgtctgcttgtgtgtgtgtgtctgggagtgagaacttcccagtctatctaaggaatggagggagggacagagggctcaaagggagcaagagctgtggggagaacaaaaggataagggctcagagagcttcagggatatgtgatggactcaccaggtgaggccgccagactgctgcaggggaagcaaaggagaagctgagaagatgaaggaaaagtcagggtctggaggggcgggggtcagggagctcctgggagatatggccacatgtagcggctctgaggaatgggttacaggagacctctggggagatgtgaccacagcaatgggtaggagaatgtccagggctatggaagtcgagtatggggacccccccttaacgaagacagggccatgtagagggccccagggagtgaaagagcctccaggacctccaggtatggaatacaggggacgtttaagaagatatggccacacactggggccctgagaagtgagagcttcatgaaaaaaatcagggaccccagagttccttggaagccaagactgaaaccagcattatgagtctccgggtcagaatgaaagaagaaggcctgccccagtggggtctgtgaattcccgggggtgatttcactccccggggctgtcccaggcttgtccctgctacccccacccagcctttcctgaggcctcaagcctgccaccaagcccccagctccttctccccgcagggacccaaacacaggcctcaggactcaacacagcttttccctccaaccccgttttctctccctcaaggactcagctttctgaagcccctcccagttctagttctatctttttcctgcatcctgtctggaagttagaaggaaacagaccacagacctggtccccaaaagaaatggaggcaataggttttgaggggcatggggacggggttcagcctccagggtcctacacacaaatcagtcagtggcccagaagacccccctcggaatcggagcagggaggatggggagtgtgaggggtatccttgatgcttgtgtgtccccaactttccaaatccccgcccccgcgatggagaagaaaccgagacagaaggtgcagggcccactaccgcttcctccagatgagctcatgggtttctccaccaaggaagttttccgctggttgaatgattctttccccgccctcctctcgccccagggacatataaaggcagttgttggcacacccagccagcagacgctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagaggtgagtgcctggccagccttcatccactctcccacccaaggggaaatggagacgcaagagagggagagagatgggatgggtgaaagatgtgcgctgatagggagggatggagagaaaaaaacgtggagaaagacggggatgcagaaagagatgtggcaagagatggggaagagagagagagaaagatggagagacaggatgtctggcacatggaaggtgctcactaagtgtgtatggagtgaatgaatgaatgaatgaatgaacaagcagatatataaataagatatggagacagatgtggggtgtgagaagagagatgggggaagaaacaagtgatatgaataaagatggtgagacagaaagagcgggaaatatgacagctaaggagagagatg

SEQ ID NO: 828 - DNA, 17591 bp, Human; identical to SEQ ID NO: 658

SEQ ID NO: 829 - DNA, 16541 bp, Human
tcactgcacactggtgaacaaattgtgtacattatataaacctaaaagataccatttacaggacagatgctgtagatagggatgtttgctatgacactttcccaacagatgacagtaaaggttgttgtagaaatttcccagcagatgacagtaaaggttgttatggacagaatatctttttctaattttctcaaaaacatgggagggctagcagtagcccagtgatagcctgggctcttcctcctcaaggctcagactcagagccccaccttacctttctcaaagtctatctcctcctcagcctcctcccgtgtgttcagatctgttatggtgggttcatccatcccccctgggaagagacaggacagacagggattcatgggatgagggtaatacgagataggtggggaacccttccctggagattaaagacaccctcttctaccatcccatctccacaagagtcacctggccagaagggatactgagttggatttccccataaggactgggaggctggccctggaggccggcgaagagacaaggaggttgtagccgagagatttgtgttctccagcaagacctaaggcaagagatcagagccccaatgaggctgagcttgtctctgaccacctccccttctccccaactgtttctcatgacccctgacctcctacctctttgtaacccagtatctggcctgtggttgggtgtctttgggcctgtaggtcggatgggactggggctcccaggacagccaaaagagaccagggatccgtcttcctctgccattttctggagagaaaaatagtaacttttgggtcttctttcttcctctgtcccagcttccttcaggaacccatcaccctagtctaagcccctccagactcctcaccgggctgagtgctccacaccatgcagaggcagccaggctggggatgacagaaacaactgttctgcttcttgctgcagatctggggcacaaggagggaggccatggggaagctgaaacaagggcaagatgagaggcattaggtaaggaaagaggataaaatgcagacaaaagagatgatgggacttgtgttcagatcagaaatggcagatgtgtcaaacagactaggacaatcaggcttggccaaaaactacctgctactgaattacctggggcagattttggatttcagaaacatggaggctggacctaggaatgtgcatttttaaaaagctccctggctaatcatgaagcacactgaaattggagactcactgattttagaaaaaggggtcccagacctaaggatgaaaggttggaggctcaaagcctatcatctcagtcaccaagtgccctggtgcttggatacagaagggagctccacggagaaatgccacatttgaaagagcagctctcaaagcaaaaatatccccagccctttctgctctgtcctcacacgtactgcaggtacactgggctgtaatctgtccagcaccccttcaggctgggatggacaggagtacaggcacagatgaacaaggttaagctagatcctactgtgaggagggtgaaggaggtttggactcaatgcgggtcaaaggttagggtcaaaagtcactcacgctactctctggagctccaggcaagttcagcagctcccagtgccccgtgcatccgagctccacggcccgaaggggtaggtccaggggatctggagggggtagcactacggggaaaggtcaaaagtcaggggtcaaagttcattccatatcggctactccgttccatttccctcccctccccctcaccaagtcgctctgtctccatcatcctggagccacagcagctgcctggcagcccggaagtgcggcaagtagtcgctgcgaagtaagccccgccccggaacgggcggaagtagaggcaacttccggtacagccccgccgagagcgtgaactatcgctgcggaggggcagacctggaccggtggaaggccgggcggaagtgcgcgcctggggccgccttggttaccgcgttttccgctcctcgctacgtcatcgttgtgagcccgctatcagcggccagcgcgggcgcggccggagaccgtggggcccccggttgccgccccctcgggtaaggccctctgcttctcactcttcggccctttttctcatagccgtttctctgttcttcctctttgcgttgctctgcgggcgctacgctggctccaccgccttctctgccgttcaaaccccgcggttgtccttaccctagcgagggtaggggggtcgggtgccatcgtctttccgacggagtggatatttgtccctccttgaaccacatggtacctaaaggtgctggtgtctgtgatccctggagacaggagggaatgctggatgatcccgaccagcgggagcttggacagcagcctggtttaagcaaggggtagggaaagccaaagacaagagtaggcagacctgaaggggtggggttgggtacagtgtggacggcgtgtgaaccccgggtggtaacagtggagaaagatgtcttgggccctgcccctgaactaggagccaccatgttggtgataccccccggactgagcgaggaagaggaggctctgcagaagaaattcaacaagctcaagaaaaaggtgagggactgtgtgtggacatggcctaacctttcacagactctgcactctgagaagatatggggtgagtgtgagcgaatggggaagtttttctggcccatacctagagacatatcacctcacagtgtagcttcgagaggtgggctttcccaagccttggtgtggaccttctgtcttttctatgcaatttgccatggattgtcttcctttcccatggcttttagtaccgcttaagagctgatgatccccaagtttgttttttccagttctatccagtgttatactgaaaaacttcagatactcagtgttgaagctatcatctttctattcttgatcttccaaataagattgactacaccaattctgccacatgtttggactcaaaactctgacttccccactatttgcatagtcaaacctttgccaagtcttattgtttcttcttttgaagtaatttttcctgtttattcttcactgtgcattcccccgagcagggctttattgacattcatgtgggccattgtaatggtctctcaacaaatttctcagtctttttttttgaacagacttcttcactcctgttcaaatgatccattgaaaacacaaaattctgctccctctgtttctcaaaaaccataaatggcttcacattgtctataaaaaagcctcaaaaccttagtttggcagccttgtctagtaaagtagaactattcactacttccaaaagatgcattcccaaagccttcttatctctgcatctttgccaccctgttttctttttctaaaatacccttctcctctctgtgttgtgcagagatacgggagagggcctagtttaatagccattaaacatcagaaaatcttactagctttcagctatgaataatctgcacctcttataattgtattgctaactcaatgtattttatttctcagactgtaagcttcttgagggtaggaacaatgcattagcctcctggatatccctgttacgaagtcatggctgggcctcattcaatatgcaggaaatagatggatgaagcttccaggaaaggcacataaacttatacttacttgcagcttatatcctaggattctagtccatgattgagttatttgtcttcaacttcaaaaatgtaacactctggaaaacctctgggttccgtggtttggttagattaggaatttccagcatcatacatgatctaggggaccagaggcaagaggcagagcacatcagtgtaccactctgagggcatcaagaaagacggtccctggagtgatgtgcccaggggccttaggagaggaaccggctaggggctggccctcacttacctctctcttctcacccttgttcccagaaaaaggcattgctggctctgaagaagcaaagtagcagcagcacaaccagccaaggtggtgtcaaacgctgtgagtgacaggggaaatggggatggactggaagtgggcagcatggagctgaccttcatcatggcttggccaacataatgcctcttccccttgtctctccagcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggtgagcacaagcagaaagattgtttaaagggcatccctccaagttggaatgtagatgggtttggggaaaaatatgcatactcaagcactggcaaattgctgtaccattctgagtttcacctctcatgtataaaatgaaaaaactagacgactcctgaattctccattttacaaattctgtggttctaatccaccttggattggagctcttggaatatgttgccctaagggatggaaagggctgaaaatgttatcaggttcaagagaggttcaaataaactgaatacataatatatcgagtcacttataaaaaataccagctgggcgtggtggctcatgcctgtaatcccagcactttgggaggctgaggtgggcagatcacttgagattaggagtttaagaccaacctggccaacatggtaaaaccccgtctctactaaaaatacaaaaatcagcagggtgtgaggccgggcgcggtggctcacacctgtaatcccagcactttgggaggccgaggcaggcggatcacgaggtcaggagatcgagaccatcctggctaacaaggtgaaaccccatctctactaaaaatacaaaaattagccgggcgtggtggcgggcgcctgtagtcccagctacttgggaggctgaggcaggagaattgcttgaacccaggaggcggagcttgcagtgagtcgagattgtgccactgcactccagcctgggtgacagcgagactccgtctcaaaaaaaaaaaaaattagcagaatgtggtggtgcacacttatagtcccagttactgaggaggctgaggccagagaatcacttgaacccaggaggcagaggttgcagtgagtggagatcacaccactgcactccagcctggacgacagagcaagattctgtctcaaaaacaaaacaaaacaagccacaatggcaggtgcggcaatggctcattcctggttaatttcagcactttaggaggccgaggtaggaggattgcttgagcccaggagtttgagaccagccctggcaacatagtgaaaccctatctctacaaaaaaaaaaaaaaatacagaaattagccaagcatggtagagcacatctctagtcccagctactagggaggctgaggtaggaggattgcttgagcatgggaggtcaaggctgcagcaagctacgattgctctattgcactccagcctggacaacagagcaggaccgtgtctcaaaaaaaaaaaaaaaaaataagtaaaaccacgtcaaataagaaatgtatgtagaattaaaagggaagaaaagatcagaggaaacctagaagagggtgagggaagaggaacacctctggtccatggttgggcaacctcctgctccacactgaggtaggtctctcaccactccaggaccccgagaagggaccagtccccactttccagccgttccagaggagcatatctgctgatgatgacctgcaagaggtaaaggctcctaatttctgtccctgaggggttggggatggaggaatatgagagacaaatatattttggaccacatgtcagcaactggaaatcatcttaactgttcttggtctcttttacagtcatccagacgtccccagaggaaatctctgtatgagaggttagagagtagagataaggctgggcccatttggtggagttgattgcctgagtccttgggaggtttgggctgtaggagctgggctatagagggaatattgagtctccacagggtctgaggggagaaggtaaaacccccctttgatcttcagtctgcatctccccagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcagtgagtgattttggctggaggtcaaggtgaccttaactgaggtttatgtgggtcctactaagtgaaatgtggcatgggctatgtcttgtgactatgatttgtgctcccaaagggtcggattcattccctgaacggcgagcccctaggaaagggaatactctctatgtatatggagaagacatgacacccacccttctccgtggggccttctctccttttggaaacatcattgacctctccatggacccacccagaaagtaaggatgacaacagggcatgatgagaagtcctgggagaatcctggggtgtgagacctgagggaagaagctgccctccctgcagccgcctattatcactgggtttggttgggtccagaagagccccttggctctccactgaccgtgttttctcttatcccagctgtgccttcgtcacctatgaaaagatggagtcagcagatcaggccgttgctgaggttggaacttcccaaatctgttcttcccatcgcttctgctgttctcatgtgttctcctcaaaatactagatgccaggaagaagttggttcctcttgataaagaaagcctctccctattcacacagaaaaactcacattctcagattccttattcagtctcctcctaggatagcaactcctggaataacttctttggtttatctgtaatgttttcctccccatcctctgcctcccctcttctgcttcagctcaacgggacccaggtggagtctgtacagctcaaagtcaacatagcccgaaaacagcccatgctggatgccgctactggcaagtctgtctggggctccctcggtaagaatgggattcttcctttcccatcctctcccccacaggccattccttttggttcccccacacatccttgggtttcctagagatgatcgaggtcagagtgtgtgcggaggctatgggaatgggaaggaaaatttcagatcctctgtcagttagaggtaaagaaaggagagaaaaggattgaaaacagcttccaaagcagtgactggaacagggaagaaagtgggagctggagtgagattggtgaggaagatgagtgtctcatggggcttgttcattttgagatggagtagagtgagtttcataagtattcgaaatcagggatctggaactcaggtgtgaggtaaggaaggaaaacatagattaagtcatccacatcacagggtggctgccaaacaataggatcatcagggagactctgatttcagagaaaaaaaaacgacccaggactcagtttgaggagtactctgggactatgttaggaaacaggactgttcacctcacaccccacatgtccccagctgtcctgacatgttaggctaacgttgagcctaacgttagcaaaggagacaggaggaggggtcggagggctgggagcagcaccgcaggggcctgggccactgaagcaaaaggacacacactttgagaaagagggagtagccagcagtgttgaggcacagagatcacaggatgggagtgggtgagagagattctctgtagctcaagggtggtggggatggaaccattggatggggtgaagagagtaacatgtctggtggagggaggaaagaggaaggggaagaaacagctagaggcttgagagagaatggtgagggccaaagctacaccctgaatgagttctggtggagctagtagcatttcttagtgtgaataatccattttccctgaaagtagattttcctgggaaaggagtgagcagaaagaagggctcagctacagtggcccttcaggcaaaagaaaggaactagaattgaccagcatgtcaaaaaagggctacagaggttttctagtttttagcttctgacatactgactgtaagtagtgggttaatatcattcacgtgtctcaacaatgacatttgggatttttctaagaacaaaacattcatcaaaatgtccacttatacttttcttggccatgggttggcacaaaggagctaaggaagacaggccatcctggccaccagagggcagcgtggaaactgggcttccaggggccagtggccaggagtgaggtggtcaggagtcagcctcagggtctgttctatgatctcctttagaccttaactgttcctctcctccctccctagctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttacacatctccctcagcctctggtttttcagcacttgggattggggttaaacctttaaaaacggctgtcaggtttgatctcagtgtaacaacatggccagtgcctgttccccactcccttgccccaaaaggatctggaacacaggtgttgtcgcagctgttttaattcaatcccacgcccctgtccagcaggaaaccccttatagaaaacccaaatcctcatcttggagtttctccttcagccagggcagcacttgaaagaggttgatgtgaaagtctcgggcgtgagcaggtacctgcttttgccgcttctggtttttgcagacatccactactccccagctgattacaccaacctgcagaggcagtggggtgccatggatcattcagtagaattcctaatcctggaagcatggctgttcctgcttgcgtcttagctgacctaaaggaatcagactagggacccagctcagcctcgttcttgacacacgcaggcaagacatgcggtcctaaggtgaggcaggctctgcctacctcgaattactagccacatgcattgagctttcctgctttggggcccatgctgaccacttggcatctccccagataggaaagggaggactcacttgaatgaaacgacttctcttgtgaactatcaaggggccgccagaatcacctgcaaggagaggagaagctgtagagaaaaggactgttgggccttgggcacttgtagcacaaccaaagagcattctctcacctctgcaagtattggggtcagcatagggactcactcctccagtacaaaggaaccgaggggtgaccacctctgagatgtccttgactttgtcatagcctggggcatattgagcatctctctcacagctgcctttctgtaggggaggtgggaagcatggagaagtaatgaacagaagtggcttaggaaggattggggcctagagtgcctccttaggatgcccgtttctcaccttatccccattcttgatgtagacctccttccgagtcagctttttctcctcctcagacacaaacagagctttgatatcctgtgcagggagcagctcttcctctggacgaatagactgcgtcacttcagctgctcccaccactgtcatctccccattgcctttgtcactcagtagatgtcccctaagcccttctagagctaggttctgggccaggcatcatctcttcctattgcacctccctctcatgccccacttgtctcttgggatctcatccttatcctcttgccaagtatgtcttactttgttgctggcaagtggtagttggaggaagcctcaaagctcgagttgttccctcggtgcaggggagacaaatgggcctataaaggacaaggagaacagcaaaccaggcctgctcctcaccccagtcctccagcctttcccagcctttcctcagggatctggacgctctcacctgatagtctggccatatttcagcttattcttgagcttgatcagggcaacgtcatagtcataaaattcaggaattcctgcttcttttttcccattaatgttgtagttggggtgaaataggactacttctatctccaggtcccgcttctcccctcctgaagtaggagagtaggtaccacctctttgtgggcagcttcctgcctctggccccgtgtcattcctaacttcacgtcttcccccatccctgactggtctggggtgcaaggaatggggctgcattgaggatgggtggagtgtaggatctgtagaaagtgggaggtgttgcctggagagcataggtgcagcccaggaccttcagttgcatccttacctacgctgaccttgattgagtgttccttgtcatccacagtgaaacaatgtgctgctgtcagcacaaagtactcagacaccacagcccccatacagctctcgtgtccctttgaagggcgctggggacacaacagtagagagggaaagctcaactttcacaaaccaccatctcttatggccattttttccttcccctactcccatttcaccttgacctcacctcccccaagtccccactactgggattctgtgcttacaatgactgagatcttggcctgccatggttgcttgtggtaatcggtacccttcctgtgttcccaaaccatgccacagagactcagagactggctttcatctggcagagaaggagaatgtgctgaaaactcggaacacttcattcccaaatggcagcagccttttgggtaggagtctatggggagcaaaggcccaaaaggagaaagggaaagaccacgggtatttgtttcctcgtgttaggagaaaactgctatggtggactgaaaagggaaagaacttgggatcaagctgtcagaggcctggctgttttcaagcccacccttgttgctaacttgctgtcccttgacctcctttggcttctgtttccacgtgtcaaatgtaggactatagaaagatctctgaagtgctcagagctctgtgattctaaggttaagtgaacagtgccaggaaacaagaatagtgacactgaggtagagaaggaggaatgaagaaggctttccaggcaactagagcttcaggtgtagaggaagaatgaattacttcaggggaacctgaggagagttgtgttctttattcccttgtatctccctaccgatcatttggtagaaaacatcttccaggttttccatatccttgactttgaacacatgttgctcattgtctttcttggaagccaaagcattgatgttcacttggttcaccaaaggcccgaccccaaacacatagacatctgagggataaaaaggaaggatgagggtccaagccctgaggaagtggggtgctgggtcctaggcaggttactcacccagataatcctcccttgggtttttgcgatccttgccaatgtatagcaagtcccggatctcatcaatgacagtaattgggtccccgcccatgttgtgcaatcctgcagaagagacaggaccatgagggtaggagataaggaagataaactggctaaaggcagggatacacatggcagggtgagcaagttgaggaagggttagagatagttgatcacagggcttaggaagaattccttatgaagggtcacaggagagatgaacagccagctatgagtcacattcagggccccaaccatgggtatagtgttacaagtggacttaagggccacatgctggtctgagaaggtggggaggctgggacaggagagaggtcccttctgaccatcagtcatgaggatgatgacatggcgggtgcggttccagccttcaggagggacgtcatctggccagctcatcatgctgtacactgcctggagggccttcttggtgttagtccctgacttcaacttgtggtctgtggagagggaagagaccatcacctcacctggtcttccaagccatcttttaaccccagagaccaatctgcaactgaaatcccacatctttcaactttttaagttaatcatcattacacggacttccctttgaccacaaagtggcccttccagcccccaacaggttcccactaacctccattgcccaacgatcctgctgttcaacctttgactacaaagtggtcctccctgtcgccctcaaggtagtctcatgaccccctccaccctgaacctcctgaccccaaagtgaacctcccaccattccctaacctctgaccttcataattgatttcattgagctgcttcgtgacccagtctgcattactgctgtctgcttcagacactttgacccaaattttggggtatgtggcatatgtcactagaccatatcttggcttcacaccataacttgccacctgtgggtgaggagaacaaggcgccatggcattgaaaatagaatactgtgattgggagatttcagcgactttgctgggacagggaggctctcagtaagaggctcaagggctgaggttcatggaggaattaccagtcaagaaactgcttcaagtaaaagggaaggaggacagaataggacctggagattttcctggggccctgttgttcagaggggctggaatgatcagggagctagtcctggaagatcagcgagattccattcccccgagttcagggataggaggattccaccttctcaattaagttgactagacactttttggctcctgtgaagttgctggccccaatgctgtctgatccatctagcaccaggtagatgttcatggagcctgaagggtccaggacgatcttccgcttctgttgttcccctgggtgccaggagagtggctcaggctccagcattaacagttctgtcccttctccattttcccccagttccctgccctgcctcccttctctgtcttcaaacctgggccgtgcccatcctcagcatcgactccttctatggtctctgtcagggaagacaggaaagcttcggccacctcttgaggggtgtcgtacatgaaggagtctgggagagtcagaaatgaggtcaaatgtctgggagtgtcagggatacagtgaccaaagagacgggggatcatgggtttccagggtataaaaggctcagaagtgagatagttgtacagggaggtttaaacaaagtgaggaaagagcagggttgaggtggggagagaagacagtaggatggaagaccaggatctgacctgggggtacaggtcaaaggtcaccttggcaggaaggctccgtcccgctccaagagccaccttcctgacacgttcgccgctgggagccacgcagggtaagcccccggctgcagtggtaggtgacgctgtcttcaaggcggtactggctgcccaccttccttgtgccaatggggatgcccgggttggagcagtaccccgctgcagaggtatgagacatcgaggtaagcactgaagcctgaggccccgtgagcaaggtagagagcaagagttacagtgtccggagccgagtgcccactcctcgggctgggcgccgtcagggagacagcaatgtagggggaggggatgcttctcacctccgttgtcacagatcgctgtctgcccactccaccggccattcacttggcaggtgcgattggcagagccccggagagtgtaaccgtcatagcagtggaaagagatctcatcactcacattgtagtagggagaccggggccagtattccccgttctcgaagtcgtgtggtcttggacagtggattgctttgagaaggggggacaagtagaagtcatcaagagggaaaggctgccttaggtgtatccctcctggtctcggagaccatgtcactgagaaacagcgcattcccagtcccgcagaagcagcatcttacctactcctcaacccatatggatttccactgcttctccctccccatttctgagtgttctcttgacttccagggctgcctggaagcccagggtaaatgcttagtaagggttaactccgctttttcttgccccctttccgcctgccaccctaaaactgctcctactcccggtcagcccaccttgtcaccctgcctagtctcatcctagtcctgaccttgctgccgcctgccctgtttctgccttaggccactgcccacactcattgccctcaaacctctgcactctgccttcctgacagtcttttggtcttgagtcttcagggtgctccaggaccccgtagatctgcaggtacgtgtctgcacagggtacgggtagaagccagaaggacacacgtactccagtgcctggccctcttggagaagtcggaaggagccgcctttgatctctaccccctccagagagcaggatccctggggccaggccaaagaccatggagtggtggtcacacctgaagagaaaggctgatgaagcctggccccaaaaggccaaggagggatgctggagacagcaggaagggaaggttaccctcgcttacctccagacaagaggcccaagataaagggcatcaggcagagttgggggctgagattgctccccatggcgttggaaggcaggagagaagctgggcctggggcaggatggtgtgtcctggcttgctttgcttgtctgcttggctcagtgtccaagctgaaactccagacctagacctggtcacattcccttcccctgctccccaccagcccccagccttttatacaatctgtgttctggcacctgcggctcgccccgcctgtcctacccacatcactttcccggaacatccaagcgggagggccccgctgagctgccagtcaaggaaacagaaactgcagaagtcccaccctttgctgccaaaggtccaggactctccccttcagtacctcctctccggccttagctcctccccagtaagcccaaaccacccacttagggaccagaaataaggatccagctcactcccctgttgattgtgtgttatggtgcagagtccagccactgtttgtccagtggggtctctgacctgccttcctgtagctcttggagtcattctggcctccccctcccccaaggccagccctacctggcctccagatagaggcactgagagatgtggaaaccattgatttttattaatttcataactgggaaattccatgtgaaagtgaaacaagcatgagtcaagtcaaccagggaaggaatctggggacaggccaaggagcgggaggtggggcagcgaggcagtcctgctggtaggagccctgaggatttcccagcttgtgtgcgctgcctctggcatcctagagacccggatttactcagctaggagagaggatggatcacagggtctaagggtggccattcagaggtagaagatggaggggcggcagattctggcagggcagcagagggctcagtggccatggctagaggggtaaaaaattcaggacatcccccaggtgctgcctcagccagggctgcatgcggaagagattgatgtgaaagtctcgtggcggcgggaccttgctacgaggggcccttttgcgggagtttttgtcagcagagccaaggcaggggttgtaaagaccccagctcaccagacccacctggagaaaaggagagaactggctgggaggctgccacagccccaactgtaagccccaacctccctagatccctcaaaggcctccctcatccccccaacaaggctgagatcctgtaacccctgggtcctgcaagcttctaccttctcacctgaaaaaacctgaatctccgctcaaggaaaactgctcccccagattctcctgccagcaaagggtgacaggagacagtgtcatctagggcagtggactggtgttctggcatgcatgctggccacagagacacaggtggccttccccttgggaatccaggcatggtgagggactcacccttgcagggactctcatcctcctgggtcccactgcataggaactggtctgtcaccacctccctgacatctgtcaagttggggaacatggttttttcttgggagacaacctcggcacagcttgtccactgcagcaggggtggaaccagagagaagggtagaataagcagacccgggtgggtgcagtggctcacgcctgtaatctcagcactttgggaggttgaggcaggcagatcacttgaggtcaggagttcaagaccatcctggccaacatggcgaaatcccgtctctactaaaaatacaaaaattagctggtgtggtggtgggcacctgtaatctcagctactcgggaggctgaagtaggagaatcgcttgaaccca

SEQ ID NO: 830 - DNA, 12270 bp, Human
gcaccaacatccccttctcttgactatagagaatgaactgctgaacaaacagagtgttcctgctcattttgtcgccttgaatgggagcaaactgaacattaaccttaagatgggagtggaggtgagggtctcaggttggggatgctgggatccccctgtgacagctcccagaatgtctctcttccttctccaggtctggctgctttctctctctgacgcgggtcacccctcctcccaagcctcacaaacctgctaggtgtccctgggtctgcttattctttttttgttgttattgagatggagtcttgctctgtctcccaggctggagtgcagtggcacgacctcagctcactgcaacttctgcctcctgggttcaagcgattctcctacttcagcctcccgagtagctgagattacaggtgcccaccaccacaccagctaatttttgtatttttagtagagacgggatttcgccatgttggccaggatggtcttgaactcctgacctcaagtgatctgcctgcctcaacctcccaaagtgctgagattacaggcgtgagccactgcacccacccgggtctgcttattctacccttctctctggttccacccctgctgcagtggacaagctgtgccgaggttgtctcccaagaaaaaaccatgttccccaacttgacagatgtcagggaggtggtgacagaccagttcctatgcagtgggacccaggaggatgagagtccctgcaagggtgagtccctcaccatgcctggattcccaaggggaaggccacctgtgtctctgtggccagcatgcatgccagaacaccagtccactgccctagatgacactgtctcctgtcaccctttgctggcaggagaatctgggggagcagttttccttgagcggagattcaggttttttcaggtgagaaggtagaagcttgcaggacccaggggttacaggatctcagccttgttggggggatgagggaggcctttgagggatctagggaggttggggcttacagttggggctgtggcagcctcccagccagttctctccttttctccaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccacatctctcagtgcctctatctggaggccaggtagggctggccttgggggagggggaggccagaatgactccaagagctacaggaaggcaggtcagagaccccactggacaaacagtggctggactctgcaccataacacacaatcaacaggggagtgagctggatccttatttctggtccctaagtgggtggtttgggcttactggggaggagctaaggccggagaggaggtactgaaggggagagtcctggacctttggcagcaaagggtgggacttctgcagtttctgtttccttgactggcagctcagcggggccctcccgcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtaagcgagggtaaccttcccttcctgctgtctccagcatccctccttggccttttggggccaggcttcatcagcctttctcttcaggtgtgaccaccactccatggtctttggcctggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagaggtttgagggcaatgagtgtgggcagtggcctaaggcagaaacagggcaggcggcagcaaggtcaggactaggatgagactaggcagggtgacaaggtgggctgaccgggagtaggagcagttttagggtggcaggcggaaagggggcaagaaaaagcggagttaacccttactaagcatttaccctgggcttccaggcagccctggaagtcaagagaacactcagaaatggggagggagaagcagtggaaatccatatgggttgaggagtaggtaagatgctgcttctgcgggactgggaatgcgctgtttctcagtgacatggtctccgagaccaggagggatacacctaaggcagcctttccctcttgatgacttctacttgtccccccttctcaaagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggaggtgagaagcatcccctccccctacattgctgtctccctgacggcgcccagcccgaggagtgggcactcggctccggacactgtaactcttgctctctaccttgctcacggggcctcaggcttcagtgcttacctcgatgtctcatacctctgcagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaaggtgacctttgacctgtacccccaggtcagatcctggtcttccatcctactgtcttctctccccacctcaaccctgctctttcctcactttgtttaaacctccctgtacaactatctcacttctgagccttttataccctggaaacccatgatcccccgtctctttggtcactgtatccctgacactcccagacatttgacctcatttctgactctcccagactccttcatgtacgacacccctcaagaggtggccgaagctttcctgtcttccctgacagagaccatagaaggagtcgatgctgaggatgggcacggcccaggtttgaagacagagaagggaggcagggcagggaactgggggaaaatggagaagggacagaactgttaatgctggagcctgagccactctcctggcacccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggaatcctcctatccctgaactcgggggaatggaatctcgctgatcttccaggactagctccctgatcattccagcccctctgaacaacagggccccaggaaaatctccaggtcctattctgtcctccttcccttttacttgaagcagtttcttgactggtaattcctccatgaacctcagcccttgagcctcttactgagagcctccctgtcccagcaaagtcgctgaaatctcccaatcacagtattctattttcaatgccatggcgccttgttctcctcacccacaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaaggtcagaggttagggaatggtgggaggttcactttggggtcaggaggttcagggtggagggggtcatgagactaccttgagggcgacagggaggaccactttgtagtcaaaggttgaacagcaggatcgttgggcaatggaggttagtgggaacctgttgggggctggaagggccactttgtggtcaaagggaagtccgtgtaatgatgattaacttaaaaagttgaaagatgtgggatttcagttgcagattggtctctggggttaaaagatggcttggaagaccaggtgaggtgatggtctcttccctctccacagaccacaagttgaagtcagggactaacaccaagaaggccctccaggcagtgtacagcatgatgagctggccagatgacgtccctcctgaaggctggaaccgcacccgccatgtcatcatcctcatgactgatggtcagaagggacctctctcctgtcccagcctccccaccttctcagaccagcatgtggcccttaagtccacttgtaacactatacccatggttggggccctgaatgtgactcatagctggctgttcatctctcctgtgacccttcataaggaattcttcctaagccctgtgatcaactatctctaacccttcctcaacttgctcaccctgccatgtgtatccctgcctttagccagtttatcttccttatctcctaccctcatggtcctgtctcttctgcaggattgcacaacatgggcggggacccaattactgtcattgatgagatccgggacttgctatacattggcaaggatcgcaaaaacccaagggaggattatctgggtgagtaacctgcctaggacccagcaccccacttcctcagggcttggaccctcatccttcctttttatccctcagatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcggtagggagatacaagggaataaagaacacaactctcctcaggttcccctgaagtaattcattcttcctctacacctgaagctctagttgcctggaaagccttcttcattcctccttctctacctcagtgtcactattcttgtttcctggcactgttcacttaaccttagaatcacagagctctgagcacttcagagatctttctatagtcctacatttgacacgtggaaacagaagccaaaggaggtcaagggacagcaagttagcaacaagggtgggcttgaaaacagccaggcctctgacagcttgatcccaagttctttcccttttcagtccaccatagcagttttctcctaacacgaggaaacaaatacccgtggtctttccctttctccttttgggcctttgctccccatagactcctacccaaaaggctgctgccatttgggaatgaagtgttccgagttttcagcacattctccttctctgccagatgaaagccagtctctgagtctctgtggcatggtttgggaacacaggaagggtaccgattaccacaagcaaccatggcaggccaagatctcagtcattgtaagcacagaatcccagtagtggggacttgggggaggtgaggtcaaggtgaaatgggagtaggggaaggaaaaaatggccataagagatggtggtttgtgaaagttgagctttccctctctactgttgtgtccccagcgcccttcaaagggacacgagagctgtatgggggctgtggtgtctgagtactttgtgctgacagcagcacattgtttcactgtggatgacaaggaacactcaatcaaggtcagcgtaggtaaggatgcaactgaaggtcctgggctgcacctatgctctccaggcaacacctcccactttctacagatcctacactccacccatcctcaatgcagccccattccttgcaccccagaccagtcagggatgggggaagacgtgaagttaggaatgacacggggccagaggcaggaagctgcccacaaagaggtggtacctactctcctacttcaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggtgagagcgtccagatccctgaggaaaggctgggaaaggctggaggactggggtgaggagcaggcctggtttgctgttctccttgtcctttataggcccatttgtctcccctgcaccgagggaacaactcgagctttgaggcttcctccaactaccacttgccagcaacaaagtaagacatacttggcaagaggataaggatgagatcccaagagacaagtggggcatgagagggaggtgcaataggaagagatgatgcctggcccagaacctagctctagaagggcttaggggacatctactgagtgacaaaggcaatggggagatgacagtggtgggagcagctgaagtgacgcagtctattcgtccagaggaagagctgctccctgcacaggatatcaaagctctgtttgtgtctgaggaggagaaaaagctgactcggaaggaggtctacatcaagaatggggataaggtgagaaacgggcatcctaaggaggcactctaggccccaatccttcctaagccacttctgttcattacttctccatgcttcccacctcccctacagaaaggcagctgtgagagagatgctcaatatgccccaggctatgacaaagtcaaggacatctcagaggtggtcacccctcggttcctttgtactggaggagtgagtccctatgctgaccccaatacttgcagaggtgagagaatgctctttggttgtgctacaagtgcccaaggcccaacagtccttttctctacagcttctcctctccttgcaggtgattctggcggccccttgatagttcacaagagaagtcgtttcattcaagtgagtcctccctttcctatctggggagatgccaagtggtcagcatgggccccaaagcaggaaagctcaatgcatgtggctagtaattcgaggtaggcagagcctgcctcaccttaggaccgcatgtcttgcctgcgtgtgtcaagaacgaggctgagctgggtccctagtctgattcctttaggtcagctaagacgcaagcaggaacagccatgcttccaggattaggaattctactgaatgatccatggcaccccactgcctctgcaggttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaacacctgtgttccagatccttttggggcaagggagtggggaacaggcactggccatgttgttacactgagatcaaacctgacagccgtttttaaaggtttaaccccaatcccaagtgctgaaaaaccagaggctgagggagatgtgtaagcttccacctcagtgttttactgagaccagcattggggcatatgaggcacaaggaatccagctctgttccctagaagccatccacaaggttttccttgtagacgtcatcactgtagacaatctgggtcctcttgtcccggtggcaacccttagggctgttctggacagctagggagggaggagaggaacagttaaggtctaaaggagatcatagaacagaccctgaggctgactcctgaccacctcactcctggccactggcccctggaagcccagtttccacgctgccctctggtggccaggatggcctgtcttccttagctcctttgtgccaacccatggccaagaaaagtataagtggacattttgatgaatgttttgttcttagaaaaatcccaaatgtcattgttgagacacgtgaatgatattaacccactacttacagtcagtatgtcagaagctaaaaactagaaaacctctgtagcccttttttgacatgctggtcaattctagttcctttcttttgcctgaagggccactgtagctgagcccttctttctgctcactcctttcccaggaaaatctactttcagggaaaatggattattcacactaagaaatgctactagctccaccagaactcattcagggtgtagctttggccctcaccattctctctcaagcctctagctgtttcttccccttcctctttcctccctccaccagacatgttactctcttcaccccatccaatggttccatccccaccacccttgagctacagagaatctctctcacccactcccatcctgtgatctctgtgcctcaacactgctggctactccctctttctcaaagtgtgtgtccttttgcttcagtggcccaggcccctgcggtgctgctcccagccctccgacccctcctcctgtctcctttgctaacgttaggctcaacgttagcctaacatgtcaggacagctggggacatgtggggtgtgaggtgaacagtcctgtttcctaacatagtcccagagtactcctcaaactgagtcctgggtcgtttttttttctctgaaatcagagtctccctgatgatcctattgtttggcagccaccctgtgatgtggatgacttaatctatgttttccttccttacctcacacctgagttccagatccctgatttcgaatacttatgaaactcactctactccatctcaaaatgaacaagccccatgagacactcatcttcctcaccaatctcactccagctcccactttcttccctgttccagtcactgctttggaagctgttttcaatccttttctctcctttctttacctctaactgacagaggatctgaaattttccttcccattcccatagcctccgcacacactctgacctcgatcatctctaggaaacccaaggatgtgtgggggaaccaaaaggaatggcctgtgggggagaggatgggaaaggaagaatcccattcttaccgagggagccccagacagacttgccagtagcggcatccagcatgggctgttttcgggctatgttgactttgagctgtacagactccacctgggtcccgttgagctgaagcagaagaggggaggcagaggatggggaggaaaacattacagataaaccaaagaagttattccaggagttgctatcctaggaggagactgaataaggaatctgagaatgtgagtttttctgtgtgaatagggagaggctttctttatcaagaggaaccaacttcttcctggcatctagtattttgaggagaacacatgagaacagcagaagcgatgggaagaacagatttgggaagttccaacctcagcaacggcctgatctgctgactccatcttttcataggtgacgaaggcacagctgggataagagaaaacacggtcagtggagagccaaggggctcttctggacccaaccaaacccagtgataataggcggctgcagggagggcagcttcttccctcaggtctcacaccccaggattctcccaggacttctcatcatgccctgttgtcatccttactttctgggtgggtccatggagaggtcaatgatgtttccaaaaggagagaaggccccacggagaagggtgggtgtcatgtcttctccatatacatagagagtattccctttcctaggggctcgccgttcagggaatgaatccgaccctttgggagcacaaatcatagtcacaagacatagcccatgccacatttcacttagtaggacccacataaacctcagttaaggtcaccttgacctccagccaaaatcactcactgcggaaaggaccctctcggtctcggtctcgatcccgctcccgatccctgtcccgttcccggtctcgatctcgatcccgatcccgatccctgtcccgctctctgtctctgtctcgatcccggtctcgatcccgctcccgatctcggtctctgtcccggttcctctcatggctgcggtcccggctgcggcttcggggaggggaggctgaggagtgggcaccactgcgttcttcatagccccagtcaaagcttcgagggggaccatcaccagcccctgggccctctgcctcttctccatctggtcctagttctcgaagtcgatcactagaagacacaaagctggggagatgcagactgaagatcaaaggggggttttaccttctcccctcagaccctgtggagactcaatattccctctatagcccagctcctacagcccaaacctcccaaggactcaggcaatcaactccaccaaatgggcccagccttatctctactctctaacctctcatacagagatttcctctggggacgtctggatgactgtaaaagagaccaagaacagttaagatgatttccagttgctgacatgtggtccaaaatatatttgtctctcatattcctccatccccaacccctcagggacagaaattaggagcctttacctcttgcaggtcatcatcagcagatatgctcctctggaacggctggaaagtggggactggtcccttctcggggtcctggagtggtgagagacctacctcagtgtggagcaggaggttgcccaaccatggaccagaggtgttcctcttccctcaccctcttctaggtttcctctgatcttttcttcccttttaattctacatacatttcttatttgacgtggttttacttattttttttttttttttttgagacacggtcctgctctgttgtccaggctggagtgcaatagagcaatcgtagcttgctgcagccttgacctcccatgctcaagcaatcctcctacctcagcctccctagtagctgggactagagatgtgctctaccatgcttggctaatttctgtatttttttttttttttgtagagatagggtttcactatgttgccagggctggtctcaaactcctgggctcaagcaatcctcctacctcggcctcctaaagtgctgaaattaaccaggaatgagccattgccgcacctgccattgtggcttgttttgttttgtttttgagacagaatcttgctctgtcgtccaggctggagtgcagtggtgtgatctccactcactgcaacctctgcctcctgggttcaagtgattctctggcctcagcctcctcagtaactgggactataagtgtgcaccaccacattctgctaattttttttttttttgagacggagtctcgctgtcacccaggctggagtgcagtggcacaatctcgactcactgcaagctccgcctcctgggttcaagcaattctcctgcctcagcctcccaagtagctgggactacaggcgcccgccaccacgcccggctaatttttgtatttttagtagagatggggtttcaccttgttagccaggatggtctcgatctcctgacctcgtgatccgcctgcctcggcctcccaaagtgctgggattacaggtgtgagccaccgcgcccggcctcacaccctgctgatttttgtatttttagtagagacggggttttaccatgttggccaggttggtcttaaactcctaatctcaagtgatctgcccacctcagcctcccaaagtgctgggattacaggcatgagccaccacgcccagct

SEQ ID NO: 831 - DNA, 26076 bp, Human
ccaggattttagttaattttcaacaggtggattagttcttgctgtattctcgtaaacagaagtcctggtttatttttatttgttttaaacattgaatcccatactcctccccaccttaccctacccagaatttagactgttaatgttttgaagccacagcctgcatcttaatcactattttatcttagtgcctggtcttagaaattatattgactctttgatagaccatatataaggcaggtggatgagaatgtgggtagctagttggaaaaggctgcttggtcatttgcttgattattttctcacacagtttttcctttactaagagaaaatgcccccatattggcaaacaaaatctccctgcctgagagcgcccagagtatagcagagcatcttaccctgatacgcctcttttcactctcttctctgtggagacagaaggagcttcaagagcagggggagatcagaatcgtccagctgggcttcgacttggatgcccatggaattatcttcactgaggactacaggaccagagtatgtgactgtgtgcgtcaggggtgctggggggagggcacaggttgggggagacagggaagttgggaaacagaaataaaaacaaaagaaagaatttccctgcccccacatcccatggagagggcacagggccctggtaaatagtaatatgagggagagagacaggagggaaagagggaggagtgagagggtaaagagggggggagaggagggggaggaggaggaaggaaggagggggaggaggagggggggaggaagagggggaggaggatgaagaggaggaggaagaagaagggtatgagaggtggaaggatctgagcaagaggtaagacaggaagagaaatgctgtcctgggggtggaggttggtagagagtgagggtggggatggaccatgtctctcatctctgcttgtaggtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgtgagacttgtggaaccaaccaaagtcaggcatctggtgcttccctgcctccctccagttccatccagcctgtcctcctgtttttttggtgaacctgccagaaaagctgccaaaaagctgactcttctttttaataaaatgacccaagtttgtattcctccccacaagagaggaggcctatcttacctgggccttagaaagagccctgaaatagaattcagttcttggtggcttatcaaaagcacacaggggcctggcaggaagtgtaaaagcttgatgttaatcatactgggactaagaggatagagaatggtaggagctgggatacccctaaacattcacattaaaacaaaaaaaacccaaagctaaaaaacaactgggcaggagctaaataaaaatctaattttgagaggctgtatctggctcaggcctcctactttgtaacccatggaatatgtgaaagcatttgaaaaactatagcactgatctcacatgggcagacacactctcagagagatgtggtgggagccatggcgcagtctgcctaggcagtggcaggagcgcagaagactctgattcctctcctcggtcctaagaccgaatgtgtgtcaggacatgtggtcagggaagagaagctatttaactgaaccagtaatagtagcaggaaaagaaaaagtggagggagggcagtccaggtagggggcctggaacaagcaactgcaccaacagaggcagttggtgcgagcacagaaccaccccaggctgggattttgttatccagtctctcttgcatggttgcccgtgtttctggagacttgtgtaaacattaatggatgaggaggagagatggttctcagagcccagccctcatctctgctggcttcccactgccctcaggcatctggtgaatgctggagtcctcaccgtccgagatgctgggagctggtggctagctgtgcctggagctgggagattcatcaagtactttgttaaaggtatcccatctgcagctcaagcctgcagcccctcaccttttggtggctcctcaggcctctaggccttattcacctttcccctttcctgtgccacttctcctctagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactggtgagtctttccctggcctctggcagattatggagcaatgacccaaagtgggatttcctcccagctcatgcttagtttcctagtgaaggccagtggctctcattcttctctggaacccgggagcaccccttcccaagttctaagttctcctcacagcttgagcctaggcgtctggctccagccttgtctttctcctgcacagcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtgatattttctggatgtcctttatttactgtgacgtgtgtttgggtgccttgtttaggggtagaggtgaagtctgagctttgcctcattcagagaggaaaggggtcaggggttcactctgacgttcaggccattctccctgtggagtggtgagggtgtacctaatctcctaaaccacggaatttctgttagggcctaaaaaagcaaaagcctagtatagttcaatttgtgttggaatgaaagtaagagacaagtgtcttagaagcctgtcattgttttgtgagggcctttaaatatcctgtactcgtgggccatgttgggcccttgtacgcccaggtatacatgagcttgtgtgcacctataccctgatacagatatacctggtagggggaggtgctcaggcactggaatgagaggagttaacggggaaggacagggttatttctgggccaagattcagagtttcccatggacacccaggtgtccggggtgcccccacaactctgggcctgaggccagttgcacttcttggctgtcacgtggtttcccagcttagctgggctgggggaggagcaaggtccagagtcaactctgccccgaggcctagcttggccagaaggtagcagacagacagacggatctaacctctcttggatcctccagccatgaggctgctctgggggctgatctgggcatccagcttcttcaccttatctctgcagaagcccaggtcctggaggcgggatgctgggtgcttggattggggcagggctggcatcgggacccgattcaggagtgagggagagcaggggtggaggtgtcagagcgaagtctgactgctgatcctgtctgttctccccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtaaccagaccccatgccctcctgctgcttgtgggggcctcctgccctgttcccatctgtcttgtaagtgtcatcatcttcccactggcctcctcccctcctgtcttcccaccctggcattctccttccacgtttctcccttggtctctgtcctttttggtcagctgtctcttgctctgtgacccgctccctctccctctccctctcctgacaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcggggtgagtctcagccccagggcctcaacctttaaccccctccgagccctctcaggatgagtttggtgccccctaagtgagataacctgaaagaaagtgccacacagaaggggtgcttaggaaacatttgtcccctgctccctctgtggagtttgacccaccctccccttgcacatggacccctgctcacctctctcctcctccactcccagttcggtaccgggtctttgctctggatcagaagatgcgcccgagcactgacaccatcacagtcatggtggaggtgagtccccgacctctggccttcctgatcctggccactgatgtgacctcctgcctgtgagcacttctccccttgcagaactctcacggcctccgcgtgcggaagaaggaggtgtacatgccctcgtccatcttccaggatgactttgtgatcccagacatctcagagtgagcgctcccaatgtgggggctgcccccaagctacaccaccccaattcctgttaggctctccacctcccacacagaggcacgtccccagatgccctgaccctcagcctcctgagcctctggttaacccccacagtcctcttcccagggaagcaggctgctggctctccgtgccccactgtacagatgggctgagccccttccttgtccattctcaggccagggacctggaagatctcagcccgattctcagatggcctggaatccaacagcagcacccagtttgaggtgaagaaatatggtgagagctggaaactggagggacaggcagctgctttcctgaaggaaataagggtggaaggagaggtactgggagcagctcagggcagggagatatgggtgccacagccctgagcagaggggagtctttgagctggagtctgacctgcctatcccttcaccctgggtcagtccttcccaactttgaggtgaagatcacccctggaaagccctacatcctgacggtgccaggccatcttgatgaaatgcagttagacatccaggccaggtaatacctccctccccacctctgcccaccagcaccgggtcctgctccctactcagtatgaatgggctcctgcttccctgccctcgggccattattccccccagcccttggcccaccctcttctctctgccacgacaggtacatctatgggaagccagtgcagggggtggcatatgtgcgctttgggctcctagatgaggatggtaagaagactttctttcgggggctggagagtcagaccaaggtaggaaggagaataggggctggggaggggaaggggcaagggaggtgaggtgggagactcagtctcaccctatgtcctgtttctttctatgccccagctggtgaatggacagagccacatttccctctcaaaggcagagttccaggacgccctggagaagctgaatatgggcattactgacctccaggggctgcgcctctacgttgctgcagccatcattgagtatccaggtgggtgactttcccttattgtaaccccagacccttgcctctgacctctgagctaaccctctgtcctccggcaccaacaccaccccacttctcacatctcatctcagactcaaaaccaggaaacacccaggagacctggtttctctccaactctgtctctgtgactcggcccttttccctggctgagtttatttatttctttgctcgttctgctcattccttcactcctccagtggacatgtgttgttcaatgccccgtgctaggcctcagcatgcacagacatgttggggaccagcctcaacgccacccgtagggttcctgaagtccattggtgacacaggaatgagaagagacaggttaagagttcataaagagtgggggccagggggccaattgcaaaatggaggctgcaaaaggctcagagctctggtctccacactattttttgagtacagtcactcagatctaagaagcagatgttcagggagaaacagtgaaagggaggcagtgggtcataggcgtaatctatagcaatagagttttaaatgaatctcctttgtgctcaaacagcatgtctttaaattatcggagagtagctggtggaagtgggcttagctagaagactgcatgtctgtccaatgcttcaaaggagggtctttctccttgaacacagtgtttacagataagacagggggtctcactctgagcatgggaacatgatggcaattaggaggcttttcttctcagaggcctcttgtggctttccacaacttattgtctcatatttttatggccagtttatacaggcaccccacaagtccttttcccaacatgcccccctccctttttttttttttaaccgctattgctattatggcttatttgtggtgtttggtctgttttcagaagtgtcttttgcatctgtagactaaaagtaaacagcataaacagatacacattaaagtaaaatttgtaatagttgatcctttaatggtcttaatctgtttaagaggatttatgtttgaaagtccgtcagtagctccaatgagaatgtcagtctcaggcaggagggttaaatgagcctgagatgctttaaaaacctgtttttttaaaatttggttatatttaatgttaaatttttatttttttcttttagatgatgtctaactttttaaaaatgatgtttagtagtattatacgaatggggagttatgtagaaattggaagtatttcaattacattgtacttctaattgatgttttaagtttattgtacgatcttccatttaaataacagtctgtctaagatcatttgtttgatttgtcaattgttggtctatttgggtctgagaattccacaattttgaggaattttttgttaactatttatatattttgtagtttgaacagaggagtgtaaagcaattccagcagccgcagcagtagctgtgactgcaataaggcccataagactgttataagggtaaaaataaatctctttgttttggtaaacacttttttttaaaacatttttgtgacaatatgaatggaaggagaggctttctaaggtctattgagggaaaccagtatccaaactcctttcttagtttttatcagtaacacagatgtttttacaccgaacgtggaattaatacaggtgaaaaggtgacagttttgacaagtaatagtttgagaattaggtcgaatgtcaatatttttgaccattaacataaaaggagggttgacacaactctgaatgggcactgttttgttggaagaaaactgatacgcaaattgaagtttttaaccttttttttttaaagataatatatttttttctaaacttaaatatgagattgggccattattaactttcataatttggagtgtttagggcctattattggattaattattttgggatgtgggccagctgtactaaaattggtccaaattatgggaaaatgagcacgtttttcagtgtaagtagtgttacctttttgatagtatagtttctgttttagttttgtcttgtatttattattttgatgggtacaattaactgtaaaggtcccctcaggggaccaattaatgacaatttcataggaattattttgtagtaccatagtgtgatcagagatgtaattttttttaattaatatttttaaattatttgaccattgttaaggttgttggcacctcttttttgggggcttaaactgttaattgaattgaactctgtgaatgatccgggctccatccagaaaataaatgataggatactggtctttgattatgacctggaattttaactagtcaatgttgtcggtagccttttaggcaaccgatagttggccttatgtaaagaggggggaactgataacctatggacacatttattaacttttttttttttcctttgggtgagagggcccatgagtatttgtaggcttagggatccaaacgctattattaacataaacttcaactgggggttttaaccatgtgacaggcctaattaaaggcaggaatgggacacatgcccaataggtataattttgggctgttgtagccacaggtttgttaggcgaggaggtcactgtttttattttggctttgtattctaggattagtaaataacagaagacaaacatgagtataattagtaacttttttttttagtaaaagagtgacctgtagtgttacttggcatcttagtttactatatgttattaatgaggaaccccactgggggtatgttaatttattctagctaagcagttatgttattagaagctgagaagggggtgtttgttaaagtaacagggcagaagaaaggcggatttaagatacgagcttaatacagtgtagcaggtataggtagtaggcaaagtgagagaattaaaaatgaataaattatttggcttagacttttgtttttttagtataatgtctgaggcctgtgttgtttgtggaagtcgcattgttgaggctgtagttcctgtagggtcttttttaggctggttcaaatgtttttttattttttaattttttatcctttgatgaggatgtagtctttaggctggtactggaaattttaggagtggcgtctgtgttaagagactttttacaatttttaaagagcaggttagtgttttaagaaaaacttgtgttttattttaatgtttagtttatagaaaactggatgatatctttttaactttagtaaatacgtttacacacggaattttttacaattatcattttaaaacttgtttagatctttaaaacaaaattaaacaaccttttttgtataaattttttataactttttttatgacttttacagacaatttttaacatgtcttaactttttatgttttataatttttttactaaaggtacatttttataactttttaaatttttttacttttttgtatttttttgatttttgtcttagtcttttttttacttttatttttttaaatgtgtaataattagatgagtgttggtaacaatggatgtatgtacatattttagtttttaaaatttagggatgtgtttaacatctgtttgccagaactgactaggttccaattctttacggttaacacctattgaaggagggtatgtgcctgtgagctggtaatctgggcattgtgggataatttgtttagccagcctctgtgtaagttgaaattatttagataagtttctccaattttggtggaataatcgatgtgattgggtggcttggtcaagcagtgatgtcataacctgaaggtctgcttgattattgccgtaagccaatgggccaggcagagagctgtgggctcgaatgtgtgtaataaaagtaggatgtgtaccttggtctagtaattgttgaagttgaagaaaaagaccacacagagtgggctccagagcaaacttaaggctgtaatagtttttaaataaatacacagaataaccttagctctctgaatgttagtaaattcagatcaagtgattggattatgtggtctccaccagactgttgctttttcatgtttaccagacccaccagtaaaaacagctatggctccttccaaaggggcatcacaagtaatttttggaagaacctatgtagttaattttaagaattgaaaagtttttaggataatgattattaatacatccaacaaattttgttaaattaatctgtcatgtaactgagttaataaatgcctgtttaacctgatttttatttattggaactataatttttattgggctcagtgccacaaagtttaataattcatatatgagcctgtccaattagaattgccatctgatttaagtatactgtaagtgcttttatggtattatgtggcaaaaaggaccatttaactaaatcatcattttgaacaataacccccattattgtgtggttagtgtgaagtagggaacacaatgaattataaaggcaagtctgagtcaatcctactgacctgggcttgctgaattttgttttcaattactgataactctttcatggcctcgggtgttagttctctgttactgcgtaagttggtatttcccctcaatattgagaagagattagacatagcataagtaggaattgctaaattgggccaaatccaattaatatcttctaacaatttttgaaaattatttaaggttttgaaagaatctcttctaatttgaaccttttgaggcttaatggctctatcctgtacttgtattttcaaatactgaaaaggagtggttgtttgaattttgtcaggtgctataagtaattcagcatttgtaattgtcttttgcaaagattaataatattgaataagttggtctctactttttgctgcacaaatctggaaactgatctctaacaggctggatagttctgcctacaaaagtttgacaaactgtgggactatttaacataccctggggcaaaactttccaatgatatttggctgcaggttttttgttattaacggcaggaatggtaaaggcaaattttttgaaatctgcctctgctaaaggaattgtaaaaaagcagtcttttaaatctataataacaagcggtcagtctttagggagcacagtgggggatgggagcccaggttgtaaggctcccatcggttgaattacagcgttgacgccatctaccggactttttcttaattacaaatactggggaattccaaggagagaaagtgggtgaaatatatcctttttttagtagtttattttataaagcacccccaacttttccttagggagcggccactgttcaacccagacggggcgccgggtcatccattttaagggaaattgctccttcactgtaataactgtagggtgaacctgaattgccccatctccataatgaactgtgggtcgggcaataatgggcacggtgagccaagtctcgggctccctccccctgcacccactcggctgaggaggaggtggccattctggacatttctctacaggaaccgtgggctgaacaattttttgagtaggtttagggagactggggagattggcataaatcatcttcagactctcctttttgttagtactcggtagaggtggttcagagttctgattatcaaactcctctctctcctcctctgactcagcctcattatctgtctgaaaaggctccagtgctgcatgcaccaatgaccaaagcgaccaaacaggcaaaggaatttcctttccttctctatatgctcttttaaggtcctttccaactccttcttaatgttttaatttcaaagtttcctgttttgggaaccaagggcaaaattgttccatagcatgaaacaaatccataagattttccgtatcaacttttaccccaccatgcatgcttgaagagctgccgtaggaagctcaaatacgtggtgtacttactttcagtttttcccattgtgtccctagctttctctgggcgccccgcttacctgtagaggttaaaacttttatgtccttgggagtcctttgttcgttggtcctctgtttcacatgcttgagcgtttcctcaccagattcttttgggccccacgttgggcgccagaatgttggggaccagcctcaacaccacctgtagggtacctgaagtctggtggtgacaaaggaatgagaagagacaggttaagagttcataaagagtggaggccagggggccaattgcaaaatggaggctgcaaaaggctcagagctctggtctccacactatttattgagtacaataacttagatctaagaagcagatgttcagggcaaaacagtgaaagggtagcagtgcgtcacaggcataatctacagcagaagcgctttaaatgaatctcctttgtgctcaaacagcatatctttaacttatcggagagtagctagtgggagtgggcttaactaggagcctgcacgtctgtccacattccaatgcttcaaaggagggtctttctccttgaatacagtgtttacagataagagagagcaggtctcgctctgagcatggcaattaggaggcttttctcctcagaggcctcttgtggctttccacaacttattgtcccatatttttatggccagtttatacaggcaccccacaagtccttttcccaacacagacaggaatacggcagcctgtgccctgggagctcactgtcttgtgggagggaaccactcaagccactccccacttgtcctcctgtccctctcttcttgggctctgtcccccacctctctctgtcctttgtcttgcaggtggggagatggaggaggcagagctcacatcctggtattttgtgtcatctcccttctccttggatcttagcaagaccaagcgacaccttgtgcctggggcccccttcctgctgcaggtttcttccagaggggaaggatgagtagggaggatgtggtagttaggagggctcagggtctgaccactctcttttgcctgccctcctttacctgcctaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtaggactcctcggacccctgggagatggtgggggaaggggaggagggtgagctggggtcccaaggatccatggcctgacttggggggaaggtggggtacttggctctgagctactaccctattcgcacctgaccccctctccaggtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatggtgtgcatgagctggggagtcacggagggctggggtgcagggaagagccctctgggtggggctgggggggttcaaggctgaggctgtcccatgaagaggcaaccactcttgtccctcccattcttggcccagatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaaggtgaccggggtcaggagagatggcacttgtgccgagggggttgaggacagggtgattgccaacagggcatggatttagcttgggggcagtgaggataccgggactgaaggaagctctcccactctgaccgcccccacctgccgcccctgccagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtttgtccagaccctctccacagctctctcacccctccatggctcatccccctgcttccctgagccttgggcgcagcccctggatcccactgaggctccccacagtctcttccccacttggccctgtggtctccatctcctggctctgtatcctttcctatccccccatgtgctgccctctcacctgtgccgagtgctcagtcctgcccctcagccacacttggctcctagcattcctgcctttcttgcaggtctttgaagctatgaacagctatgacctcggctgtggtcctgggggtggggacagtgcccttcaggtgttccaggcagcgggcctggccttttctgatggagaccagtggaccttatccagaaagagtgagaacagagaaggaaggggagtgggtggcgggaagataaggaaggaggaagggcctgaggggaccagctggaagagtccgggcaggaagggctgggcaggggaaggggaggaggggaggaggccgagtgcctgacggctggactgcagcctttctctctaccaggactaagctgtcccaaggagaagacaacccggaaaaagagaaacgtgaacttccaaaaggcgattaatgagaaatgtgagttgcgggtgcctaggcagtagcttgggctctccacctgggatccgggttgggggtctgcctctctgcccctcggctccttgctgaacccacgtgtggtatttggggccagagatccgaattccgggattacgagtggaaggtgggcagctctctccagcagcctctcttatgttgctggtctcaaggggtcggggcgggggctgaggtgtatgtcctttttgtcctctcatgctcacccccacctggccctgcagtgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgaggtgaggggctgggtggggctagggcacaggtggcggcgcttggaaaggcagaacggtcccctcctcactcccgtccaccgtggtcccccagccctggagatcctgcaggaggaggacctgattgatgaggatgacattcccgtgcgcagcttcttcccagagaactggctctggagagtggaaacagtggaccgctttcaaatgtgagagtgtgtgccggcccggccttttctctgtgctgtgtctcggggccagccggggtagacgggccttctctgcctttccctacacagattgacactgtggctccccgactctctgaccacgtgggagatccatggcctgagcctgtccaaaaccaaaggtgatgtcaccctgtctgggcctcaggtgaccctgcttccatttccctgtaccccagctccctgttccctttgctcttagtgtaggaagagggtccagtgatctggggaggtctgtgccagcgtgcagctggcgtgggccagagggcagaggcggactgagacagagctgggtcacccccacccctccctcctgtggccctgaagctttgatggcccctctgatctctgcccctgtgcccacgcttcctttccctcaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgaggccccatgggagcctgagcatacaggagttgggggagccagggcccagtgaggggtggggaggctaaccgggccaggactctggccatcctcgttttcctgccctcaggtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgaggtgaatggagcacccctgaatataagtccccgggcccccagctttgtcctccaccctcagcactctctctgctggccaggccaggggcccaacacccgaaccaatgccttggtctgttcccatcttctacaattctgatccaactctgtccctggagttgaaactcaaagttctgggggagtctgcgctagcagggcaggctgtagtcctgtgtgacctcacaaccatgttttccctgagacagaaggaaggggccatccatagagaggagctggtctatgaactcaaccccttgggtgagtgaccctctacctccagccattggtttcctaagtgggtacaggtggtgggggatgtggacagcaggacaggctgccaacttcccccatttccccagaccaccgaggccggaccttggaaatacctggcaactctgatcccaatatgatccctgatggggactttaacagctacgtcagggttacaggtgggagtgccctttagtcccttcccagtggccaccttcggattcatgtgggacctgtggatccctgcttggtcccactccccgtgagcctctgacacagagtcctcagacctccaccctctccctcccatgtagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggttctgggtgcaagggcaagcaggaggggggccaggaaaggacagttactggaagatggacagcccaggaggctacagagggaaagaaagggggcccctgatgaggatggggagcatggccttgggctcaaacagcagaagggtgagtgtcacctgagcggccacctctcctctccaaggctacatgcggatccagcagtttcggaaggcggatggttcctatgcggcttggttgtcacggggcagcagcacctggtgagcttgggagagtggttccagggttctgagggggtcagggctggggcaggggtgggacagagctggtatgatgggagggtggataaccaggcacctgggggcgtgggcataatgagaagcaagtccttatccccaaccctcctttcctgccctccaggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgttacataggagcatgcaggtgcgggcatgctggggctggcccgagaagcgcctgtcggaggactctctttgccccttccccctcctgtttgacatcttttctccccttactaggggggtttggtgggcaatgatgagactgtggcactcacagcctttgtgaccatcgcccttcatcatgggctggccgtcttccaggatgagggtgcagagccattgaagcagagagtggtaagttcagtggcgtttctgccctctgctggcccccagctctctccctttttcctcaggaacccaggggtccaggcccaagaccctcctcccgttttcttccaggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggaggtgaggggtgaggcgctctggcagtgagcctgaggcccaggggaccttaggatccctgagtgtgcccagagggagaggctggatgaagactcagaggaggaatgaagttataagcaggggtgggttgggggagactcaggagagcccagcagggggtggctaagggccaggggaccaggctcttctccctgccttcctgtttactcgtggtctcccttcactttcagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagtaggggccgtccccgggctctggcgggggtgggtagtcctcagaccaagggcttgcttgagtcctggctcaacctccctaggacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcaggtgaaccactccctggtgaaccactccctcgcctgggtagccaggacacctgggcctcgtggccaggccagaagccgtccccaccctcccacccgtggaatccccgcagcacttcttcctggggtcttcgggggaagactgacttcctggctgcgtgacctggagctctgagcttcagttttctcacttgtagagtaacatacacagagttcaccctacagggtcgttagaaggctgaagtgagataattcatgtgctggtataaactttgtggaaatgtgaggtggggagaggaggtggggctgttttgaggaaggagataagttattggagccgcaaaaacaggtttgcttgtgcccttctaacatcgccttcccttttctgttgctgaagttttccttgggcagcaagatcaatgtgaaggtgggaggaaacagcaaaggaaccctgaaggtgagggccagggaaggggtggggccaggcactggtggaggagagggtgtggagtgagaggcctgtgggcagaggcacatggtccggggaaggaggcagacacctcagggttggtgtcccgtgcttccgtcctgggtgtttttccccctgcttgctttcgcttgctctccccatctctgggtacctgttgtttcctttacccgcctcagtgctggtggctccgaatcccactcctcagcccaggcctcttccctgaaccatgggccccactcgtcccactcccacagcacctcagacgaggcatgtcccaaagcccttcttcattctgtgtctcttgtctggctggtgggagcccctcccagccaggagcccagccactactctagaggccgtgttagtggcccctctcccaagcctgtccttatgtccctagtgactcctcctctgctcccctgctgcctgtggcccttggtgctgcatcctagattctgtgctgagacggccttctccctacctggaacttctctctacctcctgtctcccctgtctgatccactgtccacacggcagtgacactgaccttccaaaagccccagccagatcagccttggggaaaagtcactccccgctgcccacggctcagatggctgggcctctgcccacccctccggccagacagctctccttgtctacacagatccccttgcctttcctgtccttccctgcttcttggcccacaggacaagctctttcttctccttcaagccttggccagaagcctttcctgagcttttcagtccagcctcttcccagcacagtctggagtgttggcctctgggggcaggcccctgcttctttacctctctgtctcgcctgacgcctgtggcgaatgtggtgccactcgtgtgtgtggactgtgcagtgacggggaggaaaaggggctgaaggcctcaaatcccgtagcccagggagatgcccttaggtatggcaccagagaggtctgtggcctcacatgtcccacgtcctctccctgccccttgctgagccaggtccttcgtacctacaatgtcctggacatgaagaacacgacctgccaggacctacagatagaagtgacagtcaaaggccacgtcgagtacacgagtgagtgtgggggttgggaggccttggggccaggcaggggctggcgcagggagccgggtggccatcccagccctcctcacaatgcttccctgtgcagtggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggtgggcgccgggagctgccctgggccaggggagggagggcaggacccaggctggggctgggcttctggagcccgcgcaggcagaacctggacgacagctcacacgtctccacaggcggaacggcaaggtggggctgtctggcatggccatcgcggacgtcaccctcctgagtggattccacgccctgcgtgctgacctggagaaggtgtggtcagccacccagggcaaccccctctgtcccaggtactgagccctgtcatgtgcagggcctgtgaccaactccccttttccacagctgacctccctctctgaccgttacgtgagtcactttgagaccgaggggccccacgtcctgctgtattttgactcggtgagtggggagagatgaggcaggaagggactcgatggcaccgggtttactgagtatgcgttaggaggtttctcaggagacagctgtgtcagcggctggtgctcttgagaacttgtgatgtcatcagagagaaggacaagaatgtgagcccgtgagacacagcagagtaaggggcagacctgcaggcggcagggaccgatgccagtcagcagggaccctcagggtttgagagggagtctttcctaatgctggttttattcagcttgaggggctgcctttgtttttttgttgaacttcctatcttttttttaatattaaagcgtattttcctttacaaagtgatggtggccatagatgatagttgtatttgtcttttcacgaccttatttggctaaaatagttatcaaccctcttacggctctcaaaacatttttatttatttatttagtaaagacagggtctcgctctgttgcccaggctggtcttgaactcccggcctcaagcgatcctctggcctaggcctttcaaagtaccggatttacaggccagagccaccatgcccggccttcaaaaaaagttttggaacatttactgtaacctctgggagaaaatgtgagaaaggtgtggtggctgtcattagccagctgtttgtaggtcagggagacccctacccagtgtgtgcagaggggccagcccccatcagctggggaagcctggctgacacatctgggttgaacacaatagaaaacacagagccaacaagattcccggatagggagctgacggtgcagcagcctagctcaggagggacactggcacggcaccgtgtggactgggcccgcgtgggcacgaggaggggtcaggcctgggacctgagtcggggggtcaggcaggatgacagaacctgcagttaggttgtggcaaataaaggaggacccagttgtatccatgacaaagatgaggccgcgaggagggcgagtgggtttgggggcaggcagagtgccttggagaacttacaggtcctgccacaatcctaatgcaaggatggagctgcaagttcagtttgggaatcatcagcctggattggtttggtggaagccagggagtggttgagacccccacaggggagctctgaggaaggaagttccgaaggagggaacgtaagaaatgaccaggtcagaaccaagggtggtccagaagctaacccttagcttagggacagtttcacagagaacacgtccatgatgcaagactctgctgagggcctggagcagtgaagactggggcaaggtcaccctctgggaagtgaagtcaccagagaccttgcggagcagctttgagagttctctgagtaggaaggtaacagaatgtgaaggacactggagagaaggccaataggaagcaaacaaaaacaggccaaggaaacccagtacagggggctgcagggcccagggagtgggtccctcatctctcctccccacgcttggccaggtccccacctcccgggagtgcgtgggctttgaggctgtgcaggaagtgccggtggggctggtgcagccggccagcgcaaccctgtacgactactacaaccccggtgagcactgcaggacaccctgaaattcaggagaactttggcataggtgccctcctatgggacaatggacaccggggtagtgagggggcagagagccctggggctccctgggactgaggaggcagaatggaggggcctgtgccctaactcctctctgttctccagagcgcagatgttctgtgttttacggggcaccaagtaagagcagactcttggccaccttgtgttctgctgaagtctgccagtgtgctgagggtgagactgagggcctggggcggggcagtggaggcgggatggccggggccccccccacactgtctgatgggttccccaacttcagggaagtgccctcgccagcgtcgcgccctggagcggggtctgcaggacgaggatggctacaggatgaagtttgcctgctactacccccgtgtggagtacggtcagtcttcccaccgaggccctggcctgaccctccctcggggaccggctgttttggtctctctgggtgtagcctgctcctcttacaggtcatgcacgcagcctgtttgctctgacaccaacttcctaccctctcagcctcaaagtaactcacctttcccccttctcctcaccccctcttaggcttccaggttaaggttctccgagaagacagcagagctgctttccgcctctttgagaccaagatcacccaagtcctgcacttcagtatgaagcaaaccggagaggcgggcagggctggggggagacagggaggctgaggtgtggccgaggacctgaccatctggaagtgtgaaaatccccttgggctgtcagaagccttgggcttggccataaatagggaggcagtggcacctctccatgggggtggcgaaggtggaatgagaggatctacacagagtccccagcctgggctcaccctgcaccttctcttcccctctgaccacttttgcgcacgtcatccccgcagccaaggatgtcaaggccgctgctaatcagatgcgcaacttcctggttcgagcctcctgccgccttcgcttggaacctgggaaagaatatttgatcatgggtctggatggggccacctatgacctcgagggacagtgagtcatctggtcccctcagtctcttgtcctccccatgcctcgccacctaggccttgcccctcagaagccagatgcctgtgctctccgtttccacctgccatcctcccgagccctgctgactgcccctttgccccctgcagcccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggcagcgaagtgtcagtgtgtgttgctagggctgagagcagtgcccctgcccgatgcagttctgggcaggccaggttgacataaccttagactctctgagccctgatgacccttgggctgttcagctctgctagaacctcccagatgacccgctaggagtctagtgcttcacaggaccaccccgagcagaactgggacccaagagcctgcaccccaaggaccagagtccatgccaagaccacccttcagcttccaaggccctccactgcccggctgtcgccagtcaccacggcctcagacagggcttgtgctcagctgacacctgtgacacagctcttctgcctcatgagctgttgtccagctacacctccccgactctgtcctcgtgctgctggcggttctgaggtctgcagattttagctgagttccgggctgttgaaagcctgctgacgcttggttctgttatcagtggaatgaggtgactttcccggagttgtgcaatcctcaggtccggcagtgtcttcttccagttactggtttcaaacaagccaaaagtctgactttggtgtgtttgtgaatcctctgaggaagccgctgttctcctggggtctccccttcccaccggacctgcctaactttcccccatttagtggcacacctggggtcttcagagatgactccgcgtctgtccaaagaagtttggtgagatcagtttccgtagaggtcatgacagttcagcagcctgccatccagtcattcgacagaaattcgggaatctttcacttcatgccatgccctgtgccaggtgccagagatacagctgctcactccagggctcatcgctggggagacagataagaggacgggcagtccccaccctctgtgaaagatgtgatgtcagggagcagtgtggtcctgtggggcatctaaccaagtcaggggcattgccaggcagggacagggaaggcttcctggagcaggtggcctccaagtggggctctgaagactgagaaggagccaggcaaagagcaggggtagatgagggcatctggggcagaaggagaatatacaaaggcccagaggccgggggcaggacagggtacctttggggacattgcatgtaattgaccacattcggagtttggatttggaagtggtggaagagatggagatggtgagacaagtagtaagcacgtcagccttccaggtgcgctcctttccgatgagcactgtcttatcccacgtaactttgagaagtttgggcctttcccactgtggcagaggtttcctgaggctcttgcatacatggccctatggttgctcatcagatctttctcccagtagctgctcagcatggtggtggcataagcccattttccggagccagggattcagttgcagcaagacatggcccggtctgggaggtcaaccatgaagaaggcagtagctgtcattgcccaaccccagaaatcccaatcctgttttctccctctcagtcctgatcatggattcagcagcagcgaactcgccaatgtagtgggtggcacagccagggtcttgactctggctctgcagtagcacagtctggaaaagctctgaggggagagagacccccactggtccgagggtctggcacagagccagaaatgggggggaaggtatggggctgggtcgcctctgacctctcaggtaccatccaggaggccctggcctctcactgaacccggccactcctctttggcatggcctcttcccaaatccccaaactgcctccttacccacaaaagtggtctctgagtgtcagtccagtgggacccccaccccttatggcttcagttccccaaatagggctggacccttgatc

SEQ ID NO: 832 - DNA, 36677 bp, Human
ttgcttgttttgagacggagtctcgctctgtcgcccaggctggagtgcggtagcgcaatcttggctcacggcaagctccacctcctgggttaacgccattctctcgcctcagcctcctgagtagctggggctacaggcgcccgccaccacacctggctaatttttttttttttttttttttttttttggtatttttagtagagacggggtttcaccgtgttagccaggactgcatttgttttttaaaaaatctttttcctaattatataagtaaggatgtttactgtagaatgtttggaaaggaaacaaaataaaaatcacctactatcatccaatctgcaataagtcatagttaaggttttgacatagttttatttttaatatatatgtttatataaaagagtgcatgcagcacatggagtttggtattggatttctcccattttcagaggctatttctgcaaattctctaaaactgtggctgaaaatattttcaatgttgaatgtcttttataagaaataggatcctagataagttcccttcagatcgtatggggctggtgggaattctgccaagggtcacataagaggcaggaccgtgacatcctctttatgatcacccttgtgcctagccttaaaggagtatcagcaaatgttggttgacttcatagattaaaaggctcatttttcccatctacaaaaagtatgaaacatcctcctcctccctttcctaggaggccagaaagctgaacgagagattaaatactcagttaaaacaatttaggtggttagtgtatcttttccctctccttcaaaaagatattaacatttccattttagtagctgtaatgtttagaatatacatacattttacttgaaagctgcctcatagtctattttggttttggattttcttttttttttcgtttttcttgagacagagtttcgctcttgtctcccaggctggagtgcaatggtgcaatctcaactcactgcaacctccacctcccaggttcaagcaattctcctgcctcaggctcccaagtaactgggattacaggcgcccgccaccacgcccagctaatttttgtatttttagtacagacagggtttcaccatgttggtcaggctgggtcttgaagtcctgacctcagatggtccatctgccttggcctcccaaagtgctgagataacaggtgtgagccaccgctcccggcctcatagtctattttagaagttgacaggctataaataacaagcagacaaattaatgaagaacatctgtctttctgcctatcccgaaacacgttgatcagtggggggtcgagggaagggtaggagtatggagaagagacccgcggagaagaggggagaatctacaacggataatgttgtagatatttacaacatttactcaatggtaggtatttttatcctcgttttactagttggagaattatatcatgcaggtttatacaattaacaagtgggggagccaggagagaacccattcactctttagttcattcattcattcagtcagtcaacacatctttgggtgtcttctaaatgccaggcactattctaacccctaaggatacttcagtaaacaaaacagtcccaaattcttcccctatggagctttctcggcgaaggcgggattggttaggagctgacaatcggcagcagacgattgtaaatgaccggaccttttttctattctcctgcccagcccccggcccggcctccgcctccggccctgctccagccccgccagcggcccaggacccgcccctggctccggccccgcccctggctccgcccccgcccccgcgccggcggcggcgcggcgcccgcgcttccgtatcgctcctcgtaggccggggctcggcgcgcgcacccgcactaaagacgcttcttcccggcgggtaggaatcccgccggcgagccgaacagttccccgagcgcagcccgcggaccaccacccggccgcacgggccgcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaaggtaacgcagcgtggcggggtcgcgggagcggagcgcgtggccagctgactggagggaaaacgccgcctccctgcagcggttcccggaatcccctccggttccctctcgctctccccgactcctcctcctcctcctgccctccctctgcgtcttgagtatgcggctagtgcgcccttcctctctcccggggccgcacctgcgaccccaggacccctcccgggccctgtcctgcgccctccacgcgtcgcccctgctgggagtccgctttcgttgcacccctccgcgtcccaccccaccccaccaaggatgcccaggataccgggcatttgccactgcaagatgtgagtcgttgctaagtttgagggtcacattcctccaggtccaccccgccttgcaaaaccggctcaccagctgggtgctcaggttcgggatctccagcccgcccccttgaggtcccctgggattagcccccctcgacctgcgtcagggtcacagactgcagccggggctggagcggcctacacccctccggatccgctgcgtggaggcaggagggggaaggggcgaggggacgtggccgcggagacagaagggtgcaccctcccagggtcggagaggggagatactgggaagatactccgcgaatatggagaggcgatcggcacttgcatttcaaccctgagcaaatcaatccgttacacgcagtagcgagttgactccatcagcccgtttatttggttagcgatggttatattgactctgagtattcccacctcctttcttttaacatttttttttttatttccttgttttgtttagcaagaagtcttagaaacgaatatagcatgcttgggcgttgattcagtggtgagaagtgccggagctggctcagggagaggtggagtttcccatgtgtgctcactggcccaggggctaagtcccactgcttgccaaggtttctcagtatcctgtccacccaccccctatccacctgtgcaggcttgagggggtgagggggtagcagatactctatcaaaatctaccctaaggaaaatattcgataaacactcctagcaattagggcatagctgataaggcttgatctgtttgtcgcagaaaatgacttgaacttgtaagttctattgttcataaagttgttttccacaattttagataatcaaaaatgtacatgactcatttttcttacctattatttcctctaaagtttctcatgtatttattgaaaagttaaagaaaatctgattttggttcacataatttgacaatggtgatttgtctaaaagtcatttcaaaaagtagtatgaaaaggatcataaccctagaggtactgtcatagacgtgaaacatttattaaaatatatattccatggctcacacttgcacactcaaagccacattggactcattttttctgctacctttataaaccttcaaactgttcaagagtcaatggtatgtatcatcttccgttatcaatcatcatgttttgttttgtttggtttggtttggtttggtttggtttttgacaaagtctcgctctgtcgcgcaggctggagtgcagtggcactgtcttggctcactgcaacctccccctcctgggttcaagcgattcttctgcctcagcctcttgagtagctgagattacaggcgtgtgctactacgcctggctaattgtatttttagtagagatgggatttccactatgttacccagcctggtctggaacttctgacctcaaatgatccacctgctttggactcccaaagtgctagtattacaggctcaatcatcatgttttatcaaagctaaaacccaaactaaaatgccattgcttataagatgcactttcattttatgtaatgaagtaagaaaaaacactgtcaatcatgctatgccatgccaccagaatgaaagcattctgatttcagaaattctcaaatgttaaaagaaaatgggcattttataatttgtgaaatattagtgagttagagcagagcttgacggcactggccctgagggtccttcttcttcctttggaagaatgaaactgggggctatgcaattcagggaagaataaaggaaaaacaggtaattggcagaggaggttggctgacttagaggtatggaaaagacaaaacaaaggagggaaaaagagaggtatgtatgatggggaggagttcagagccactgaaaattttctctggccctaacaggaaaacgagttaccccacaagccagggttttatcatctggtacgtggagatatccatcagcattgtcattggttttcatttgtttgtttttaattctcaagtttaaaaaaaaatttaaaatttaaatgtgtctcaaccaccagaaactatagtgagatttctctgtaataaataggaaagaaggagactgatccagtccttgttaaaaaaaaaaaaaagaggaaactgaatcacaacatactttgcttttttcttttctcacaaaggaacagtgggccctttatgctgggtgaaggtgagtgagatgggggaaggttcactgggcaccaaccttctgggctagagaaattgcccaggctttacagaacaagctggaatcagataaagttgtggaaaggaagtcgaggtttcactctgccatatcagtaggaggtactaaagccaaactagtagcagcaaagtgaacagaaatggtaagggggaaaaataggaaaggaaagaacaacgtggattgcaagacgtcttactaaaaacaaagaattacacttggaacagaagaaattcattaccattgccttacactgtgcaacaacttgataaaaatataaatccaataaaacaaactcaaagatgagaaaattgtaaactggagatgaaaagggagattgcagacctaaaggaaaattgaagaccgtaaaaacatagtgacagaataaataagtcaggagaaagaacagaagcaatactgctgaaaataaaagtattttaatagaagaaagcccagtaaggaagcccagtaaattcaactgaaaagggacaaagattaagaagaaagaagctattatgaaagacaaaatacaatcaagaattgggaccactgaagtcccagatgtagagaagtcaacaaatgggacagaaaattcaaataaaaataagtccaaagaaagcttattgagatgaagaaaaaatggtctgtaggccaaaggaacatgccatgttccagaaaatgtcatgtgggaatacggaagcactacgatatcttaaactatttaaattcaaagaaaaagatttaggaatctaagaagaaaaagtaaaggagggaaaaacaaaatcaagctcgcctcagacttcagtgcagcactaaatgccagactatgatggttgtgaggaaacagttccaagggaaagaaacttttccgaggggcatattttttttccggaagaacaaagggaattcagcacccatgaaccgtttttggaaaaacaaaaacttgctgagtaataaaatccaggaaatagcaaattaagagataaatcaaaataaagaacttaagagtagagaaaggtaaaaagacttggtgagtatttattctatttaaatatagaagtaatacatctatagaaattgtgggtaagatagaatgcgattgttattaatctagacaaaaatatacagccaaaaaaaaaagaagtcagagaggaagatggaaggaaacatgagaataccaatattctcttctttcaaagaatggaatagtaaatatggtataaaattaaaagatgctatgtgaatatataatactgcaacttttaatatctttcataagttttatttaaaaccttagagggatatcataggaaattatactttcttatggacaaaaaaatttaaattttaacaactcctttgactttattttagtcttttcccaagtaacattaaacagaaacactgtgtgtgtgtgtgtgtgtgtgtgtgtgtgtgtgtgtgtgtgtgtttatgcatagaaagatctgtgggattatgttcgcctaatattaatgatagtaatagtttttacagaagaaaaaagaaagatgtttgaaaaataagctagaatcaaatatgccaagatgttaacaattgttgatgctggatggtaggaataaggatgagtgttactttcttatttgtactttttcatatttttctaatttccagaaaaagatatgtaattgtttttgtctaacatttctgaatccacttcattcattattcattgcctccttgacaatgtgcatcagtctatgtcaaacagaaggaaagacacagccatactttaccaggagactatgaggcagcgagttcctggagggttgtttgtctgtctaggaggagttggaattcaaagaatcacttcactcaatccatccattttatctgggccttgaaaattggcagggtttgtctggtctcagggtgaatagcaggtagagctcttctttcagaatggagaaggccacagtgtcacagggtgaacctgtgacaaaattggggttcagcctgggaagccacatgagttgttggcttcgcacaggatggaattaaagagcaagctgacagaattaagtgaaagcaagtttattaagaaagtcaaggaatgaaagggtggctactccataggcagagcagcagcatgggctgctccactaagtatacttatggttatttcttgatcatatgctaaacaagtggtggattattcataagttgtctgcaaaaggggtgggagttctggaactgagggttcctcacttttttcgatgatatagggtaacttctgcatgttgccatggcatttgtaaactgtggtggcactggtgggagtttcctttagcatgctaatatattgtaattagcatatgataagcagtgaggacagttttgtcaccatcttggttttggcaggctttggccagcttctttactgcgtcctgtcttatcagcagggtctttgtgacctcctgttttatcacataactaagaatgcctaaccccctgggaatgcagcccagcaggtctcagcctcattttacccagctgctactcaagatggagtcactctggttccaacacctctgacaagagcagggggtgacctgtcacctggggctcagcaggacaataactctaggaaaaactggaaaggctgatagccttgaatttaacctaaggagcttggtgcattgtcaggcaacagtgagctacagactgagctcactacataattcacagggcccacccagagccaaataaaaatgcctgagaaagtaccactaaaggtactaaaatataaagccttttcttccacagtctctctctctcaacacgtaatgtttttttgtttgctatttaatatcattctaagtaaaaaaataggccgggcatggtggctaacgcctgtaatcccagcactttgggaggccaagtcaggtggatcatgaggtcaggagatcgagaccatcctggctaacactgtgaaaccccgtctctactaaaaatacaaaaaattagctgggtgtggtggcgggcgcctgtagtcccagctactctggaggctgaggcaggagaatggagtgaactcggaaggcggagcttgcagtgagccaaagtttgcgccactgcactccagcctgggggacagagtgagactctgtctcaaaaaataaaataaaataaaaaataaaaataaaaacttgaattattagcatgaatattgcagttctttatattatgcaaaaccagatttaaataagagcatttaattcatatatggaattgccaagttataccattagtactttacagcacatcttgggaggttcccttgaactagccagaagaagcaaactgaagccagacagaggaagattgcaaagaggaagagagggtctccaccaggcacagagccacccaagggagccctccctcaggctcagggataccgagggagccagagcagattcacacaggtccctggggcccctctgccctggtgactctaggatgcatgtacttgcacctgacttctaggcatccccctcctgctagcttcccctcgatccagcctggggcaggctctgtggaagtcaagccttgcatctccctttcccaagcacctaccatcctaacccacagtgtagtggccacgtccaagggtctttacgtctctgcctcagatatgctaggtacctgggtcaagagtgacccagagactcatccctgccagacccaacctccagccagtcaccctctgactccagtccatggggcgaggctggagtgctggccctgacctctccagcatctgcaccaggagggcttcagcggaatgtggtcccagttgatgccccatgccaacagtagcagcagcagttgttaggcatagagattgaagccagacagggcctgggattcctctgctgggagcctaaactgcaggagatggggaaggatccaagtgtgagctggggctcctagcacaaaactcacattgaaagataaaatggttaagaatttcaggatagccacaggagaacctcaagccaagtgtaggatccttctagctgcagggcctgggggtactgagactagccctgttgacaggagccatgctttaggaagactgatctatttgtagtcagcaagagttttaaggagctccattaacaatttaggcacgatgccaagatgggatattatattttccaagcaagaagaatctggtaatcaggcatatggttccaagtgaagtataagtcaccagaaagcaaggaaggaagccatcccctggcccagagggggagaatggggtgtgtgtgtgtgtgtgtgtgtgtgtgtgtgttttctcggctgctgaagagactgagtgttcctgcagatatataacaaagatgaagatgtgccaccgttggagacaaatggggaccagaggccacatgtcagaggtcaggtcaggtgttcaaatataaaggggttgccctggctgggcatggtggctcacatccataatccaagccctttgtggggctgaggccggaggatcacttgagcccaagagttcaagaccagcctggacaacatagcaaagccccatctctaaaaaaaaaaatacaaaaattagccaggtgtagtggcaaatgcctgtagtcccagctacttgggaggctgaggtgggagaatcgcttgagcccaggaggcagaggttgcagtgagccgagatcacaccactgcactccagcctgggtgacagagtgagaccctgtctcaaaaaataaagaagttgcccttctacaatctggatgtggtggtatctaggggaatgttcacaactaggcaacgcctctgctgtggattgattatgggagatgacatcacacatcaagatatctcagcagatgtttctcaatgggtacagtattatgggattagttccaggcagtcgtgcttggatatctcatgggtggtggagtctgtagcaaggctggaaattttgacttggaatcacttggatttctctaagagaataccccaggttggatgtgttactgtggcagcagagaagacttaaaaattacattgtttttagcttgaacttcgtcttgtgaagtcctaattagggaagaggagtcaggctgggggtctaggggaaagcaaagagataaagcagataagccataggtctaccttgcttcatggtccaggacatacaaacaaaaagaagaagcagataagctataggtctgcctttctttatggcccaggacatacgaccctcctgcacacataactcacaatcttcctgcgtatcatcaaatgcttcaacttatcatcaaacatctcggctgaccgaaaaatgcaagttagctccctgctaccttggcgttgtcagtcctccacatagcactcttcagcttaaattgcattttataaaatccccagcaagcctttgtctcctggcagtcaactcgtctcttactgacctgcccattgctcccttgcaatgtattttcctactttctctaataaatctgcctttcttgacctaaactgtcatggtaaattcttcttactcctatgtcaccagccacagacagtcgccacaagccatgacaagtctgcgatttcatggtctttttttattttgatgatatttccccagtgtttgggggacagaagaatgcccacaatctataggtcttagtcacatggatggggacagaatatctgagagagagagaaggaacaagatctactggggctccttaaaattcttcttgaagaactcctttctcaccttggagtagggaagactttctgattatgactcaaaatttagaagctaagaaagaaaatacctttaaatctgaaaacataaaactcaaaaacttctgggtgtttttttgggggggttgttttttttaaacagcacaagcaactcaaagggcaagtgacaaactggggagagaagaaaaagatgtgactcatatcacagtttcccttctacttaaaaaaaaaaaaaactgcaaaccagtaagaaaatagcaacagctcaacagaaaaattgccaaaggcacgaacagttaatgagaaggagatgcaaatcgctcttaaacctatgaaaagatgaaggtgttccatcacaaagagtaagagaaatacaaattaatattaatgtgaaagacaacttttcatttatgaatttgagaaaaatccaagaacttgatgatatacctctaagaagcaacggtagggaaacgaaaattctcacacattgcaggtggttatgtaaattggtatagccccgcgggtggtcagtgtgacagtttctatccaaattacagatgcatagtttcattgccaggtctcttctgtctgcttcttcagacccaccctcccctctccccactgtttagttggcccaggaccctgtctggtaaggatacaactccaggccccttgccctatggcttctggttgtgttcagccgatggggagccccaaataagagaaggaagggacaccgtgagtgatatttatccctcagcttcctgcctgcactgtcctcttggtctggctgtgtccagtggtctcatgtcatagctgctcatacaggagtttctccttacaaattgcaatgttggcttctcttccccctccggcccagagtgattacagccatcaatgttgtgagctacaggttctataccctcccttctgcaggcccagaatggtaacagccctcaatgttgtgagctgcaggttctgtactctccctcctggggcccagagtggtcacagccctcaatgttgtgagctacaggttctatactctcctttctgcaggcccagagtggtgacagccctcaatgttgtgagctacagctctcaatgttgtgagctacaggttctataccctccattctgcagacccagaatgttacagccctcaatgttgtgatctgcaggttctgtactctccctcctggggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctatattctcccttctgcaggcccagagtggtcacagccctcaatgttgtgagctacaggttctggagtctcccttctgggccccagagtggtcacaggcctcaatgttgtgagctgcagattctatactctcccttctggtttgcctacagccctctcacacatttgtaaatatagtcctgcaacccctaatgatgtcttgggcaaagatggaccttttatatgacgatagccccataagattataccatatttctactgtaccttttctgtgtctaaatatgttcagatacacaaatgccactgtgttgcaactgcttacagtattcagcacagtaccatgctgcacagatttatagcctaggaacaatagtctataccatataacctagatgtgtagttggctatgctatctaggtttgtctaagtatactctgatgttcatacaacaaaatagcctaacaatgaatttctcagaacacagcactgttcacagttgcaaagatatggaatcaacctaagtatccatcaacaaatgattggataaagaaaatgtggctaggtgtggtgctcacatctgtaatcccagcactttgggaggccaaggcgagaatccaggagtttgagatcagcctgggcaacatagtgagaccctatctctacaaaaaaaaggtttttttaattagccggtgtgtgatgacacatacctgtagtctcagctacttagggggacaggtgggaggattgcttgagcctgggaggttgaggctgcagtgagccatgattgcaccactggcactccaggctaggcaacacagcaagacccgtctcaaaaaaaaaaaaaagttacatatatatacacacagtatattcagccataaaaaagaatgaaatcgtgtttttgcagcaacatggatggaactggaggccattatcttaagagaaacaactcagaaacagtcaataccacatgttcttataagtgggagctattaataaaaaatgtgcacacattgacatatatataatgtggaatgatagtcattactgactgagaagggtggattgggtgtggggagttaaggaatgagaaattacttaatgggtataatgtatactattcaggtgatggatacactaaaagcccaaatttcaccactatgcaatatatctatctaacaaaactgcacttgtaccccttaaatttatttttttaaaaagcgtgtatcctaatttgaatgagctgtttcttgccagaaccctaactgatatgtcctttgtctagcaattctacttctggaaattttcccacacttaaactggcacatgtgcaaaatgaaagagatttccttgcagaagagactggaaataattcaaatgtctatagtaggggtactaattatataaataatggtgtgtctatagagtagaactgtatccagctatttaaaaaacaaggatagaaagatcttccaaacatatttttaagtggaaaaagcagggtggaacagggactatacatgctatctcttgtctaaaagatggggaaattaggaatatgtatttgtttttgcttatgcatgaagatactctgaaggattcacaaaagaaaaaaaagttttctaaagggagcaagacttttcacaattttttttttgaatgcttaaaattgttgaacccaacgactgttgcctgttcaaaagttaaatttaaaattcctcccagactaggtaggggattgggcccagaagctgagaccaggctcacttgaataaatggggtaaatgactaggaattttactattccttacaggtctctcattatcttgtctttgctcccatttttatatttgcagtttaattagacacttcagaattttgatcacctaatgttgatttcagatgtaaaagtcaagagaagactctaaaaatagcaaagatgcttttgagccagaatgccttcatcttcagatcacttaatttggttctcatgggtaagtgctgctttttatcttagctcttatagaagcaagctgtgatgccatcctcactgagagcactggcaggaagtcgcaaactcatttccctgactagaggacccagtaccaccctgcctagtgtcaggagttaagtggaaagcaaataggaaacctacactagtagtttagattcaatgtagattcctgtcctgttgttaattttaggaaaacaaatgagtgacttaaggcaataataatcaggactatcctcgccataatttgaagagtaatttctcctaacacgctttcttcctccccaatctttgataaatgtcttttacctctaaagttgattaattagcaacatgcttattcatattctgtgaatatttctaggatggacaattgcctctgaggacattccctcagccagcccaagtacttaaacaaaaacaaggaaattctttgatgttaaagatctcgtgtgtgtccgggcgcggtggctcgcgcctgtaatccctgcactttgggaggccgaggcaggtggatcatgaggtcaggagatcgagaccatcctggctaacatggtgaaaccccgtctctactaaaaaatacaaaaaattaggcgggcgtggtggcgggcgcctgtagtcccagctacttgggaggctgaggcaggagaatggcatgaacctgggaggcggagcttgcagtgagccgagatcgagccgctgcactccagcctgacagagcaagactctgtctcaaaaaaaaaaaaaaaaaaaatctcgtgtgcgtgtgtgtgtgtgtgtgtgtgtgtgtgtgtgtgtgtgtgtgtgtgttttgaggcatagtttcactctgttgcccaggctggagtgcagggtgtgagctcagctcactgcagcctccacctcctgggttcaagcgattctcctgccttagcctcccaagtagacgggattacaggcacccgccaccatgcccggctaatttttgtatttttagtagagacaaggtttcaccatgttggccatgctggtctcacattgctgacctcaagtgatccaccgccttggcctcccagaatgctggggttacaggtatgagccactgtgtccagccattttttttttttttagacagagtctccctctgtcacccaggctggaatgcagtgagcgatctcacctcactgcagcctccgcctcctgggttcgagctattctcctgccttagcctcccaagtagttgggactgcaggtgtgcaccaccacacccagctaattttttgtatttttagtagagacagggttttgccgtgttggccaggctgatctcgaatcctgaccttgtgtgatccacccacctcggcctcccaaagtgctgggattacagacgtgagccacgacgcccggccccagatatatttttaagtggaaaaagcagggcagaacagggaccgtacatattgttgttagtgtcagctcccaaatggatcttattttatctcagatcacagtccttgcaccatgtgctgctggcaccaatgtagagtaaaaaccatctatgtgggcatttttttggcacaagaaaaatctcaatctgataccaataaatgtgtgttaaagaatgtcagacttagagtaatcattgcaagttgagcccagataaaactattgcctctctaatgtgttttcttccttctagtgtatatcagcctcgtgtttggtatttcatatgattcgcctggtaagagatgttttttggcttcactaaattttgtataagagtgaaagtgttggggcaaccattcagaggtataaaatgtgggagatttgatttctgattgtacatctgttgcctgttttattgggattctttctctgtaaaaggagctaaaatgagctaactctggttttttgagagatacaaaactagtctaagaaatgaacactagagatcatttttaaacttctttaaagaatattcaaactcttaataatctcactaataaaagaatgaggagacacagactgtgccaaataaaaaatggcccagaaatatttactctttaatttacattcttccaccctgatgattccagacaaaggacaataatttttttttaactaaacttcttcctacgtatataaatctgtccacaaaacttcactaagtattaaatatgtgtccaaccttgtgctaagtgttggttgggggtgaagagttggcagttgagaaacaaaggcctgagtcctaaccacaggaaacttcagtgatctttaaaaatttaaccgtataaggcagaatttggcaagtctggctttaatgtctcatttatcactgccacttcccacctacatgacattgtataattcaactcagtttcacagtctgtaaaatgaatcttttcatagtgcctacttcagcattgttgtggggcttaaatgcttagaaagggccagtctgggctcatgttatactcccctgctctctgtgatccagggaataagtgagctggggaatccagaggaaggaaaatttgcagcgggctgagctacttaaggaggacttcatggaggagctgggagcagagttgagagaacggcttggggagggagaatgggtaggggagagtgaaaggaagtgcatcatgtgggctgggatggcctgggttattttggtccagtgaaccatggagggacagtccaagggcatcggagaagcccttctgtccagactctccttacacagtgcacagtccctgtttcccatgcttgcctgccctgacaatatgttgctcgttaattgacttactaatttatttcccatgtcctgtagacttcctgttttcaagacaccagggctctctggagaggttatctgccagaggtgtgggttctagatcccaagaaatgactgaacagtggccagaatacaactgtgggttccaaatttcaatgccctttttcttcttctctttagattacacagatgaatcttgcactttcaagatatcattgcgaaatttccggtccatcttatcatgggaattaaaaaaccactccattgtaccaactcactatacattgctgtatacaatcatgaggttggtttgatatttcattttctcttggtaaacatattattgttctgttatatggggagaggtgatcttttctctctctctgtctctccctctcccttttcctatctacctctccttctctctgcgtttcttattcagagccttaaaaagccaaagacaaaacaccatcacacatccatttttaattcagttgaatactttaataatccaaatctattttgacaaagcttgtatgtgtcatcaaagccaatttctacaggtcagaacctcacatacaaaataattcttgtgtatgggttaggcaatgatttctctaattcagtcagtctgaatgtttaaaagtcctgttatctgaggacaggaatccaaaggtctattgaccatattgatggtttatgttcacttttctttactctggtgggacaccagaaagctgcctggcctagtctgggacaggcctgggtccatagtctggtttggtcactaaccagcttgacacttggcacggacctcagcccctaagctaatgcctctgctgaggggttgctgcaaggattcgtgacataatggatggagtcctgcttgtcttttgtcttcccacacctaccaatcgcccttagaagtcattgctttgatccagcagccccttggagtgtccttttgatggttatttatttggcctagagctgctgctgctactgcttattgactgagccagtgggagacctcttgtgagtttctcttcggtgcctgctaaaaagtttttctctgcattgagtggtcacatgtatcatccaactaactgaagcttggtagatgagatatctgcattgtccctgaaatagcccaggtctgacttaggactggatcatctagtcttagccagagagggagggggtctcagggaaggcattcataattgtcccatagaggaagggagatctgaggcttccaccatgagggcccaagtttcattcattcatttactcatccggcaattttttttttttttttgagacggagtctcactgtgtcaccaaggctggagtgcactggtacgatcttggctcactgcaagctccacctcccgggttcacgccattctcctgcctcagcctcccaagtagctgggactacaggcgcccgccaccacgcccagctaattttttgtatttttagtagagacggggtttcaccatgttagccaggatggtctcaatctcctgacctcgtgatccgcccgccttggcctcccaaagtgctgggattacagacgtgagccactgcacccggctcctccggcaagttttactgagcacctactacatgccagggggtccaactgtgaaccaaagtccctgccctcctggagcagacattatgtaaatggagacatcagtaaacaaaggtataatgtgacaggtgtgggtaaatgctacaatcaagaaaagagagggattgaaagtgcaggggtggggagggcataagatgttccattttcaataagatggttggggaagatcacttaatacaatgatatttgggcagagccctaaaggaaacaatgaagtaaggcgcccaaaaatagactctcattacatcaatgctaacaatttcctttttccatttttttctttccaaagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacagtgagttttatctctgtttctccacttcgtccccatcatcaagatctttattatttgctattccatgaaataggaggtctacaaaggtgttttagacctggggctgggctcacctcttggccctgccacttcctagctctgtaaccgtggactgctttgcttctctgagccttggttttctaaatctgaaaagtggaatgataatttgtactttgcagatttgccccgtgcctgtataaggcagtaggaactgctgttttcggttttgcagcctgacaggaagtctggagccaggttcaggtgggctggatctagcgctctcatctctctggcccaggattttctttctttctttctttctttctttttttttttttttgagatggagtttcactctgtcacctaggctagagtgcagtggtgcgatcttcgctcactgcaacctccaccttccaggttcaagcgattctcccacctcagcctccagagtagctgggattacaagcacacaccaccatacctggctcattttttgtacttttagtagaaatgtttcaccatgttggccaggctagtctcgaactcctgacctcaagtgatccacccgcctcagcctgccaaggtgctgaggttacaagcatgagccaccacacctggccccagtgttttcttaatacagcaactccaccccctcattataacccaatgttcttttgtgtgtgaacaccaagtgtgcatgcacctagtacccaaagctcagaggagaagactagaccccaagaacaggcctaccccttctttctttccctgtgactcaagtcagttccctaacacactgtgttaacagccccagctgtgttactttttcaatttcccactttacaacgagtttccaagagaaccatctggtctcagcttcctgttgtaggctatgcgggtgtgcacgtgctcatacatgattagcaaagtggtaaggataactgaatccccctgtggcaaacaattcggatacgacatttgctggatttgtgtgcatgtttacgtatgtgtataaacagacatctgtgtgtacacacagaaaagaaagaaaatcagaatttatagttcatggtatttgggttgttaaagaatgcatattaaagtaacagtgagatatgtttcatggctcaaatgataaatatgaaaaatacataaatatccaggtttagagggaatacaaagagtgtgctttggcatggtccatctgaagtaattggcagcatgtattaaaaaccttaacatgtgcttactctaatccagaattctttagtaatttgtcccaaagaaattattaaggccaggcacagtggctcacacctgtaatcccagcactttgggaggcctagaccagtgtatcacttgagctcaggagttcaagaccagcccgagcaacatggggaaaccctatgtctacattaaaaaagaaagagagaaagaaagaaagttaggggggagggagggagggggggagagagagagagagaaagagaaaagaaagaaagaaattattaaggacaaatgcaaaaatttagttccaagaatatcccatgatacattaagtctttaataaaaatcagagacaatttaaatgttcaaaacagtgaatcagttaaatcatgatacagtcacttagtggaatagcattagcaatgaaaaattatgatgtaaatcaggacttggcagattttctatacagggccagagaagaaccactttagactttgtgggccacatatggtctctgtgacatattcctgtctgtttttgttttttgcacagtgtcttttgaaccaccagagtttgagattgttggttttaccaaccacattaatgtgatggtgaaatttccatctattgttgaggaagaattacagtttgatttatctctcgtcattgaagaacagtcagagggaattgttaagaaggtaagtggcttctcctgttaggatcaaaacagttctgagtgggcaatcaatgcacttgactgtctcttttgaaaggaaatttgcagttgaacaattaaagctaaaacgtcaggcttcagtatggtccgacttagggaagaagtcactatggttcattcactattgatctaaacctgcagcacagtgttctttaaaagaataagccacggctgggcctggtggctcacgcctataatcccagcactttgggaggccgaggcgggcagatcatctaaggtcaggagtttgagaccagcctggccaatatggtgaaaccccatctctactaaaaatacaaacattagctggatgtggtggcaggcatctgtaatcctagctactccggaggctgaggcaggataatcgcttgaacctaggaggcagaggttgcagtgagccgagatcgcaccattgtgttccagcctgggtgacagagcaagactccgtctcaaaaaaaaaaaaaaaaaaaaagagtaagccacatgcacaacatcaaggaacacacaggagagagggtgtgggagggagatgcagagtacagccaaatttcagtgaaccctggagagatttatttgaaaaggagagtttagctgagccacccgtgaaaagcatctgtcgctgcctctctggccctcacacacagtaaggaagtggcttatctggcaggttctgtcctctcctaatttctgcaaaggacctgactctcagtaacctcagggttatctggtatcagacagccctgcatcttcaatttttgttgtccctagccctccaaatgctggaataagtggaaatggacaaattgctctcaccggtgtagcagcagcttatgtctgtagagccctttgccaagtataaaacccttgcaagtgagaccagcctgagagataatcagggtagatgcatttcaggcggagggcacaggaagttcaaaggctctgaggctggagtgggcccggtgtatttcagcaacagcgaggagaggtggctgaactggagtgaccaggcaggagatgaagaggaggtgaggtcagagggtaaatgtggctggacctggtaggagtttgtgggtctgggtcttctgagtgtgatggaagcctgtggaacccaaggcttaacagagcatcctggctgggctgttaaaaatagaccacaggggcaaagatgggagttaggagaccaactaagacacaatccagggtggcagtcacttaagaggcagtaacaaattatatgattattatcatttttcttttaatatcgacatggattataatcagtactctaggaaaaggagcaaaaatgggtgaaaaataagtttatgtggcctaaggactatgtggagtgtcattaaatctgtttcaatcatgtctcgtttgtgttcaccccataagcaactaactctatgttttagattatgattcctaaaataagagactgttgcttattaggatattgactactctataagaggaaaaactgtagttaataggcatcttcttcataaggaaaattagcctttaaatccagaaaaaaaaataagctactagtataatctaagcaacagatggtggtggcttggaccttgatagtagaggggtaatgagtagtgagaggccatcaaattctgcatatattttgggttttgtttgtttgtttttgagatggagttttgctcttgttgcccaggctggactgaaatggcatgatcttggctcactgcaacctccgcctcccgggttcaagccattctcctgcctcagcctccctagtagctgggattacaggcacccgccagcacacccagataattttttgtatttttagtagagacagggtttcactgtgttggccaggctggtgttgaactcctgacctcaggcgatccacccacctcagcctcccaaagtgttgggattacaagcatgagccaccatgcccagctcataattctgcatatattttgcatgtggagcaagactaacttccccattaactatggaagatgatgaatgaagcaggtgagggttagatagggttagagggtttgggacatgttaaattccaggtgtccgtaaggaatctaggaggagacgtggggaaggagctggatgtgccagtctgttgtccaggagagaacccgcagctagagagagagcctgggagtcactggcttcttggtgcatgttgaatgccctaagaccagatgaggtcacctgggaatagacactcagagagaaaacaagacatccagtgacagagcccaggaacattccaaaatttggagatctggcaaatgaggaagaaacagcaaaatcgactgagaaagagcaaccagcatggtagggagagaagcaggtgagagtgatgtcccggtagctgagagaagaactttccagaaggtgaaagtggtctactgagtccagtgctgtaaatgggacaattgaagaggactgactattggatttagcaacattgtgtccttgataaaagtagttttaatagagttaggggcaaagagctggttggagtagattcaagaaagagtgggaggagaaaaattggagacagtgaagagagctcattcttccaaggaatttttccaaacagggaaggagattgtgtgctggccactggaggggaagcttttagtttgttgggtcgtaagtttgtttgtttactaactcctcctcccaaacagaaatttacagaaaaacatcattactgaaggctgtatttgagctgctaggaatcctcatttattaaactgctagtaagaatgtattttaaaaactgtaaaacatgatacaaaagttattattcatgaaagagccttcatatcatcttttaaattctgaagtgaaatgcaactacaggaaagaagaggcaaggtgtttaaagggagatggctgggcacagtggcttacgcctgtaatcccagcactttggaaggccaaggcaggcagatcgcttgcggtcaggagttcaagaccagcgtggccaacatggtgaaaccccatctctactaaaaatacaaaaattagccaggcatggtggcgggcatctgtaatcccagctactcaggagactgaggcaagagaatctcttgaacccaggaggtggaggttgcagtgagccaagatcatgccactgcactccagcctgggcaacagagtgagaccccatccatctatctatctatctatctatctatctatctatctatatctgtctattgataaagggagaagatgagaaactagacatcagtcagttttgtcacagacaagctctgtgaccttggagaagttacttagccacactgagctacagttttctcatccgttgaatggaggtaatgcctattttgcagactgttttgaaagtcaaaagggttaatgtttatgaaggcactttctcaagtgtaaagtagacacacactgtccatgagagaagataatcttgtaaaaatgacgtcacagagacttttattcctctttgaagacttttatctcatttgtaaaatgaaggcgctagactagatgtcatggttataaaatatgtgtgtgtgcaggtgtatattaaaagtgcatgtaggtgtagttttctgataaattacttgctccagatgacttataaatcctttttcttaccaagcctgtgataaatctaaccctgtttgagatttgaagacaaatcccaaaagagattaaggcctacctctaaatgaaattctcagtcttactgattttttgcttatgtttacagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcaggtatgttcatttttttaaattcatgttttgagtattcatgcttttactctgagggcaagcctatttaaagaaaagaatctgaaaagaattcatggagcactaaaggtctttcttccagtaaacacctcacagagatgttttctgttggttcgtgtgtatgatctggtagagtcacttttatattgtcataccaaaaaacaatcagatactactcgatgagatcagaaatcttgaaatggaaacgcttttgtttcagggagtcaggattaaattcagcactgtgtgccctttgtgtggccattgctgaagccaaatgccagaagaggtggagttgcttgagacagtggtatacagtggcattaaggggtgaaaaggtggaagcagcgaggttgggtgcagttcatggatgtgatctggcatcagctctcgctcatagatgaaaggaacccttgccagggtgtacgagaaaatcactgatgaaggctgaacacctttctgttacacagacatcagaacaataaacagtgtgatcccaaaccttcttcccctttggagtgagaacaatcaagcctcggaactccctgctgattgttttctcaggaagtagccaagtttccacctgttttaccaaaagtgagaagctatgcaagtctccctcaaagaagcccttctaaatgtcccaaccgcagtgttaggggaaagaggtcccaatccataccccaagagagggttcttggatcttgcgcaagaaagaattcagagcgagtccgtaaagtgaaagcaagtttattaggaaagtaaaggagtaaagaatgactactctatagacagagcagccccgagggctgctggttgcccatttttatgattatttcttgatgatatgctaaacaaggggtggattattcatgcctcccctttttagaccatgtagggtaacttcctcacattgccatggcatttgtaaactcatggtgctggtgagagtgtggcagtgaggacgaccatcttggttttggtgggttttggccggctttactgccatctgttttatcagcaaggtctttaccaacggtatcttgtgccaaccccctatctcatcctgtaagttacaatgcctagactgtctgggaatgcagcccagtaggtcccagccccattttacccagctcaagatggagttgctctggctcaaatgcctctgacaccaatggaagtatctttaatgttctgatttaccagaataaaaataaggtaggatctataaagaaattactttagttgtaaaccaaaataaaattctaagccccccaaccaactgaatggatccctcctctcagccaagggccgagtaaagtaaagtaaacctgaaacactagttcaggccatgatgggagtgagtggtccagacgtgcctcacgggaccttcctacctttggaattcaggcacagctggccagcactaatattaaaacagaaaccttaagactgacaaaaagatgctttgtagcactaataccagcatgatggatagcaggccctaaaagaaaccaaagtgttttaccccaaaatacatttctttgacatattttgaaatggccctgcaaagctgtctcttgcagggaaaatctgctttctataaagaacccccttcccagtccaggtgttcttcctgatccaagagagaattcactaagagtctggcacttttttaagtccagtaagaaacatttacagtctgttctctctgaagcctgctaccagaggcttcatctgcgtaataggaaccgtggcctccgcaaccctttgtcttaacccagatgcttccttttattaattccaagtttttaatcagaaaatctttgaatctacctatgacctggaagcccccccacttcgaattgtcccacctttccagattgaaccagtgtacatcttacatgcattgattgatgccttatgtctccctaaaatgtataaaaccaagctgcaccctgaccaagggttctcgggatctcctggggctgtgtcatgggccattggtcactcatatttgactcagactgaatctcttcaagtatgttactgactttggctcttttcattgacaaagtgatatggtcacttgtgaatgaagtgagccacggaacgttgcctggcacataacggtgctctgtgttggcttcactacagggcaatatgatttgattctctagtgttcctcaagaccagatgatgcacaggctggttctaaaggaaaaaacatgtcaaacacctttagcgtaagttatttttatgtcagcaaatacaggcaaacttaaaactgcatatagattctgactatagctctttcaaaaatataaatccaaaataaatgtgcatgtctttgttctaacaccagctatctgacactaactagttgtccaatgattccattcatttctgatactaccccaggttagcacagaccccacaggttaaaggctcagtcccacaaaactgcctgcccccacttcagatgccagccacaagtcatgggtgacaaggttccctgcacttccacctgacttggctacaaattcaggagttcccatgacctccctttaggtttgataatttgctaaaatgactcacagaactcaggaaagtgttatggcttatgattaccattttattataaaggaattgatggacagccattgaagaggtgcacaggacaaggtctgaaagggtcccaagtgcaggagcttctgtccctggggagtcaggtgtaccaccctctctgtacattcatctgttcatgaatttggggactccccaacccttggtgttcacagtttgtattgggtttcattatgtatgtgtgattgattaaattactggctgcaggattgaactcagtctccagcccactcccctccttggatagaggtcaaatgggggagctggaagttccaaccgtctgatcatgtggttagtttttctagggaccagccctcatcctgaagctatccacaccctgccccatcacctcacaagcataaactcatatgtggcccctaaaagaggcttgttaacaaaagacactcctaacgttcaggaaattccacaggtttttgaagctctgctccaggaactagggacaaagactggatatatatgtatattttattatatcattgattttacatacaaacgaaactcttatagacaataaaaactgaaattagtgacctggcagacagatggtggtttattgaaactcagtccccagttccaaggtgaatgtgttgctgatgagaaggcacaagctccttggaggttgatgaattctgtgatgactcactttctcccctgactcttttccatttcacctactaagatgttcatgtaacaacatcctctcaggtcattccatttttacttggcgtgaatgcgtcatgttgcacatcaagtcagccctcattctttgattattacccgagataggtcaagtaccgctctctttaattatccaaatactgtacctgatgtcaaattcttgtttgaaactcaggaagcaaataggttcagataacgtggcctctgtcactatctgcttgccatctgacgtgccctcaaccagccaaactcagaaaccagacaggtttggatggtgaggggtcttggaaggatagcctgagaccagcattaacataggctcagcagtaagcactgtgacccaatcctagggcagactgatatggggggattttagcccagacatctggagaaacaccttccccttgtcaagccttaaaactaatggtttgtctcttttattaatattaaggccctaaggaaaagctctattcattcatttgacaaatgtttattgggggcctgttatgagccagattcttttctggatattgaggatttagcagtgaacaaaacagattaaaaacttctcaccttgtggagcttacattgcagtaggagacagaataacaagatcaacatgtaaaatagacagtatgttaagtaagtaccatggaaaaaaattatgcgggaaaggaggtgagggggatgtcaggttgaggagagcaggttgctgtttttaataggatagtgtcttgatttgcatttgctagaagcagagcctgggatgtgaattcatattcaagtgtgatttattggtgggggcatcttaggagaaggggaaagagggaacaggtaggtacagggagagagaaattaagcaggcatgtggctctcagctgagcctgatcccaaggggttctcggaagcgtgaactgtatcctcaagtcagcagccagtcagttactggtggtgatctatggcatggcctccagatgaggcagcccccttttgggcaagggcagttccttatgtgtccggagttggttcctgccaatgggttcgtggtctcgctgacttcaagaatggagccgcagaccttcctggtgagcgttaacagctcttaaagatggcacagacccaaagagtgagcagtagcatggtttattgtgaagagcgaaaggacaaagctttcacaccctggaaggggacctgagcgggttgccactgctggctggaggtggccagcttttattcccttattgtcccttcccgtgttcgtttctgtcctatcagagtgcccttttttcagtcctcctcgtgattggctacttttaggatcctgctgattggtgcattttacagagcgctgattggtgcgttttagagtgctgattggtgcgttttacagaatgctgacttgtgcattttacaatcctcttgtgagacaggaaagtccctgattggtgcgttttacaatcctcttgtaagacaagaaagttccctaagtcctcactccacccaggaagtccagctggcctcacctttcacttagagaaggatcagctctgagagatatcagcagacacgtgcggcagcagtagtgggtgtgcactgactggaaaaggggacatgggcaggccacccacagcatccaccacagatggccacagatggccttcctgagaaggtagcatttgaataaagacccaagggagatgtggtaagcagaataatggcccccaaagatgtctacatcctaatcccagatatgtgaacaggctaacctctatgccaaaggggcttgtgggtgtgatgaaattgaagatcttggccaggcgcagtggctcatgcctgtaattccagcactttggggggccgagccaggtgaatcacctgaggtcaggagttcgagttcagcctagccaacgtggtaaaaccccatctctactaaaaatacaaaaattagccaggcgtggtggcatgcgtctggagtcccagctacttgggaggctgaggcaggagaatctcttgaacccgggaggtgggggttgcagtgagccaagatggtaccactgtactccagcctgagctacagagcaagactgtgtctcaacaaaaagagaagcaggagactcagaggcagagaaggagctctcacagcagcagcagaggtcgcagagtgaggatgaaggagggggccatgagcaaaggaatgcaagtggcctctagaagctgggaaaggcaaagaaatgggttttcccctagagcctccataaggagttcagtcctgccaacatcttgatattttttatcccagtgaaacccattttggatttctgatctccagaactattaatataatatatttatattgttttatgacactaactttgcatcatttgttacggtggcaatgggaaacaaacacaaggtgagggagtgagtcacgcaaacctatcaggggaaggagttccatatgcggggttcagcaagtgccaagtgcccgaggcaggatatgcctggcacggcacggcaggagtgaactgaacaagggaagaatagtaacagttctggtcagaaaagatggaggagcctgaatgacatagaacttagaagccgttgcaagagatggggaccctcagagggttgtgagcaggttgctctccgtgatctgacgtgggatgtaaagggaacatccatccacatgccttgaagtgggagccaggtgacccctgggctgattactgcagtcacccaggggagaggcggtcttacttgttccagagaggtaagtacgggaggaactataagagactgatgttagtcatcgccagtcttttcataaagttctttatcttttccattaaagatcattgtgatcagatattaccaaccccgttgctcagttcagccctctgcttgtgaggtttcttattttttgcttaaaatatctccacagtgaatccagagacagacaggtttgtccaaggccaaatttttaagacacgacctggtctctccttcccaagatgggttgatctggtccatctttcatgaagaagatagttaacagcagtaacattcaatcacagcttctcctttctgagtcagaacattgatgggattcatctcttttcaaatatgaatatttaaaaatagcatgcatgtataattgtcatgaccccaagtgagatttctattttttagattatcatcaagctgaaaacaaacaaaaattctaagttctcctaaagaattctcagactcatgagaataccccaaattgaggaatattatcctagcatattaactacaatttacacaatttggtttggacatagagtgcattgtagctgttatatgcaagttggatgggtacatgagtcacaatctctgtattatgccattccttcaccagtgaaatcactttggtttacagtacccctttcaagaatgtaaacgctatacatgtcagaattttgtatcctaaaggcgtgcctctgtggctagatctgattctggaactgtcattgatatgacaatccaatccttcacactcttgatggaggtgagagtggattcttgaaccctgtgctatctaacagtgtttttactgaactatcaagggtttttactgaacttctttctattcattccttaaccttctggaagacttagagtacataatccatttgatttccttttttctcccctctatctatttttgcctgaggctatagttcgaggattaatactaatgaagacctttctggaagtgcaagagagccttagtgatataactactgatttttcagtctggtcgcacttcaggaaaataactatggtcagtcaaaaagctgaaattttccaaaaggaattttgatgagaaactaaggggaactgttaatagagcaaggcaggttctgcagagccctgacttgtggccccagcgtggctaaagtccagcctcagaatgacccagttggttgttttcaagcaaactttccttccccacttcttcctgcccgcagcgcatgctaaccagtgtggctaccgaacgtttgagatgtgtttcatgtgactgagagaccgagctcttaattctgtttaattttaatcatttaaattcagccagctgcagccagtggctactccactgtacagtgcagttatagaacataaactgaaggaaattttacttttaaaagctaagtctattttattgtttaaaaaatgcacacttagataattctccagtctctggtatttctcaatataaaactgttttttcaaacctttggtttcttgatcatcttgtaacaccaggccaatgtacatttatttccatctgcaattgtttattgcattttttgaaataaagtcatttaatttttcatcaacagaatcagcagaatctgccaaaataggaggaataattactgtgtttttgatagcattggtcttgacaagcaccatagtgacactgaaatggattggttatatatgcttaagaaatagcctccccaaagtcttggtaggtagtttttttgttttgttttgttttttctatctttgttttttattttaacttaagaatttgtatttatataaatattttcacagaagaaaatctcattttctataaacaccaaaatgctttctcactctgagttcttttccatatctataaatgtatattttgcagggtttttgttttgtttttgtttttattatacttttaagttttagggtacatgtgcacagtgtgcaggttagttacatatatatacatgtgcagttgtaagtgtatctgtgcatctgtgcattttatgttttctttcctttttttttttttttttttttgagacagtctcactctgtcacccaggctggagtacagtggcgtgatctcagctgactgtaacctctgcctcctaggctcaagcaattctcgtgcctcagcctctcaagtagctgggactacaggcgtgtgctaccacacctggctaatttttgcatttttagtagagatggggttttgctatgttggccaggctggtcttgaactcctgacttcaagtgatccacctgccttggcctcccaaagttctgggattacaggtgtgagccactgcactcagcaatgttttgttttgttttgtttttatacttcatcacataatttataatgatcaggtagaatttcattattattaacataccatttttcatttaaccatttctcagctaaagggcatttggatttcttttccttttcttttctttggtgatgatgaatagtacaataaacatttttatatggatcgtctttttgttttggattatgtcagtggaacatatacacaaagtggatttatcctataaaaagatttaaaaaggactaggcacagtggctcacgcctgtaatctcagcactttgggaggctgaggcgggtggatcatttgagcccaggagtttgagaccagcctgggcaatataaggaaaccttgtcttagagaaaataaaaataaattagccaggcatgctggcacatgcctgtggtctcagctactcaggaggatgtggtgagaggattgcttgagcccaggaggtggaggctgcagtgagctgtgattgcgccactgcactccagcctcggttacagagtgagaccctagctctaaaaatatataaatatcttaaaaatataaagaagcagccaaaggagaggaagttaagaggagtaagtcagaacatagtctatgtggccagcagcctgcctggtttgaaaggcagctgctcccactcactagtcacaaaccttgagcaagtttcttaacttctgcacctcattttctcatctgtaaagtgggcataagaatagtaagcctggccaggcgcggtggccacgcctataaacccagcacttcgggaggccaaggcaggtagatcacgaggtcgggagttcaagaccagcctggccaacatggtgaaaccccttctctactaaaaatacaaaaatttgccgggcatagtggcgggcgcctgtaatcccagctactcaggaggctgaggcagagaattgcttgaacctgggaggtggaggttgcagtgagccaagaccgcactactgcactccagcctgggcaacagagcgagactcccgtctcaaaaaaaaaaaaaaaaaaaaatagtaagcatacctcatagagcagttgcaagggaaaggtaaattatatataaagcaccaagagtcatgcccagcatatagtaagcatggtgtaactgttagctgttattattgctgtcatcatcatcaactgcatcatcattcaatctcattaagtttattttttatttttttagaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagtacagctgatacggactctctctctctttttttttttttttaagaattttcataactttttagcctggccatttcctaacctgccaccgttggaagccatggatatggtggaggtcatttacatcaacagaaagaagaaagtgtgggattataattatgatgatgaaagtgatagcgatactgaggcagcgcccaggacaagtggcggtggctataccatgcatggactgactgtcaggcctctgggtcaggcctctgccacctctacagaatcccagttgatagacccggagtccgaggaggagcctgacctgcctgaggttgatgtggagctccccacgatgccaaaggacagccctcagcagttggaactcttgagtgggccctgtgagaggagaaagagtccactccaggacccttttcccgaagaggactacagctccacggaggggtctgggggcagaattaccttcaatgtggacttaaactctgtgtttttgagagttcttgatgacgaggacagtgacgacttagaagcccctctgatgctatcgtctcatctggaagagatggttgacccagaggatcctgataatgtgcaatcaaaccatttgctggccagcggggaagggacacagccaacctttcccagcccctcttcagagggcctgtggtccgaagatgctccatctgatcaaagtgacacttctgagtcagatgttgaccttggggatggttatataatgagatgactccaaaactattgaatgaacttggacagacaagcacctacagggttctttgtctctgcatcctaacttgctgccttatcgtctgcaagtgttctccaagggaaggaggaggaaactgtggtgttcctttcttccaggtgacatcacctatgcacattcccagtatggggaccatagtatcattcagtgcattgtttacatattcaaagtggtgcactttgaaggaagcacatgtgcacctttcctttacactaatgcacttaggatgtttctgcatcatgtctaccagggagcagggttccccacagtttcagaggtggtccaggaccctatgatatttctcttctttcgttcttttttttttttttttttgagacagagtctcgttctgtcgcccaagctggagcgcaatggtgtgatcttggctcactgcaacatccgcctcccaggttcaagtgattctcctgcctcagcctccctcgcaagtagctgggattacaggcgcctgccaccatgcctagcaaatttttgtatttttagtagagacaggattttaccatgttggccaggctggtctcaaactcctgacctcaagtgatctgccctcctcagcctcgtaaagtgctgggattacaggggtgagccgctgtgcctggctggccctgtgatatttctgtgaaataaattgggccagggtgggagcagggaaagaaaaggaaaatagtagcaagagctgcaaagcaggcaggaagggaggaggagagccaggtgagcagtggagagaaggggggccctgcacaaggaaacagggaagagccatcgaagtttcagtcggtgagccttgggcacctcacccatgtcacatcctgtctcctgcaattggaattccaccttgtccagccctccccagttaaagtggggaagacagactttaggatcacgtgtgtgactaatacagaaaggaaacatggcgtcggggagagggataaaacctgaatgccatattttaagttaaaaaaaaaaaaagcaaacacaaagatgcttcaagatcttcaggagaagtatggtatacaagtttcagggaccctatttgacaattttcagagtgctctctatgctgattccgagtcgagtgtgtcagctgtgattacagtgcctgtggatctaggccgggttgggggggtgtgggcgggggaagggaagtctggcccggagcaattgctcctgccggtaaccccagcactttg

SEQ ID NO: 833 - DNA, 38619 bp, Human; identical to SEQ ID NO: 669

SEQ ID NO: 834 - DNA, 11726 bp, Human
gctgcctgcttctggcatagagtatgtgcttgggaacagtcttccccacgggtgaccccaatgggtgttccctttcccagggattcagaccatgtcagcttcagtccagagagctgtggccatgtcctccggggacgtcccgggagcccgaggggccgtggaggggatcctcatccagcaggtgtttgagtcaggtagacgctgtggcggggagatggggctgatggggagacccaggctccaagatggaaggaggaccacgcccctttgcatcctggtggtcccacagcagaccggactgttgctcaggtagccagagtttctgcctgtggttctgctgactttggaggaggagggtgagcactgaagtctccctgtcgggggaccttctgcaaggccagcggtccaggcccacatccccacccgggatgtacagcactccccagtcacctccatccatgtgcatgggccctcctgggccatggggttgcatccttagaaagttctgcctgtgctgctgagaccctccagggtatcggcattcttcaaccaggacagcctgtagcatagcgtccttgccccccataccctggccagcctgcagcatcctcgcccgccattccctggccagccgctgaccccatgcaatcaccagtgccatctgaccagggcacagcagggccgctggtggcagacccaccgtgccatcggggcattccatctcaagtccctgacacggtgtctcctcggtgctggacatgggctgggaacaccaagcacagccagggccctggtcttgcacctctggatggtcccaaggcccactgtgttacttcctaaggctgttggttaaattggcacaaactgggaggcttgaaatgacagaaatgccaacatcgaggtgtctcggggccacactccctctggaggctccagggaagaatccttccttgtgtctcccagctgctggtcattatgggggtacccctgtgctccttgttcctgggctcaggacccaccgctccagcctctgcttctgtggtctcacagctgtctcccacgtgtcctctttataaggacaccagtcattgaacttatggtccagtgtgacctcatcttaactaatcacatctacaaagaccctgatttcaagtaaggtcacactctgaggttctgggtggacgtgaacttcgggggacgctgttgaacaccctggtgtagatccaggacaatccccgggccccagactcgactggggtgggggcgggctggaggaatgcaggctgtgggaactccacctgtctctgctagaccccaccctggggcctacacgactgccaaggcaggtcctgctgggcgggtgagccaggaccagccggcatctcctcccaggcggctccaagaagtgcatccaggttggcggggagttctacactcccagcaagttcgaagactccggcagtgggaagaacaaggcccgcagcagcagtggcccgaagcctctggttcgagccaagggagcccagggcgctgcccccgtaagcacctgaccttccctggggagcctggctcttgatgccccccgccccaggaacagcgttgcctctgggggagtggctctgctgggggctgggggctgctgccgagagacgcctggtgccacagccatgtgcaccctcgctgctgaggctgcccccattgctgacgcccctcttccttgcagggtggaggtgaggctaggctgggccagcagggcagcgttcccgcccctctggccctccccagtgacccccagctccaccaggtaatgccctagaccacaggagaggcccctgtctgcccttgctcccctcgggtgggtcctgctgcctctgcctttacctgggcactcagggatgagcaccggggcctgagcccctacccacagggtacagctctttttctttaatagacagtatttttttcctgataatacgcaatggtaatagtttaaatgagtcagagaaagtgaggtcttctcaggctcttaagagcatggcgtttggtccaggctgtacccgctgctctcagctgggcccgtgggtgggccgggcgcccctgctatagccaggaggtcaaggatccactgggaatgccatgctcatctttcgtccccagcatggtttcttaatggggtagaagcagtgtggggggtgcctgccgtggtgggttacagatcttgaccacttggcaccaggggctctgtggggccctggcacttagcagtgacaggagccagtcctgccctgcaggagcacccgggctggtgggcgtctgggggattgttagaatgagtgaggtcattgccgtgcaggaccagcctagcctggctgtctggggggattctggaggaagtggtacctgggagacccctgaaggcacagcaggcaccatccaggcagggcacaaggacggtgggggctgcaggtggaggattcagcaggcgctgaggtcgggagagacctccctgggcctggccccactgccctgtgaggaagggttcatgtggttggtgtacagttccggggcccctggaacgcagcagcctgcaagaaaccgggttttcttcccaatagggatggccccggggggtgtctgttggagaccagatggatggggaacaggtggtcagggcagaatttcaggccctggcagcatgggagcagggcagagactggggagttcaggtacccagagatgctgctgggggagctgttttgggaaggaggtggctctcaggagggtgctgcaccccagcccagtctgcatgggcgtctcttgcctgtgccagaagaatgaggacgagtgtgccgtgtgtcgggacggcggggagctcatctgctgtgacggctgccctcgggccttccacctggcctgcctgtcccctccgctccgggagatccccaggtgagcctgcacctctgccagcgcaaccaggccaccccggttcacggccgcctccacccactgaccctgaagggaagccaccccaagcctctcccatccaagatggaaaggggttctgagtcaggtcactgggccgtggggccggggcctggggttttcccaccctgccacctgcctcccggtctggccacacctgctgcccagcctggacagctgggcccctgagggcagcaaagcagaacagaggcccagggcgaagatgccaccctgtccaagctcatcccaggctgcagcccacgcccccatgggtagccggcccccacccccaagccccaccccagagtcccactccagacagggctggggagcacagaggccacagagctgtgccccccagggcaggtgggagtttgtccaccaatgcacaggacgccgggcttagtgggggcgggaggcctcctctgcgttcacatcccggtgctccttccccacggcccaccgagccctgcccccattccaaccccacaggacgtggcagtctgtgggaggaagagctctgggtgcagtggggacccacgttcaggcgaggctctgccccagcccctgagtggccgtcatcaggccccctctcagccttgtgcctcatcactagaataaggggcacagtgggggtcattgctcggctcctgaagccgttcctccttgccgtctctttctgcccttgatcacctccccattctgctgggtgccattccccttaacaggtgggtcagtttagggaggcccccggcagggcccagccctgagaggcaggcaaagccaccagggctcgcaggtgttggggattcctggggttcatcagagagcacgccaaggggaccctgatcacgctggccagggccaccccacgaagggtaaatgtccccctgctgggctctcccttcctgtgtctctgcccatctctctgctgtgcctcggttccccctctgtgaaaagacatggtcggagccctggagctccacccgtgggtttggggatctgtcacccgctgtcttgttctgcatgtctctgactggtggacacacgagcagtgggacctggaggtgctccagctgcctgcaggcaacagtccaggaggtgcagccccgggcagaggagccccggccccaggagccacccgtggagaccccggtatggccacgccccctcctagccgggccacccctcctgtccacatggccacgccccctcctaggctgggccaccccctcctgtccgtctgtcccctggagtcctgtgggacaggactgccccagccatagcactatgtcccccatgcccaagcccggtccttgtggtctcctgcagtggagtccccatcatggttcctgtgggcctaaacccagctctcctggctgcgggtccaccccggggggcactatgagcattgataacggccccggaagatgtgttccttgttctgctgctgtgagggtagtaggtctactgtgcacagacccagtgttccctctgacagccctgagggccagggggccccccgtgtgtagacgggggaggagggaggaccacagagccaggaagtgccacagcctttcccactcagtgtggacgccttccaccatgccagccctccgcccccaccatgccaggcctctgcccccaccctgctgccctgggtttcagggtcccagcagtcactgactcctgggtggtgccgggcaggcgcccgctgcccctctgatgctgacccttgggttccagctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcaggtgagcggggagtgggggtcagggtgggctcttcaaggagcccaggacctacggggcggatgaattcacctgaaacaggaggagagggaggccaggcgagaaaggctccgggaggcacagggcctggggctgtggggggagcgtggggggctgcggggggaaggggacgctcctagacctccactccagctcctggccctgggcattactgctccccccacaaggcaggacaatgaagggggggatgtcccagcacacgtgggagccctcccctccctgcctcaattcccttccctgcacccctgtgggcaccgcctttcaggagactcccgcactcagccccaaaggaggccaggcccgccaagcaggagagaggtgcgggcgccaggcttgcaggcagcagcctgagggtgcttgggtcgcccctgcctcctggggatgggactggtcccgctgtcctgcagcctgcgtggcaccgtgaggctcctcacttgcgcctagacccgccgtccagccctgggtggtcccaggggagagcgcacagggctcgggttcgggttcagctacatttcccccggccccccgcgtcaccccgcgctgttgcctcccacagaacctggctcctggtgcgcgttgcggggtgtgcggagatggtacggacgtgctgcggtgtactcactgcgccgctgccttccactggcgctgccacttcccagccggcacctcccggcccgggtgagtgagcgtggtcggcggggaggcctgaacccacacccacaccctacaccccaccccacactccccacccacatcatacagcccacaaccacaccccacccacaccccacactcccacccacaccttgcaccccaccccacacccatgccctgcacccacaccctacactccacagccacactccaccacacccccacccacaccctactccccacctcataccctgcacctcaccacactccacagccacaccccaccccacaccccacactcccacccacaccctacacccaccccacaccctacacccaacccaaacccacccaaacccaccactcccactctccacccacacccacaccccttcctcacaccccacacccccatcccccactcaccacccacgcccacaccccacaccccataccccggaggtggcactcctgctcccccccagggctggcagcccctcatcctctgctgcaggacgggcctgcgctgcagatcctgctcaggagacgtgaccccagcccctgtggagggggtgctggcccccagccccgcccgcctggcccctgggcctgccaaggtcagtgccgcaggggccctccatgcatgccggtgctgggggtggggaaccccttgggttggtgttgggggagcacatctcagggcagaccctgggtgccagcttcgagggcttgcaccagacgcactgaccatgtgctcattatctgtagaaaatatttcccctttaaaccaattctttttggcaacttaaatatagttaaaaaggaagctccccccgagggttggtggctgacgtcacggttggctgtgtggccgcctcacagcatgagcctgagagtcctgccagggctccctggtggggtgaagggagagcgggagcgcccggcctgcaggagcaaacccccaccctgtctgacccctccaggttgtctcacccccagccctccctggggccaggatccaccccactgtgtggccagagccctctcagagaggcaaagtgaccccgggtccagccagtagctcttcctgtcctcctgctccggggtcagagaggacctgggtggcgcggagacccctgactgctggggcggctgggcttgccctggagctgggtgtgggggaggcccgagtcgctgctgcaggagcctccgggggggtggcctcttgccctgaccgtccccagcagaggcctcctgagcacatcctggccaccgaggagcctttagggatcctggggtgatgacacgtcccacctgctccactggcccatgctctttcccagctgtgcctccgccccgtatacaccgtgtgggtgacaggccaccccggcgtggtactccccaggagggtgacagcctaccccagcgtggtactccccgggcaggtgacaggcttccccggcatgcaggctctggcctggcatggcacaagcctcagacccagccctgcccttggggcttttgtggaacagtggcgtggcccacagctgtcactgtccccttccttctagaagcctccctcctcacaccacccatctggagtcaggagcccagccgggcatatacgcagatgcccctccctaaccccaggcagctttcctgcaactgctcccgcagcgggtacctcgtcattaacctcctgggttctgtctctgaacagcagagacctctttcttgtcatcgtgatgtgaaatgtaacgccatgtcagaggaaaagttctggctggccttggcctcccccctcagcctgcccccttcctccagggtggttggacgtggccccagaccccatcctgagcagctctcccaccccctgggagcatccttaggaccggggagcatccaggggctttcccctccagaccgggcagcccctccctcagccatgcagggctgccgggcctcgcagcgccagtgttcacccgagtggaggagctgggatgtggctgtttggggccacaaatggggaattccacagggttcaatgtaatatggtctcctctctgctgggggtgcctgcctggggaccttctcccactctggtcgctcacctatagtgtgggctggccctggtggtgcttgtcgggggcgggggtggcatggaccaggcactttcctctctgggcctcagacttcccctctcagagtgggactccttgctggttccctgagctccctcgttttccccaggaggccacacagtgtggaggctgtctgggggccgtgggcagctggccgtgggcaggaccctggggaggcagccccagccccatcatgcccacgcagccctgtgcccccacccccagtggagctgggtgtaagaattcccatctcagtgtgggggaaacacccccgcggcccctaggccctgcggcctctgtacccccaccagggctgtgggagttgggctgacctcttctctttactgggttccaggatgacactgccagtcacgagcccgctctgcacagggatgacctggagtcccttctgagcgaggtaacgcctcccctggcctcctggtgctcctccactccccctcccctgcctcagccggcacccaggctccccactctgggggaggactgccggcccccactgctcttgagccgtggaaactcaggctgtccctgctccacccaccaggagccccagtgctgctgagcacctggcaccccccacaggagcccccctagcccccttgcaggagccccccccggcccctccccctgcgggagcccagtgctgctgagcgcccccagcccctccccaacaagagcccccacacggcccctcccctgagggcctgcaccctggcaggcagaggctcgagcaccaggctcaagatccactttcccagggagggtggggcgtgggagtggggggggggtcccagaccccgtccctctaagatttgcttgcccctcccaactcaggcctctctacgctaagatgggcaggtagaatctgtggggaaaatgtgacttttaagggctctgtctgtttttgccaagaggataagctccttcagcctccacgggttctcctcagtgtctgatgtggcacccgggggtcccagctgaccatggggcaggggttctgccctgtgcagtggccgtgccccacacaccctgaccgtgcaggtgtctgcagagccccagggcctgagagtgggccagggggcccagcgctgggtaatggagctgcccctctggatggggtccccgggtatagctggagaaatgagcgacgggctcacagcctctcccgggtggcggtcttattctgctggcatcgtggggcccgtggccccatcctgtgggagcatcaggctcctgagcagaataagtagctggccccgacccccccaccctgaaggagccacccgaggaggcagaactgccatgaactgccatggggatgtgccctgggcttataggatgtggtgaagtacacaggacagggtcctcggtctggcctgtgccatggggaccttgggcctcagtttccccacctttgatggaatacggtgaagtgcacaggacagggtcctccccagactggcctgtgccatggggcctcgggcctcagtttccccacctttgacttagagggaaggttggatggtgacttcttgtaacgatggccatgattctgtggctgcggcgggggcgcacctggaggttctcaccgtcactctgtcccgcagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctgggtgtggtggtgggtgcctgtaatcccagctacatgggagcctgaggcatgagaatcacttgaactcgggaggtggaggttgcagtgagctgagattgcgccactgcactccagtctggtcggcaagagtgagactccgtctcaaaaacaaaacaaaacaaaaaaaccacataacataaatttatcatctcgaccacttttcagttcagtggcattcacatctcatgtaaccattgccaccaccatctgcagagctgttccagcttcctgaatggaaactctggccccatgaaacactcactccccattcccctcccaacccctggcaccctccactctactttctgtctctatgacttctccagggacctcatggaagtggaatcacacagtatctgtccttttgtgtctgtcttattttactcagcatggtggccccaaggttcatccatgttgtagcatgtgccgaaatctgcttccttttttaaggctgagtaatattccagcacatggatggactgcattgtgttcatctatgctttcctcagcagacacctgggtgcttccaccttttggctgttgtgagtaatgctgctatgaatatgtgtgtgcaaatatctgtgtgagtctttgagtaaaatcgctggatcacatggtaattatatttttaattttttgaagaactgccatcctgttttccacagcagctacaccatttcacatccccaccaacactgcatgagggttccagcctccccatatccttgaaacaattactattttctgcatttttctttcttttcttttcttctttttttgagacggagtttcgctcttgctgcccaggctgcagtgcaatggcgcagtctccactcactgcaacctctgcctcctggcttcaagtgattctcctgcctcagcctcctgcatagctgggattacaggcgcacaccaccatgcccggctaatttttgtatttttagtagagacggggtttcaccatgttggctgggctggtctcgaactcctgacctcagacctcaggtgatccaccccccccccccccccaccccacgggcctcccaaagttctgggattatgggcgtgagccactgcgcccagcctgtgtttttcttttatagtagccatcctaatgggtatgaggtggtacctcattgtggctaaaccatgtacgtttaagaatttacacacacacacacacacacacacacacacacgtgatgaagctgtaagaaaagggagagaataatgacccaaaatgtcagcacaaggatgcctcaggggtagacacaggtgtcttcttagcgccttttagcccacgcatatgtgcttgcgcagtctctcggtgtgttttctaacatttcacaattaaataaggagtagttgatattcacagccaccatttccaccgtatatgtagagaaaaatgctcaaatcctagcgatcagcccgctgagctttcacaaaccgaacacaccgtgcggtcacgaggcggctctcccgaacaccggctctgcacccccagggcccggggaaccaagacttccccaagggcccagcaaaagtgagggaggaggggaggaaaggagggagagggagggaggagtgctggctgctttccgccagcgcctcgtttgggtttcgctctgctgaggcctgaaggcgccctgagggcccctggggggcagggaggggcggtggctgcggccgacagcaaggaacctccggagaagcgaagccgggccagacgtgccaccggggcctcggcgctggcgaaggggcgcgtgcggccgcactggggccagccccgccctggtccccggccacatcctcgagaccaccggggtggaggggggggtctcactgctcagggcccgcgtgacattgcacaggtttagaaacgcacagcgggaaggtggccccggcgggccgagggcgcaggatccctgctccgtccagggtccgtcctgcgaggaggcg

SEQ ID NO: 835 - DNA, 8159 bp, Human; identical to SEQ ID NO: 591

SEQ ID NO: 836 - DNA, 34589 bp, Human
  misc_feature (1)...(34589): n = A,T,C or G
tgtttcagcagccctgggaaatgaatataccatggaaacatggacctgaaccacggatcctggcaggggccttagagccacacagatgagccttcagcttggctttccccagcaagagctacatgatcttgaggaagctgcttgtcttctctgggtctcaagttcttcatctgccaatggagacaataatgcttacttcctaggttttaacagctttattgagatgtaattcacatatacaatttgcccacttaaaaagtacagttcatgcctgtaatcccaacactttgggaggccgaggagacaggcggatcacttgaggtcaggagtttgagaacagcctggccaaaatggtgaaacactgtctctactaaaaatgcaaaaattagccgggtgtggtggtgggtgcctgtaatcccagctgctcaggaggctgaggcagaagaatggcttgaacctgggaggcagaggttgcagtgagccaagattgcacccctgcactccagcctgggtgacagagactccgtcttaaaaaaaaaaaaaaaaaaaaaaaaaaagtagagttcagtgttcttttgggaatactcagagagttgtgtgaccatctcccatccccacagtcaattttagcacatttcatcaccccctaaagaaactccagacccatcagcagttgttccccatttccttccaaaatccctctctgccaagccctaggcaaccactaatatgctttctttacttaaaaaaaaattaatagagataggcttttgctatgttgcccaggctggtcttgaacacctgggctcaagcgattctcctgtctcagcctcccaaagtgctgggatttcaggcatgagccaccacgccccacccctcctactttatgtctccatggatttgcctgttttggtcatttcaaataaatagaatcatacaatatgtgaccctttgtgtccggcttcttcacttagcattttttttaaggttcatccatgttccagcatgtatcagtactttctccctttaatggtggaatactttattgtatagataagcaacattttgtttatccatttattttttggtggatatttgggctgtttttatattttggctattttgaattatccttctgtgaacattcgtgtataggtttttgtgtggatatatctggtttttcttgttttcttttgttttattaatacataatatgatacatatttatggggtatatgtgaatatttattacatgcatagaatgtataatgatcatgtcaggatatttgaggtatccacatttgggattgtttaaagattaaatgaaatagtgttaaaagtatttaatatgcccttcaacaaatgatgaggaaatcttagaatctgctcagactccttcagtttacatattaggaaactgaggcacagaaaggagcagagacttgctcaagtccacccaaagcagtagagcattgtggttaaatgcaggacttcagtcagactgtctgggttcaaatcctggttccacttggacatgggtttccttacataaatcacttcacctctctgagcctcagttttctcatatgcaaagtgaggataataataataccttccttacatggttactgatatgagtattaaatgtgccagctcatgtgcctggcgtataggaggtgctttataaaccttagctgttaccactcatggcattgccaaatgtgggacgggtctcctgactctctggtgtgagattgatggaatccacactttccagttcccttttctacctcctgggtatcttctcatatggttgtaagttccctggaggaagggaatgtggcttgctctctccaccacgctgagcatataagaggtgctgaatgagcgcttttattcactcctctcatccccagccctcaccagctgggagttgttgtaggtgtcaattttctgcctctttccaacaccctgtgaggtgactgagcattgtcttccctcccaggcagctcacagtgtgccaccatggagttggggcccctagaaggtggctacctggagcttcttaacagcgatgctgaccccctgtgcctctaccacttctatgaccagatggacctggctggagaagaagagattgagctctactcaggtgggccctcctccctctggtctcttccggtatcccccacccctcagcttgctgtagagacggcaatcaggggaaattctggtccctgtcctcccgtcagcaccacggacagctcccacgtctgtgggacgctctctgcagatggggatgatctcccagccctgccccgcctctccctcgttccccaccagccctctttccagaaatttccttcttcatccaagggacttttcctcccagaacccgacacagacaccatcaactgcgaccagttcagcaggctgttgtgtgacatggaaggtgatgaagagaccagggaggcttatgccaatatcggtgaggaagcacctgagcccagaaaaggacaatcaagggcaagagttctttgctgccacttgtcaatatcacccattcatcatgagccacgtcagtcccctcccacagaaatcattgcaagggggatgcggagcaatggctggaggaacggagactccagggaagagaggggagatggaggccagtgggggaaataggccccttcactaatgaccaccaagaaaacaaaatctcatgtttacatcctccacctccatttctatacgcatttctgcttcttgctcttctgtccatcctttctacaaagcccataccatacacccctttcccttttcctcccagctccttagccaagctactctagtatttgtaataactagcatttactggatactcatagtatgctcattgctgtccatacattatcatctggaatccttacaacaacaaaggaaatacatattattagtttctgtcttttacaaatgaggaaattgaggtttagagaggtgaaacgacctacccaagtttgcattagagatagtaatgtacagatctgaaattctaacctaggtctttctcgtttcaaagtctccatttttaaccacaaaaaaagaaagtgtctggggttggaagatttgctaaggcttaagcagagaagctaatttgtagccttaagaagagctacagctttcagacaagggcaggactcttggggagaggtggtggtggtgttgctgctagtggtttgttttttgggggagagacgtgggatagagaatctcttctcaccagcatcaccaccacctcatacagagcctatgttgaaatagaaaaaagtggcctttttctggaggatgcagcccctaccaggaagtaactgcttggctagcaaagtgcaagccggagtcctgcccccattttccttgttggcttgggcacctgtgtgcagtgaacaacctgcaaaactcttcttagtggtcttcttcctgccaacccaggaacagcagcattcagcagttctgtgcttgatccaaatgtggccaatttttccccagagcacagtgtattgaaaatcataccaaggaagaaaatggaggggactagtaattgttcatgtttcagaaattacagaactgagagcttgactgcttccttcccttcctggggatttacatgggggaagcagaagtgattggggctgaggacattcacatttcctcacaactggaggcagtcattaaggatttgggcatgtcataggatttgggtgtttttctccccccttagtggcatctccacaggcagcgaaagctgtctaagcaaataggtgaggcagtgcgttagtccattttttgttgcttaaaacaacatacctgacactgagtaatttataaagaaaaaaaatatttcttacagttatggaggctgagaagtccaaggttaggggctgcatctggtgagggccttcttactggtgaggactctctgcagagtcccaaggcagtgtggggcatcacgaggcaagaggtttcggtgtgatagtctctcttcctcttctcataaaaccactagtcttactcccacgacaacccattaacttattaacctgtttatccactaatccatgaacggattaacccattcatcaaggaaaagccccagtcacctcttaaaggccccacctctcaatactgccacataggggattacatttatacatgagttttggagaagacaaacattcacgtcataacaggcagcttcacccaagtctgctcctcaagtctgtgggttttctctctgcttctggaaggtgaagcccaggcctgggcaagtattcttttgcagcatcctgaaatatgaccttagcttctaaatgtgtaaaatggagataataatcacacccaccatcacgggatggttgtaagactgaataagttacaatgtgtaaagcatttagaaaaggaatttgcacagagtaagcattcagtagatgataggtactaccccacaaccaccgttatcattattatcaccatcattattatcatcttcattttcatcaccttcattatggccatcattccattcctcagctcagaagccttctatggctccccattgcttataaaatcaagtcctaactttccccagcatgaaacttctaccaccgtcacctatctctcagggtttcctaaacatactctgaacaagtttcctcactctgccactgtgacccagaaagctatctgttctccttctcccagactctgcctcatctttcaaggcctggttccaggatcccttcctccaggaagccttccctgattgccctattccaccatacaccttttttctcggacttcatgtcatggtgcctatattccaagggctctgagccatgtacccctttatatagttaccactatttactgagtgcctactgtataccagctactgtgttggatgctctagatgtagaacctctaattatcaccatcgattcctgggtagtaggcattatttattcatcttacacagatgagaaaatggaggcccacagtggttaaataactagcccaagattgcacagctagtagggctagtggaaagtagaggtggaatttgaactcaaatcctgcagtaactctaccattctgccttgctcttctttgtagcagtagataagttttcatggatacatacctcatccttttgattagattaagggcccctggagtgtcagtgttcattcatttgtttgatcattcattcattcaacaaacatttcttgagtccccactgtgtgccaggcccagaggttccccagcccaaggcctggcacacagtgggccttcagttagaccttgttgattgactgcgcttttccttgtctgggcagcggaactggaccagtatgtcttccaggactcccagctggagggcctgagcaaggacattttcagtaagtttgtggtgggtggggaggtcttggctcagcctgcatttcctgccttgttccctggggggtgccctaatacctgacgaccattcattgatgggcagtcagacccctctccccaaggtgggtacaatagagactcaccttgggctttcattgattgtgtgagttggtctctggtttttctcaaagtagagcacataggaccagatgaagtgatcggtgagagtatggagatgccagcagaagttgggcagaaaagtcagaaaagacgtgagtgagcccctccctgatccaacctagccttgcttgagacctggcctttccttgactccaaagcctgctgtgggtccaacttgcttccctcgctaagtcctgtctggttgggaggccctttaaaagccaacaggagccttaaaatgtacatctgattatttcatggccctgataaccctccaatggctacaaaatacatgccacaaggcctgtatggcccttcctccctctccaaacccactatgagacaccacacttcagccaccaccagcttctccactcctataacccatgtgccctttcaagcctcggggcctttgcagttgctatagtctctatctggaatgcccttcccccagttcttcccatggctgactcctttgaatctttctggtgttggctaaactgtcacctcttcctggaacccttctctgaccatccttccatgtagattagctcagttattctcaccttgtgtgtctttttccttgcagtttagcactcattaccatctggacatattttacgccttgctctcccactgtgaggacagggaccttgtctttcttgctcgtgactgtttccccagcatctagtgcagtgcctggtatgcagtagcacctcaatagatatctgttgaatgaaaacatctgtaaaatgggtgtaacagttaactgagtacttattatgggtctgaccatgtgtaagtcctgtatctatttattcagttcttaaacaggtgaatcgcacacagggtatgagattttaaaagtgcaaagaatattcagtgaaggctgggcgcagcggctcacacctgtaatcccagcagtttgggaggccaagggggacggatcacttgaggtcaggagtttgatacctgcctggccaacatggtgaaaccgcgtctctaccaaaaaatacaaaaattagccgggtgtggtggtgcacgcctgtaatcccagctactcgggaggctgaggcaggagaatcgcttgaacccaggaggtggaggttgcagtgagctaagatcacgccactgcactccagcctgggtggcagagtaagactctgtctcaaacaacaacaaccaaaagaatattcagtgaaaaaaaaatctccctcccactcctgttctgtagtccctcagttttgctcctatcttagtcaacctatgtgaccagcttcctttttgccttgtcagaaataaagcgagctcctgtatttgctttaattttccatgcaaatgaccacattttatttacactattctgcattttgctttcttcatttacttcattactccctgtctgggaggtcacgttccatattattgagggagaggacacggtcctatcttcagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacggtcctatcttcagcagcttctttattttctttcttttcttgtttttcttctttatgttttcatttgataaatatttccccccaagattttattgtgaaagttttcggccaggcgtggtggctcacatctgtaatcccagcactttgggaggccaaggctggcagatcacctgaggtcaagagtttgagaccagcctggccaacatggtgaaaccccatctctactaaaaatacaaaaattagccaggcgtggtggcgaacacctgtaatcccagctaccagggaggctagggtgggagaatcgcttgaacctaagaagcagaggttgcagtgagccaagattgcgccagtgcactccagcctgggcaacagagctagactctgtttcaaaaaaaaaaaaaaatgttttcaagatacaataaaagtgaaagaatggtactatgaaggtccatatacccaccatgtaccattttgattctacaattaatgttgggttttattcatcttatcacatctctattcatctgtccatccctctatccatccacacacccattcattatatttttggtacatttcaatgtacatttcaaacgtaaattgcagatttacactcccctcgtgtacttcagcatcctttcttttaaggccatgcagtgtttcgttgggtagatgaaccataatttgtttaagcagtcccttgctaagggacacgtgggtttttaatctgttgctgtgagtgcttgatactcactcactgatttctggcatactcctgcaatgtaggaaccaccacccccatttcatagatgtgagatcaaaggttcagagaagctgcattgcaaaggcacacagctaggaagcggttcaaaagcaggttcctttgttttgttttgttttgttttttggctcaaacccatgttgtgtccccatttgtgactcggcctcttctgctgctacactgcctggtatggtttgagatggggtttgggttcaagccaaggagctggggttggaatgttagagcgaggggaggaaaatggacccccaagaccactacccagccttgaagttaaggccgtatagcctgctagagtcctgagccccttctggcttgggacatcctctccctggggcagctgatcacatgttttctctgcagccttcccagaggagcttccggcagacctgaagcactggaagccaggtgtgcagggcaggtgggctggggttgggaagggtggatgccttggggaggggatggaagagattgaactcctggcccaagtctgatggggatggtgcatggtgcagcccctgcccttctttgggtagaggctgagagcttggggtcccttagagtcctctaaggggctcacgactgtttgtggaaggtggtaggggcttggagctaacagattgttcataggttctattctgccccagctctccgtgtggaggccctagggtcctgctcagcatagctctcagagccaagtcacaaggagaggactgggggactgcctggcacagagcagttgctgatcaacacagctgcagccagggctgagaagatgacaagcatttcctctgtcaggagagacatccatgccactccagggccctccccatcccaggaaggcccctccaagcacccagtctctaacacagcccacttcctcacagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccagtatgttagggggcttggagagagtgggctttctccctcttgggaggtggataaggagttgacactaaggcagggactgtcaggaactggacctcacctctccccaaccctatcagtgtcactcacctctgccccagccagttttatccttggggcccccgtcagctcaatccctggcagagaacatgcctcagaaggaaacacatccgtgcgagcatcaggagggaatctccaccaattagagcattcacctgccagccttattcgttcatcagctcttcatggagcccgttctctgtgccaactgctctgctaggtgctaagaattccatcagggcaggacagaaacagctactgctcttagggaaattagggccctttaggggggtcagacattaatcaaataagcaaaagcagaatcgcaaacacaggtgctatgcaagatcccacctcactgcctttgtctcttgcagtgcctttctccagttcctcgttgagctgcctgaatctccctgagggacccatccagtttgtccccaccatctccactctgccccatgggctctggcaaatctctgaggctggaacaggggtctccagtatattcatctaccatggtgagtgcggggcctggctccccgaccacctctccctcctacctgactgctccctgacctcatcctccccatactccatgcacttggcagtggtgccctagcaccttctcatgatcctccctccccagcacaactttctctgtccctatttcccaaaaatcaaagcagaagagcagagattcctgaggtggtctgggtgcatgaccaagagtggttgtgtggccttccatatgttgctttccccttctgacccttagtttttccttattttttttaaatgtttttgtttttaaattgcaacatcaatacatgctcactaataagctaatgacaagtgatgtttacaagaattcactgtctctctcactcttttagtatactgatgtgaatagtttggtgtgcatccttgcatagctttctctgatttgtcttgtttcctaatcagtaaaatggtccctactgacccaccacactgaggggttgtgacttgtctcagggaaggtgtgttttggctgtcagggatgagaccaggaggatgcttccactcaagtccagagcatccattcctggttgcaagacagtttcagtataacgcactggtatctcagaagcagagaagcagttcctgatgtctaggaaaatgagcactgaccacacagcaggaagagtgcaatagtagtacctgccctaagttccttatgagctaattgcacccatttcacagattggaaaagcaaggttccaggagctagatgtaactccagagctctttcttcagctctgtcctgaaatatcttcctttggaagttctactctcttctctccagacttcctgagctccacagcccagtttggagtaggggtgacccaagtgcatttctggaatcaatacctggttattctcacaccactctccacccccaatgtaggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacaggtaaggacccttagggcctgtgagaggtactagaagcaggatcgaggccctggggaaggaattgtctcaaataagatccacaagcaaagctgcctgtagggacaacaggtcatgtttaggggtcagtcgggacagggagggtctccagggagtggaggcatggttgtgggggaatggacagctagagaatccacatcccatccaaatacagccatcagccttcagctgcttgttacccagcagaaaagccagacaatgtggtcagatcttttgaagttgaaaaccctgatttttacatagatattgtgattttttaatttttattttattatttatttattgttgagatggagtctcactctgttgcccaggctagagtgcagtggtgcgatctcagatcactgcaacctccgccctacaggttcaagtgattctcctgcctcagcctccggagcagctggaattacaggtgtgcaccgtcacacccagccaatttttgtaatttcagtagagacaagtttaaccatgttggccaggctggtctcgaactcctgatctcaagtgatccacctgcctcgacctcccaaagtgctgggattacaggtgtgagccactgcacccagcctgatattgcgattttcttttttaaacatgagtgaaatttttaaaagtacagttggccaaagaaagacatatttgagttagatacagcctcaggccgctatcttataacctccatcttgggaaactcagcccatgaaggctgtaaggactaagtggcccagagggaggggggtccccaggggtaaccctcaccctaaatctggcacctgcttctccatctccagagcacaagacgtcccccacccaatgcccggcagctggagaggtctccaacaagcttccaaaatggcctggtgagtgatgcgggatctctctgccctgggtggtggagatggaagcccatatctggcttcacattgctcattcacttgacacttattcaaccccttctttgttggctcacacactcatttatttattcattcattcattcattcacttatttgattatgccatcatttcaccattcactccaccactccctcaaataatatttattgcccttcaataagcctgcactgggtgttaacacttcattgtcaggctgagagaatgaatgaggggcaagcgaatgatgaagtgagtgagtggatgaagtgagaagttgatgaggatgggagcaatggaaagtgggaataaaccagtgaataagagaattactaaattactaaatgcttactctcacatactggtctaagcatgttaggtatgctaaatcattaacatctcacacaatcccaatattatccccattttccagatgaggctactgaggcatggtgggatgtatagcatgctcagaattgctccagcaagtggtagaaccgggatttgaacccagacacgtgggctccactgtcttaactcttaacactccctcccatgacctccccatggtgagtgagtagtgatcaagcgaagaaaaagcttagtgagtaaatgaaggaatgagaaaagatggccatgcatggtgccttatgcctgtaatcccagcactttgggaggccaaggcaggtggatcacctgaggtcaggagttcgagaccagcctggccaacatagtgaaaccccgtctccattaaaaaatacaaaaattagccagacgtggtagtgggtgcctgtaatcccagctacttggcaggccgaggcaggagaatcgcctaaacccaggaggtggaggttgccgtgagctgagattgcgccagtgcactccagcctggggcacagggcaggatccatctcaaaaaaaaaaaagagagaaaaggtctaaaaggagtggacacttaaacaagagagaggatgagtgaaggaatgggtgtggaaatgagtgaactaatgaatgagtggtgggtgactgaatgaagcaaatgatgaagactgtatgggggccagatgtggtggctcacacctgtaatcccagcactttgggaggccaaggcggaacgattgcttgagcccaggagctcaagaccagcctgggcaaaatagtgagaacttatctccacaaaaaaacaaaaaagaaaaattagccaggcatggcagtgggcgcctgtagtccccagctactcaggaggctgaggtgggaggattgcttgagcctgtgaggttgaagctgtcgtggaccatgattgtgccattgcacgccagcctgggcgacatagtgagaccccatctctacaaaaaaatcaaaaaattatctgggcatggtgtcacatgtctgtggtcccagctacttgggaggtggagtcaggaggatcgcatgagcccaggaggttgaggttgcagcgagctgtgatcacaccactgcattccagcctgggcaaaaaagccagaccctgtctcaaaacaaaacaaaacaaacaaacaaaaaaactgtgtggggaacagatgtaaatgatggtggcagtgctggccttgtggtggctggccctggccctgcctctcacatacccccaccctgacacgcccctggcctttgcagagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacggcttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccagggacactgcgggcgcggcagctgctggagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcaggtggggtgaggggcttggggaagagacatccttgtgttgggcattaactgcggtcttggtgccaagcccagtgctctgtggggtctcttttagtatgcagagcagccgggtggggcagaatggattgtctccatttttaagatgaggatgttgaggctcagagaggggcagccacttgccacacagcaagtgagaggcaatggcattctcccagtcaatatttgaaggcccgccatgtgccagtcactggggtatgtctagaatctgagactgacctgggctcaaatttgttttattctttccaccccctgagcacgccaccgttttcttatgctaagagtaaagccatggcctccccttggactctctgcctccattctctcctcttccactccattttgtattcagcaaccagaccaatcttctcagaacttgaatctgattgtatcccatccctgcttacaatccttcagggacactccaccactgtcaggatgaaggctaaattccttaatttggtttcattaagtcggtctgcaatctgcttgagcatttcagcttaatcgccagaggattgcttccatatttccccctaaacatactttacccaagctgtaagatcctacataattgtgccaataatttagcagtgagcttcctggtagccgaagcaaaaagggaaagaaaaccactgtgtgagttgtgagaaagtaggaatcaataaaggctggagtggtcatggaaggctttctgggaaaggtagaggttgagctaaggaaagaaagtattttaataggtaggaggacccttcatggagctgcccttccattaaggtctagcctggtcaccgtgcctgggtctgaggccctccctccacagggctgccttgagcgacacagtggcgctgtgggagtccctgcggcagcatggggagaccaagctacttcaggcagcagaggagaagttcaccatcgagcctttcaaagccaagtccctgaaggatgtggaagacctgggaaagcttgtgcagactcagaggtgagaggagaggcggatgggaggtggttcacgccatgcaggttgaggacatgtaggacccattctcaagtttgtcatgggcatttccagtgccccctgtcctctgggacaccccatgccctctttctgggcaatggctaaccagagtctctcactgcactcgctgcccaggcggagcctctagaattgaaaactttgctgcattcaaaacctgccatcatgtgcccaagtcttagctaaagccatggagaacctctccccttctaggagttaacaaggatgccttgtgcacctagtaacagaagtgacacctactgccaccctttgaggcatttaggacaactgttgtcccaaatttatagacggcagagctaaggtccagaaggcagacaaaacttgattacagaacaagttaactgtctttcattcattccttcatcacacattgtttgagcgcctcttaagtgctgtctgggataggtactggtaagtgcctaatctgaggctcatttccatgaaagatacagtcctgagatcttttatttttatttttattatttcttaaagacagggtctcgctgtgcctaccaggctagaatacagtagtgcgatcatagcttactgtagcttcggaactcctgagctcaagcgatcctcctgcctcagcctcccaagtagctgggattataggtgcacgtcatcacaccggatgattttttaagtttttgtagacacagggatcttgctatgttgcccaggctggtcttgaactcctggcctcaagcaatcctcctgcctcagcctcccaaagtgctgggactacagtcacgaggcaccgcacccagacagatcttttttttttaagagggggacaacagttgccccaaggaaagcaatccccctggggaatttggggcactggggcagccatcatgggacccatgggtaagggctcagtgacagcagtgcctgctccccctaacattgcctgttctctccaggacgagaagttcctcggaagacacagctggggagctccctgctgttcgggacctaaagaaactggagtttgcgtaagcaaaggggtggattgtcttgtgggtctgcgcaaggtttcccctgcagcattagctgggcttgtaccacctgaatggagatagatctccagaatcattcttaccctcttgcccaccactttggaaatagcttccagcagctggaaagtgaccagtgtgggcaaatgctggaggttctcagatttgaagctaatggacccgtttgctggttaacatggtcattcccatcactcattcaacagacgtattgagcacttgaatgactgaggctgctgtcctcatgagctgacagtctaatcaactcccctctggaggaggtcagggggacttcctggaggaggtgatatctgcactgaagcttcagtgaggataaggaatgagctgagtggggagaggggagtaagaaaggctttccaggaattgtaatttggccagggatcagaaaaggcccaatgtgtccccaaccttccataggaggatgccactatgactatggagtccttttccctcctgtggccaggaactgcacaacgtcccttgtgcctgagcttgtttacttccacagccaagggatggcctccccagggagaatctttcccccattttgaaattcccaggagcttttgatgtgcagctaggatgaaaaagcaaccctacttgcctgggactatcctggtttgaaaactgaaagtcttgcatcccaagaagcccttagtcccaggcaaactgggacagttggtcgctctatgtgtggccagggctgggggccaacaccctaggcagtgctgctggggtgacagaaatggagacctaggcaaggctctagggagtccagttgtgtctgggtcactgaggaggggcagcccaccatacatgggccccaagaaagcacaataattattatatttagatctgtcagtatatagcttttctttctttctttcctttctttctctctttctttttctttctttcttctttctttctttctctctttctttcctctttctttcctttcccttccttttctttccttccctccctccctcccttccttccttccctccctcccttcttcccccttttcttctttttctttctctctgtttctttctttctttctctctctctctcttccttccttcctccctccctatctctctctttctttctttctttccttcttttctttctttcctttctctcctttctctttctttctttccattctctttctttctctttccttccctcccttccttctcttccttccttctttttcctttccttttcttttctttcttgaggcagagtcttactctgtccctcaggctggagttcagtggcacaatcacagctcaccacagcctcaacctccctaggctcaagtgatcctcccacctcagcctccctagtagctgggactacaggcatgccccacctgactaatttttgtattttttgtagagacaggatttcaccatgttgcccagtctggtctcgagctcctgggctcaagcaatcctcccacctcagcctcccaaagtgctaggattacaggtgcgagctcccgcacctggccagaacaggcttttaaatttgcagctcaccttccatctcaattatctcaggccaccctcctctacaggcattgtcatcatctccccattgtacaaatggcaatgctgagaacaagagactttaaattgtttatccaaagtcataaaggtcaggtcagcctggccctaagctccttccacagaaaaagctaaatgaatgtttgttccttggtaggggtctagatcatctaatgattaggaaggagttgttatgcctgtggtatattcggtgctgtttttttttggagatggggtcttgctctgtcgcccaggctagaatgcagtggtatgatcttggctcactgcaatctccacctctcggttcaagcaattttcctgcctcagcctcccgagtagctgggattacaggtgtacaccactacacctggctaatttttgtatttttagtagagacgggctttaaccatgttggccaggctggtcttgaactcctggcctcagatgttcctcccacctcagcctcccaaagtgctgggattacaggcgtaagccaccacgcccagcttataattcagtgcattttatatataatctcattaatctcaagagctactgtggaagacagacagtcatcatcttccccattttacagatgaggagacggaggcctggtgaggttaagtgacttgcccgtggtcccccagctggtcacccacaagctatcagctctccctgatcactgctcccctgtgccccagaaaaaagccagtgtctcttgttttgaacagagacaaggtgctaaatttgtccagaggtaaaaatgatgctgaaaagggggaatgtctgaaaacaataactgagggccctttctggccttaaattattttcagctgaaaaagcccctagttcaagatcggaactgcgctctggggaacagcggccatggggtggaacagcctagagccgggtgatcagccacctggagaccggaagcccccgaggaggttctgaggaaggaaggaaggaaggaaaagactatttctggcattttctcaggcttctactgtgcccaggcaccctgtagacctcatctgtctgtcaaatcagggttcttagccactcacaaccctacagggacttcgtttgtacacagagtccttccccagttcagtccccactcacctgttcacccttatctcctacactcgctgggtgctctctccattccagccacagggcctccttgctggctttcaacctcctaggcatgcttctgcctccaggcctttgcaccggctgtgccctctgcctggaatacttctccccagatatctgcatggctcatgccttcacctcctctggtctttactcagtgaggccttttcttttctttctttccctgtttctttctttctttctttccctcctttctttctttctttctttctttctttctttctttttccttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggccaacatagtgaaaccccatctctactaagtatacaaaacaaattagctgggcatggtggcaggtgcctgtagtcacagctacttgggaggctgaggcaggagaatcatttgaaaccgggaggcggaggttgcggtgagctgagatcacgccactgcagtccagcttggatgacagagtgagaccccatctcaaaaataaataaataaataaataaataaataaataaaactccattcccctcatggttaaaaaaaaaactccatccccctcaccactgtatatttccatatgattcattgtctcagacatcagcttgctttccgatttctttgattatctgtctatcttcccccctggaatgtcagcacccagaaggcagggattttcgtctgtttggcccacaactttcctccctgggcctggcacatagtaggcaagcggtcaatatttaacaacgaatgccttaatccaagaacccccataagattggggtgaaatatttgaggagatcaagacttaagggtgaagggatttgccaaggcctttagcagggagccaaatgccagatcctggagtcaaactctgatcctgtggccttttgctgaggccagtgttctcagacttcaggatttcagaggccgagaacatttcggaatgaattcaagtgaccgtgcgcggttactgttttttaatgtttatcaaggatgctcattcaaacaaacaaataacaacaaaatacccactgctggcaccataattttaccaaagaatgatcattctaatattgaaaaagttcaaaggacataattgcagaataaaagacagctctttatatggaatgcatttaaccatatttttaaactaaacggcccttcgttgtccttatttttctcatccccttgaagtctgctctaaatgttgatccaggctgtgtgaccctgtgtgagctatttgatcgcctagtgcctcagtttccctatatgtaaaatggagataagagcccatagctcagagtcttgaggagtaaatgagatctaggccgagggaagggcctagcatgcccctggcttataataaatgctcaacaaatggttccttttgttattaaaatgcaaaggcatattagtcaaccacctggtttaccactggcagtggtcgtcagctggcatttcaggaccccttccccaggctgcggcgggagaagggtatctgtggatgttgggaagagtaagaactggctccctacttagagacaaaagctggggagccccaagatgggagcccaacttacctctttttcttttctttttttgttttttttcttttttgagacagggtctcgctcttacccaggctggagtgcagtggtgtgatcatggctcactgcatcctccacctcctgggctcaagcgatgcttccacctcagcctcctaagaagctgagaccacaggacacaccaccacactcggctaattattgtgttttttgtagagactgagtctcactatgttgcccaagctggtcttgaactcctgggctcaagcagtcctcttaccttggcctcccaaaatgctggaattacagacatgagccactgttcccagcctcaactggcctcttatggggggctatgaaatctaccccaagcagaagagattggggtcctacgtggaagggttgcagggacctaagaggctggggtggaagggaagaggaggggcctcagacaggacctgacttctgtgccttgtctctgccccaccctggggctgaatgaggggctgtgactgtgactggaggtcttacccttgctctttgcctcctaggctgggccctgtctcaggcccccaggctttccccaaactggtgcggatcctcacggccttttcctccctgcagcatctggagtgagtatagactctgggaccccttcctctcaacatctgggtgcagtgctgtgatcatagctcactgcagcctcgaattactggcctcaagtagtcctcctgcctcagcctcctgagtagctgggaccacaggtgcatgctacagtgcccagcaacctctgggttttgacaaccccaaatcctgcccccaaggcacctgcagaaagaaaagccctcactttgtccctttttttctctcttccgcctactgcatcctcaatgtggctggcacatgagtgatgagatgacgccacatcagatgggaatccccagtgacaaaaaaagttgtagatcctttcgtgacctttgaaactcctttcctcacaacctcatttgctgctctcagcaattcagctggggagggattggggagcatagtcctactttacagtggaggttaaggaagttgccaagcctcaggggcttagttcctaagaagctaaacagggattcaagtccatcatgagttagactttgccctctggctgcctggttggagcccccaggtgatgaagtcctcgtctgaaaagctcaggaatgtgccggctgcctatggtgtattagagctggggggtgggaagggcaggtgccagggctgaggaggccctcactgggatgggaagggtcagatggccccaggacgctagctgatggcccccatctgattccacctgcagcctggatgcgctgagtgagaacaagatcggggacgagggtgtctcgcagctctcagccaccttcccccagctgaagtccttggaaaccctcaagtgagtgagctgggcctgcccttcctgctgaatcgggcccccaaagtccggctgactttttcaaaattaatttaaatttgtttttttagacaagggctcgctgtgtcacccaggctagaatatagtgctatgatcatacctctgcagccttgaactcctggcctcaaggaatctcctcacctccgcttcccaaagtgctgggattataggtgtgacttaccatgcccagccccagtggattcatccattcactcattcacctattcaatcagccattcatccttccattcaatgattcatccattcactcatgcagtcatttctttactccctcatccaaccactcactcaatcatttctttacttacccaaccatttattaatttaatcaacaaatatttaaggaggacctactatgtgcaggcacctttctaggccctggagacccagctttaaacaaaacaaataaatcccctgacctcaggaatcttaaattctagtgaggagacacaatgaacaagtaaacaagtcggtaattataaagtatacagtaatgaaaataatgtttggtgacagaaaattatactggggggtgaaataggagagatagattaggatttatcaataaagcattattatcaaaacagtaaaactttttaaaaactgttctgggctctgggaagttggagatggataagatacaggaggatcaatgtgattttttttctttttttcagacaaggtctcgctctgtcacccagggtggagtgcagtggtgtaatcatggctcactgcagcctcaatctcctaggctcaagcaatcctcccatctcaaccttctgagtagctgggacaggtgcatgccaccacgtcccgctaatttttgtatttttttgtagagacgtggtttcaccacgttgcccaggctggtcttgaacttctgagctcaagccatcctcctgcctctgcctcccaaagtactgggattacaggcatgagtcactgtgcctggttcaatgggatttttttttttttttttttgacacggagtctcgctctgtagcccaggctggagtgcagtggtacgatctatttattgcaaacttcacctcctgggttcaagcaattctcacacctcagcctcccaagtagctggaattacaggcatgcaccactacacccaactaatttttgtatttttagtagagacggggtttcaccaggttggccaggctggtcttgaactcctgacctcaagtgatccgcccacctcagcctcccaaagtgctgggattaccggcatgagccaccacgcccagttcaacatgattttttactgaacctagaggatatcaaaatcttcccacactccccctcacaaccaaggtcttagaatggccaaataatttaccggaatttacttagcaatttccttaattgtaggactgtgggacttctccagtaatttctagtgtcctaggtaacactgtaagctagatttcttctccttagtccttccgtccccctctttcttacccgccaccccacttaagtatttattgagcacctactatgtgcctggcagtgctctaggcacagggatacagtaatgagcaaaacagacacagccctgctccatgtgaagcccacaacccggcagaaaggattacacagccattaaacaaataatgccaacacttatttcattatagtgctgaaaagtggcgcagagggaaaagaggggatgttgtaaagtcatgggacaggtgggggcaggagggtgcactctccctcccatccacctcctcatccctgccctcccacttggccacaggacctaacagtatcctcctgtttaccgagaggtagcttaagtctgtcgacagcgccattcacagcctatgacccagaactctccttgaggtcaaagtgaggcatgcaagtttggtcctgagccctccccctcactgtgtccccgcagtctgtcccagaacaacatcactgacctgggtgcctacaaactcgccgaggccctgccttcgctcgctgcatccctgctcaggctaaggtgagtggggccccggataccggtcaggtgctgagctggggggctgcagagcgcagggaacccacatcgtgctggctgcaggggacactgagaccctagaagcaatcaccacagccctgaacaaaaggattagcgggacgtggtgaaagaaactctgagcaagtcacttattcattcctagcccctgttttcttacctggaaaatgggaaccatcctaatggtctatgtaagcacttgtcacaatgccaggttctgttatgcaataaatattgctccttttcccccagggatggcgggaccaggctttttccggaacctaggggtggtggcttctggaaggctaaccacgcacgtcagcttttgccggccttgtcacttacatgccggtcagtgtttcactgccaccttctggtaggccttggcatagcacctcttgcttttgagtgacttccatccaggccctggtgtggtcccagaggtaatgagcggactgagcttggaccagagccccagtcatccaactcagcattaccagctcttcttactcgccagactgagagaaactgctctcctcttcgccagagctcttcacttactgaggacaaccagagtcagattcccaggaaagatggcatttggtcccttattatttatttatttttaatttttttaatttctgtttttgagatggagtctcgctctgtcacccaggctggagtgaagtggtgtgatctcagctcactgcaacttctgccccccaggttcaagctattcgcctgcctcagtgctccgagtagctgggattataggcgcccaccaccacgtccagctagtttttatatttttagtagagacagggtttcgccatgttggccaggctggtctcaaactcctgatctcaggtgatccacctgcctcggcctcccaaagtgagtactaggattacaggcgtgagccaccatgcccggccaacttatttatttatttatttatttatttatttggagatggggtctcacccaggttgtagtgcaggggtgcaatgatggctcactacagcctcgactacctggactgaagcgaacctcccacctcagccttccaagtagctgggtcctataccctcctgagccttgttaatttcttcccagcatgatcactgttttacaatattttatttatgtaggtgcttacttcttgctatgcaaagaaactcagaagcaaaaatagaatctgtctggttcataattgtgctaaaaactagagatacaagtatgaactagagagatgtcgttcttgcttttgagtttctttgcgtagtaggaattaggcacatacataaataaaatattgtaaaacagtgattcatgctgggaaggaaactaacaagccccaggagggtacaggacttctggggagatgattcttccgtgggaagctctaggggaaaaggactctaggaagaaagaacagcaggtgcaaaggccctaagtgggaaaaggggctgtgttttaagggtcagaagggccactgtggctgtgtgtagtgaatgagggacagaggctgggcaatggtggaagtaggggaggtcaggggaatccagatcacacagggaggcccttgtgggtcacaagaggtatttgcagtttttcagtgtgaatggaaaagtaggtgggcctgggaaggcgacacttgatctgatttacacttttcttttttcttttcttttctttttgagaccaagtctcactttattgcccaggctaaggtgcagtggcatgatctcagctcactgcaagcactgcctcctgggttcaagtgattctcatgcctcagcctcccaagtagctgggattacagatgcccgccaccacaccaggctatttttgtgttttcagtagagacagggcttcgccatgtggcccagactggtcttgaaatcctgggcccaagcgatccacccacctcagccttccaaagtgctgggattacgggtgtgagccaccatgcccagcctgatttaccctttaagaaacatcatatttcatggaatctaagatgccatccattgtaagaccccaatatgaggccaaaatgcaaactgtgacacgctattggttataagacacatcctgatctcaatgatattcaaatggtgacatatatgtcttggcatcgatgaaatatggtcagattactctccctgtggggtggaggaagggtctccagggttcagagattgcaaaacccccatctagtttctgcactggtaccggccgacccgtgatgtgagttgatttagcctgaatccacttggcagcagtgtaaacctgctgcatttatttatttttttctttttttttcgagacagagtttcgctcttgttgccaaggctggagtgcagtctcagttcactgcaactccgcctcccgagttcaagcaattctcctgcctcagcctctcaagtagctgggagtataggcatgtgccatcacacccggctaattttgtatttttagtagagacggggtttctccatgttggtcaggctggtctcaaactcccgaccttaggtgatccacccgcctcggcctccaaagtgttaggattacaggcgtgagccactgcacctgctgcttttatatgcagccctgcaagggagttctgaggctgaatcatggcaaagtcatggccctgaaatcatacccgcagcagcacctgacctgttaaaaggctgcttggtgtcgagtaaacagctgaagttggcatcagtgacactcatcatgctattttcactgctactaatgctggttgtgaatatgctgcagaaactggagctggtccagtgactggctttttctcttcctgcccccagtgctggtcacaccctctatgttaactcatgcgaccctcaccaatgttcctgtgatgtagtcagaaccatagctaacatttagttcattctaggcaccaaggcatattctaaatgttatatcagcattgattcatttactcctccccacaatgactctatcatgcccattttacagatgggcaaactgagtctcagaagagttgagtagcttgcccaaggtcacataggcagtaagaggcatagctgggatttgaacttgggaagttgttctgacagtttccacacagtaaggcaagaaatgacttccttttagtcctgctgttttcctgggctcactgtttgaccacagagaagtggtctcaactctctgggtcttggtttgcctgtctttaaaatggggcagtaatcccagtaggtggtgactcccacggggctgacctccaggctgcaggggacactgagatcctagaagcaatcaccacagccctgaacaagagaactagtgggacctggggacagaaactttgagcaagtcacttattcattcctagcctctattttcatatctagaaaatgggaaccatcccaatggcctatgtaagtacttggcacaatgccaggctctgttgtgcaataaatattggttccttcccccagggatagtgggaccaggctttttctggaatctagggatggtggcttctggaaggctgaccatgcacaggcctccaatccctccccctggcctctgtttccgacagcttgtacaataactgcatctgcgacgtgggagccgagagcttggctcgtgtgcttccggacatggtgtccctccgggtgatggagtgagtgtgggagtctgggcggtgggtggctcagcccggggtgggagacactgaagtctctccctggtgtcctggaagagctggatgtgggggtggccttggtctggagctggggagtcccaagggccaggccccaaggtgagtttctcttgccagcgtccagtacaacaagttcacggctgccggggcccagcagctcgctgccagccttcggaggtgtcctcatgtggagacgctggcgtaagtccaggcaaccctggtgggtggagaacaactcactccccaggcgtgtggcccagtgtgaccccggagctcaaatcatgctcttcccttcaccaatctgcaaccctgggtgagcagacacttccccctctggcttcagcttcttcatctgtaaagtggggacagtaataatatccacccaagaggttttgtgaggcttaaactaatcaagccctacaaagctcttataacaacagtagctggcacacaaaaatgccaataaatgctatattaggctgaaccatatgaaattgctgacatccacccatttttgacctgtaaaattggcaatttcatatggttcaggtttatcttttattaagtcaccatgatgtccaatactggttactttatattctttcaaagcacttttatctccacaatcactcacctcttctaagacgcacagggtgggtcttacaagacccattttacagatgaggaaaataaagcacagagcagttaactaacctttctggggtcacacagcaagtcagctgcagaaccataaaggaatctcgggcctcctaggcttctccttttccccatgacccacaccggtcggtatcttgccaggggaaaagtccccaacgttctaggctgggtggaaggagggatttgggggcagctgtcactggggccccaggccgccctctctcctctaacctagctctgagtcccatccccccttgcaggatgtggacgcccaccatcccattcagtgtccaggaacacctgcaacaacaggattcacggatcagcctgagatgatcccagctgtgctctggacagggtaaccagggtgggcttgggaggggagagccgcagtgggttgggggcagtgtccttgtgaaggtggcattcaaaaaatgtgggcgggacacaggtggggctaggccaccacccttggacgcatgcgtcatcagagacatcccctcatctccaccctgggctcggtggagctgtcctccaggctttgcgagcttggtccctgtggtcaggcttagagatcaggggacaggaaagttggccatccacatcccacagcctcagtgcttggaagagcttcctttggggactccaagccttcccagctgctgtttcggcttggtggctgccctgatgctccgggtttgtctcagatgaacttgcttgacaagtctcctgctcctcactatgaagatcactgtcccccagccctgtgctccccgcactgtgctgcacgtccacctccattccactgcccctcccatccccccatcttgatagcacccttcccaggtgtcaagctgcccctcctagagtgtcctgcctaaaccccctctcctggctcctcccgctacagcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaacgggacactaatggggcggtgagaggggaacagactggaagcacagcttcatttcctgtgtcttttttcactacattataaatgtctctttaatgtcacaggcaggtccagggtttgagttcataccctgttaccattttggggtacccactgctctggttatctaatatgtaacaagccaccccaaatcatagtggcttaaaacaacactcacatttattctgctcacatatctgtcatttgagcagggctcagcggggacagctccttctgtcctactctgtgtcaggtggggcagcttgagggttgggctggtgtcacctgaagactcattcttctgtacgtctgacaggcaatgctggctgttggctgggggcctcagtgccactacggaatagttggctaggacccctccatgtgggctagttgggcttcctcatagtatggtggctgggttggagggtgtcccaaaaagaaaggaggggatagagagagaccacttttcataacctagccttagaagtcacacagtattacttctgctacatatatatgttttaagaggcagggtctcactctgtcgcccagtctggaatgcagtggtatgatcacggctcactgcagcctcaacctcctgggctaagtgatcctcccacctcagcctcccgaatagctgggactacaggtgtgagtcaccaagcccagttaatctttagttttatttttgtagagccagggtctcactatgttgcccaggcaggtcttgaactcctggcctcaagtgattctcctgcctcagcctcccaaagtgctgggattacaggtgtgaaccaccacacccagcccacttctgccatattctgttggccagtgtgacaaggattgctactgtcctacccaccctcctttcaccacatgtgcacatgcacgtgtgtgcacgtacacacacatacacacacacgcgtgcacacaccagagcccaccttggctcaagtcctcttttctgagaggacttttctttgtggcttcctaaaattcagtggaaaattaattgtttggggatgagaaaggttgaagcaccaaaagcttaccaaggggaatgtttgcctctgcctctgacacacagctctgtcctgggagtgagctggtttttagcggagacggagtcccaccttggctgcagggagtccgaaagggacttggaagctccgctttctacccagcgagctgccggcacgactgttgcttttcactcgggcatagtctgctcagaagccccaattcaagacatcttagcttactcctggtggcagtgggagctgcctgttcagctccagctcaccagccccagtgcccacaggatcagtctgattcccaagctctgctcctctccccagcaagtgagagctgggtgtcaagagggtctgaggaatccagacccggctgcgtggttgatgatctttgcagacaggcaagcacctcctgcctcgaactggctgcaaagggtatcaggtgctgccatccaggttcagcttgtaaatagctcaggtgtcaccctgcaagggatccctgcacttgcagactctacagaggccatgggcctcctgtgtgtgcggctacaggagtgagcactgaggtgtgctctgatcatccactgtgccatgtgccaggtttttggtctgacccactgcttttggtctgtgtgatgatgaaatgaggtcagagcctgcagttattaacactaacgatttgttaatgatagctactgtttattattttatttaatttttttgagacagagttttcactcttattgcccacgctggagtgcagcggcatgatctcggctcactgcaacctctgcctcctgggttcaagcaattctcccacctcagcctcccaagtagctgggattacaggcatgcaccaccacgcctggctaatttttgtatttttagtagagatggagtttcaccatgttggccaggctggtaatctgcctgccttggcctcccaaagtgctgggattacaggggtgagccaccgcacccggccactactgtttatttaatgagcagatacatgcaaagcccttatcacagtgcaagggaaattcaaagcgctcagaaagtattagctcaataagtgatgactgtgtgccagacactgtgctaaactcctactcaagagggataagagtctaggggcaggtggcagagactctagaacgagattgcctgggctcaacgcccacctcaccacttacttatgcaagctagttctctgtgcctcagtctcctcatttgtaaaatgggcataaccacagcaccttctttataggattatgtgaaggtgtggtgagctaatacgttaagaattggagctcaataacatgttggctgtcattattacatatatctgtgtttcattcttgcctctggctgggaatgttcttcccagctctccatatggctgatttctcatccttcgggacttgccccattctccaaccccatcactagttttatctttttcacttatttatgcagtctgctcttgtcctaggacatgagctccaggagggcgggaaacatctcgctttgtacactgctgtgccctctgtacccagcaaggcgcctgtgtataataggtgctcaataacataaaatgaacaaataatcctcacctaacggtttcattcattctacaaatacatactgacagcacagtcatgaataagatgttcctgccctggtgagtcttatattttagcaaattaaaaaaactctttggacagggctgccaggtgaggttggccagtctgtacactgcacaaaggcacctgggacaagggggaacatgggggctgcaaaccagtctgggttctgcttgccaaactgggagtcctggtgtggagccttttaacccagaggggcatcttttcgtagttaacgcacagtcatcgtaagatgtggataaatta

SEQ ID NO: 837 - DNA, 54286 bp, Human
ccgttcattgattttctaggattatgtgagttaataggtataaaagactaaagacagtttgttgctgtcacatataaaccttttaataagtgctggctgcaaaaaacatttgactctgatgaggcctttctcccatcgtgctctcattttcctgcctgtgaaatggaaggattgtcccagatgattttgagtcctccttcgaacttgatcgttctgcagttgtatttatttaatggaaattttccgtttcctctgtgtgtcgccctctccatgaggcaggtgttcctgtgaaggacctccttgcacacatctttccccagtcttcatcgtccacacttaaaatgcccaactcactctcttcctctgtcctccagggcaatatcttctctctacaccaatgatggtgacatggaagctctcgaggctgacctgaaacatcgatttacccgacaggagtgggacttggctaagagcctacagaaaaccatccaagcagcgaggtctgagaattactctctgaccgacttctgggcctacatggttatctctaagcaaaccagagaagtaagtcattcccagctggggacctggggtgggggtaggagcaaggggtctcagggtgtggggttaccaaagatgctgaccagcaccaccttttaagtccttcaggattttcaagtcatcaaaatctgggcacttcggttgatgcctcaaaactaaagtatatcaggattactgtggttgcaagtgacagaaattgactctgattcgtttatgcaacaaataaagtgatatgatttactagaaagatacacagacatccagggcaagaagaacaatgaggacttatgatggaataaggcagaaatagggaaagtgtcagacccaagacaactttcctctccatctctgcttggccatttgatgtcttgaattcactattttattttatttcattttatttttgagacagggtcttgctctgtcacccaggctggagtgcagtggcgagatcatggctcactgcagcttcgacctcctgggctcaagcaatcctcttgcctcagccttttgagtaagctggggcaacaggcatgcaccatcgtgcctggctaatttttaattatttttttttttgtagagacagggatcttgctatattgcccaggctggtctcaaactcctgagctcaagcaatcctccaactactgggttcaagtgatcctcctatctcagcctcccgaagtgctgggattacgtgtatgagccactgcatccagcctatcctaacacatcgggtttttgttgttttttgtttgttttgtttattcttgagacagggtttcactctgtcgtccaggctggagtgcagtggtgcaatcacagctcactgcagccttgacctcctgggctcaagcaatcctcccagctcagcctcccaagtagctgggactacaggcacgcaccactgggcctgacaaatttttttttttttttttttttttttttttttttttttttagagatagggtttcgcttttttgctcggggtggtctccaaatcctgggctcaagtgatccttccacctcagcctcccaaagtgctgggattatgggtatgagccactgcacctagcctatccaagcactttgggtggctgaggcgggaggattgcttgaagccatgagttcgagaccagcctgggcaacatagcaaaagcctgtctctatcaaaaaataaattagccgggcatggtgacatgcatctgtagtcccagctacttgggaggttgaggtgggtggattgcttgagcccaggaggttgaggctgtagtggcccattattgtaccactgcactccagcctgggtgacagactgagacccctctaaaaaaaaaatgtggcctacgtgcagaggttccaccctgtgggacccacatgcctccctcacactgtcttggcacattctcccaaagctgccggagtctcatttgtccaatatgaagaagcccgtggaagaagggacactaccctacccgatatttgcagccattgacaatgacctgcaaccttcctggcaggaggcaagagcaccaggtaagcaaacatttagagggagggagaggtagtaagggatggaacagcacggagtggaatggaagaatgtttccctgccctccccttggggagcccaggaagagggaagggctcaggattgcagaaaacagggtgctcagcttagacgagagaagagggaagtcccagaagtgaccagaggacatgcacttgctttgcatggatcaagaaaacctttaagaggccaacatggtggctcacgcttgtaatcccagtggtttgggaggctgaggtgggaggatcgcctgaaaccagaagttggagaccaccctgggcaacatagtgagatcccatctcaaaacaacaacattaaaaaacaaaacaaaacaaaaaaacacaataaattagccaagcatggtggcaggaacctgaagaatctacccaggagactggggcaggaggatcactggagcccaggaattcaaggcttcggtgagctgtgattgcaccattgtactacagcctgagtgacaaagtgagaccctgtccccccaaaaagaagaaagaaaaaagaaaacagaggagaggagggacaaaagacaaaaaggggccgggcgcagtggctcacgcctgtaatcccaggactttgggaggccgaggcgggtggatcacgaggtcaggagatcaagaccatcctgactaacacagtgaaaccccgtctctactaaaaatacaaaaaattagctgggcgtggcggcgggcgcctgtagtcccagctgctcgggaggctgaggcaggagaatggcatgaacccgggaggcggaggttgcagtgagctgagatcgcgccacagcactccagcctgggcgacagagcaagactccgtctcaaaaaaaaaaaaaaaaaaagaaaaaagaaaaaagtaaagaaaactgtaataagggatgtttgaaggatggcggggtgggtgggtggggctgtctctcacttttttttttttttttgagacggagtttctctcttgttgcccaggttagagtgcaatggcacgatctcggctcaccacaacctccgcctcccaggttcaagcgattctcctgccccagcctcccgagtagctgggattacaggcatgcgccatcacgcccagcgaattttgtatttttagtagagacgtggtttctccctgttggtcaggctggtctcgaactcctgacctcaggtgatccacccgcctcggcctcccaaagtgctgggattacaggcatgagccaccgcacccggccatctctcactttttagatgtcttccttctccataggtccgattatcacccaaatgctggcagctctccagacattccagtttctcttttgagctcatctctctcctgagatccagacctccttaccctatttcctaagcataaaatgcactcacttgttcagcaactgtgtcctggtaagttctcacgatacatcaggcaatgttaccagttacctgtggttgggcgtctcctggcatctcaaggctcagaagcccccagtgtgaatggtgtttgtctgtttgtttgtttgagacagagttttgctcttgttgcccaggctggagtgtaatggcacgatctcggctcactgcaacctctgcctcccaggttcaagtgattctcctgcctcagcctcccaagtagctgggattataggcatgcgccaccacgcctggctaatttttgtatttttagtagggatggggtgtcaccatgttaatcaggctggtctcgaactcctgaccttaggtgatccactcacctccgcctcccaaagtgctgggattacagacgtgagccaccacgcccggccatgaatgttttatctctctcctcggtgtggatccttgtgctgttttctcaccagagcagatacagctgactccgtcctttccataagccccacaaattcagtcattcccagacctagaaatcaccccctcctcattttcatcctttgtgctcttctacatcacccccagaccaggtctcccagtctcctgggagactcttgtaattagttcctcactggcccgcccatcccaagctgtccacctccttccctggctacctgatggaagtttccaggatgaaaatctgatcatgtcattttcttccctggaatattctaatgactcacattggaatcatgcattagatttatgcccacagacaatcctccatgcaatcgtgtggctacactcttcccttgcactccaggattccatggagttgcagccacaatgagatggaagagagaggcagggctgagggttcaagctctggaaaatattggaaacaggctgctgtggaagttatgagctgccaccagcagcgtagactcaggtctgaggatgagatccccagtggtttctgataccacacagtccatctctaacattctcctgtcatggttgtaattcctcattaatagatttctttttcctgcatacccgctacattcctggttctgtgctgggactcacttgccgttgtatttcctctgcagagacctggttcgagttcacccctcaccacgctggcttctctgcactgggggcctttgtttccataacccacttcggaagcaaattcaagaagggaagactggtcagaactcaccctgagagagacctgactttcctgagaggtcagcgctggggtcagaggggattaaaagggggtgggaagtggaggagaggcaagaattttccttctgagggtctagtttgcccagctcttaaatttcttgggggaaagaaaaggacttggtaggcttccagaaagaggaatggtgtattccttctgctgagtcttcagtgtctctcaaaggtctccttaatgcggcagatacctgatatcctatcaaacaatccaggagagggagcttaatagaggggctcaagtccagggctgtggcttccaataagcagattcagaatgtgtttgggattacatggtgctttgggaggctgacctgggaggatcccttgagactgggagtttgagaccaacctcggcaacatagcaacactgtgtctctacacaagatttaaaaattagccaggcattgtggcatgtgcctgtggtcccagctactcaggaggctgaggcagtggaaggatcacttcagcatgggagttcaaggctgcagtgagttatgatcgccccactgcactccagcctggatgacagagaaagatcttgtctcaaaacaaacaaacaaacaaacaaacaaacaaaaaactagaatgtgttttgggcaccagcaaagcaaggggcatacaattttttttaaatggggtatttccagaaaaaattacaacaaaaaccaaaaacaaaacagtcatagtgagtaaaatcagaacttgattaaatgtccttgactgtagcttacacactggtatcacttttagttgtggcttcataatcttctcagcattcagggtctgaaggcattaccctgctgggcagacagctcccctacataggaccaaccatgccagcttgagaaagtcattaatgttacctgagcctcgtttttctcatagggaaagtacttacctcaaaatgtgggtgtgagagttaggtatgatccacaaataaaacactcagcccagtgtccagcacatggtaggaaattaaggatggttgactctccatgattttagcatacacttttgagacacactaggagcctgatactattttaaatgcaggggattcagtcatgagcaggacagtgaaggctcattccctaatgaagtttgcactccagggaaggagatgatgaatgaacacacacaaaaataagtatgtattataatgtcagatcatagtaaatgctatcttgaaaaataattcatggtaagggactggagagtgactacagtattatttttaattggtggtcagagcttctgacaggagatggcctttgagcatggacctgatgaaaagtgaagccatgcagatatcttagaggaaaagcatcatggacagagggaagagcaaatgcagagaccctgtattagtccgttttcatactactataaagatactacccgagactgggtaatttgtagacaaaggaggtttaattgactcacagtttcacatggctggggaggcctcaggaaacttacaatcatggcagaaggtgaaagggaagaaagaaccttcttcaagtggtagcaggagagagaagagcaagccaaagaagagctgcccaacacttatcaaaccatcagatctcgtgagaactcactcgctatcacgagtacagcatggggggatctgcccccatgatctgattacctcccaccaggtctctccctcaacatctggggattacaactcgagagatttgggtggggacataaagcttaaccatatcagaccctaagccaggaccaagtttgtcttactctagaaccaatgagaagaccagtgaggctggagcctcctgaatgaggctgagagagagggctagagaggtaggcagggtccagatcatatgggaccctgaaggacacagatgaagtttagtttggattccaagtgcgataggagagccagggaggcagtttaattagggtggtgaccgattcagtttatatggtaaaacatctcactctctctctctctctctgagcatggattaggggtgggtgtgtaaacttagaagttgggagcagttgagaagctaatggtcctggtgacagataatggcagtttaaggttgggtaccagaatggatatgggagggaagtggatggactctggaaacctggagatggatgaagaagaattacacctggattggatgtggagagtaaggagaatcagagatgacatcaaaggttccagcttctgcaacctggtagatggaggggtgttctcaggggaggagaacaaggtaggatgaaggggatcttccccttttctctggtctggacagacggggtccttcacattgccaagcctggctcctgtctcctatccccaccatctctttgctaaatctggtcttgggcatcagagattttgaaattgtcactcccaggtactccctataacattattatttccttagatgtatgtatcacctactgaagggattctgtacgtgtattttatccctcccctcacacaccagggtgctttttatttattattataaaataaacataacataaaatttgccattttaaccattttaaagtgtcaagtacagtggtataaatacaatacattcataatgttgtgcaaccatcactgccatccatctccataacacttttcatcttgtaaaactggaactctacgcccattgaatactaagtccctgtcaccccctcccttagcccctgacaaccacaatgctaccttctgcctctacgattttgactactctgagtatgacatgtaaatggaatcatgcagtgcttgtctttttgtgtctgtctgatttcactgaggaaaatgacttcgaagttcatccatgttgtaccatgtgtctgaatttcctttctttttatggctgaatcatattccattgtacgaatataccacattttgcttatcaattcatccatcgatggacacatggattgctttcaccttttggctgttgtgaaggaacctgccatgcacatgggtctatgaatatctctttgagaccctgctttcaattcttttgggtatatactcagaggtagaattgctggatcatgtatgtggtaattctacttttaaaattttgaggccaggtgtggtggctaatgcctgtaatcccagcactttgggaggccgaggcgggtggatcacctgaggttgggagttggagaccagcctgaccaacatggtgaaaccccatctctacaaaaaatacaaaattagccgggcatggtggtgcatgcctgtaattccagttactcaggaggctgaggcaggagaatctcttgatctcgagaggcggaagctgcagtgagcggagatcgcgccattgcgctccagcctgggctatctcaaaaaaaaaaaaaattttttttttgaggaacgaccataccattttccacagtggctgtaccattttatattctgcccaatggtgtcccaggtttccaatttctccacgtcctcatcaacacttattgttttctggggttttttggataccagccatcctaatgggtgtgtcttttttttttttttttttttttttttgagatggagtctcactctgtctcccaggctggagtgcagttgtgtgatctctgctcactgcaacctcccaggttcaagttattcccctgcctcagcctcccaagtagctgggactataggtgcataccaccaggcctggctaatttttgtattttttagtagagatagggtttcaccatgttagccaggctgactttaaactcctgacttcaattgatccgcccacctcagtctcccaaagtgttagcattacaggcgtgagccaccgtgcctggctgattattcattttttatgtctccctgtatcatatacaaatgtgtttggctaaaagtcactaaccaaccacagtgccccgaggacatgtgggattaattttcttacaaaagaaaaagacagactgagcaccgtgactcacagctgaaatcccagcactgtgggaggccgaggcgggcagatcacttgaggtcaagagttcaagaccagacgggccaacatggtgaaaccccgtctctacttaaaaaatacaaaaattagcagggcgtggtggtgcatgcctgtaatcccagctagtcgggaggctgaagcaggagaatcacttgaatctgggaggcagaggttgcagtgagccgagatcacaccactgcactccagcctgggcaacagagcgagatcccatctcaaaataaataaataatacaaagttaggtggctggtgacattggtttagctgtgcaacattaagcagaaggacccaggtttattctagattttctgctcctccatccttagcatattaagtcaccctcatgctgaactcctccacaccacgggatggcggctgcatccaatgaagctgcaacttttttttttttttttgaagtcagggtctctctctgtcactcaagctgccgtgcaaaagcacagtcatagcccaatacaggtcttgaactcctggcctcaagtgatcttcctgcctcagcctcccaagtagctgagactagagttgcatgccaccatacctggcctgctccttctgagaaggagaacaagcactttgcagaagtccccccagcagtgtgcatggaccagagcttgaccgtcccctagctgcaagggaggctgggaaatatttgcccttcctgcctgtgtgctgagaagggttggcatggacaggagcttgaaatggccttggggtagccagtctacagtgcccggctggctccacccatagaaggttcgtgaggacaaggaccttatctgtcttgtttactgctctattccaacagccagaagagtgccgggtgcccactaattgcttcataaatatttatggaatggaagaaagatctttcttcctgctgcagatccctgcagtgctttatgccagtctgctggtgctttgaatatcaaacatgacagtcacgtgatggagaatgtttgaattttattgctcttttcttggcaggtttatggggaagtgctcttggtaacactgaagtcattagggaatacatttttggtgagtatttggggaacagaaaggtcaaaccctagagatattttatgcaaggagattcacagtacttttcctactcatggcagaagagagacctgtgtgtaattgttctagcaactgcttttcctgacatttattctcatataattgggcagccaggatgaccacagagtggatgagagtacagactcccttggaaggaatgttgctctggtacatgtaagctttgtgacctccgaaaagttacttaacctctctgtgcctcggtttctgcctctgtgccatgcgggtgataataacagtagttatgaatatttgatgagttaattcattgaaagcttgtaggacagtgcctggtagataacggcactcagtaaacattagcaatcattacctggtccctcatttaacatttaacccctttaataccctaagaggcagacgcttttgtcccttccattttgctgagatccaccaagtcgtgggaaggatgcgtgactcacccacactgctggtcagtgagtgcagacgcggggatctataggagaactgggtggtggatctctaggggaatagtgtggtggttctgatccaaagcctgtctgcctggatccacatcccggctctgcttctcctgcactgctcactctggaaagctgcttaaattctctgtgacccaatttccccttcctaaaatggagacaatagtacgtagtcgcagtctcgtatatttgatgtggggtttaaatgacctcatgtatgtaaaatgcttagagccaagcctgacacatgggagtgtttcattacatgttaatcttatttttaggatcattactgagttcacaccctaaaccactcgtcattcatttaatgtatattcatgggacctcctgtgtgccaggcactgtcctagttcttacactttgactttttttgttgtttgtttttttgagacagagttttgctctgttgcccaggctggagtgcagtggtatgatctcagttcactgcaacctccacctcccaggcttaagcaactctcctcccgagtaactgggactacaggcgcgcaccaccgtgcctggctaatttttgtatttttggtagagacaggatttcaccatgttggccaggctggtcttgaactcctgacctcaagtgattcactgcctcagcctcccagtgtgctaggattacaggcataaaccaccacgcccgggctgatgttgttctttgacattggtgttcaccatagcttggttaaaaacaaaactaaaaagggaatctatctatatccaacctccaaatggctaactaaaggtgtgagatgggtctgagtgttacttctccagtgggtctgctaagctttctctctaaaaaacaaaaacaaaattcctgatatgtagtgtttgccaattcctgtggtgtaaatgttcccaccgtggccaacttcaggctaccaacatgaggtcactgagcacagagttggaagagaggtgcaaaattggctctcgagagccattggctgccattggagcccatggctgccatttctattaatgaaatatccctgcaggtcatctgtattttttatattataactagggactttgttgtacagataaacattcctcctgcttctactcttttgcagaccagttaaggaatctgaccctgaaaggtaagcatcctacttcatcatgaatccctgatgataatggggaccgcacacttgcttgaggccagccattgtcctaggaacattacatgtatgattcatttggtgcccatttgaattctttatctggtatttcaaagatttcatcttgatttggatctgttgctggagaggtagtgtgatcttttgggggtgctgtagaaccatgttttgtcatattaccaaagttacttttctgattccttctcatttgagtagactatttcttttaattattcttgaatttatgttggatttgactgtgttttttttttcttttttccgcttaaggatgtgactttaatgtccctagctaattatagcctaatttggtccttggtgctttcaggggtgaagattgtaagagttccttggatatagggagtcttcgtgtgatggctttctcatatgctggttgtagaagcgatgtgctcactgtgtgagcaagttcactgttgcctacagggctggaatggtagaagactcttgaagcttaactcattccccacaaggcatgcaattttttccccagtattttattgactggtttgatggttcaggcttcaggtctgtaggggagtgcataggaagtgattgtggccaaaacatgtgagtaaatgcaacacccaatggtgagcaaaggtcccagccttgacagaggtggctggaggagctctcagtgagttgcatcgagattttttttttttttttttgagacagagtttggctcttgttgcccaggctggaatacaatggcatgatctcagctcaccccacaacctccgcctcccaggttcaaggaattctcctgccgcagcctcctgagtagctgggattgcaggcacttgccaccatgcccagctaattttgtatttttagtagagatggggtttctccgtgttggtcaggctggtctcgatctcccaacctcaggtgatccgcccacctcggcctcccaaagtgctgggattacagccgtgagccaccatgcctggctgtgcaccgtggtcttatcaggcagaagggttggagccacctcagctcccctgccaggtcagccagaaagccatccatctctcagacacactcgtgatccagtgctccagctattcagatcagacgggcacctcttttcatctgtaggaatgttggtgttctgagtagagaggaactgtgaatctgtctcttatgcaagcctaaacctagaggggctcctcctgtggggatgcagtcgccctgatatgttccagaaaggctgtctatagttgtacccatgctgagctcccatgggagaaaccccaactgtgcctgtggcagtggaagagaggggaaagacatccccttatccaagacccttcatgcacaccagggctgtctgatggttgggttagagctgtgggctttccgtgctgagcccagcactgaaactgtgtccctgctgaaagaaacttcccaccagcagaaagatctgattttcaagtcctgctgtccagattcttttgtcccatggggtgttcccttgatgtggtgcactccccattcccctaggataggagtcactgagcaccagactacagtgagtgttattgttcctctgggtctagccacccagtgaagctgccacacttcaggctggttcttgggaatgtctccaaggaatccggtaatgtcccctgtcctcgagactcccagcaatgggaagcagcaccagctctaatgggggtggcaggagagagacacaggctctgtgagattccttgctgatggacagccttagtaggttggcttccttgaatgctagttatagtagtaatgaactgatcatgtggacagactcaggacctcctggttagccagagtggtgcatgcagtggtgatagctgaggacatagagccattttctccttcctgggcccagtgttatcctaccaggagatgctgtcatggactgtgttggttggcctccacccagcaggtggagcaccagctgcagtagtagcagtgggatattcacttgccctatgttgcccagggtggctactcttgtttctcaggcaatgggcagagccacagagttcccaaaagtttccgtcctttgtattaaagccaccagggcgggtggcagggcaaagccaggtgtgggctgggtcaggcagttttgtgctctaactctccctgtgcagggcaagcagcagctcctgtgggtatcagggggtgggggtggttttcagacccatgtgctgataatccagagaggaatgtttctgcctctgctgcacagaagagtttgtgtagggagtggggagtggcaggtggcagtaagccccacgcggatcccacacacttggcgaggcagatcccctcccaccctgttccactggcagtggtgagctaagttccaggcagcctgtgctcagaacttgcaaatgcccccaagtcataagctttccctgcagagatagcaaccactgctctcaggccatgcccctccccatctatcccacctagccatgtgccagggtcctgcacacgtgtctgcagcttgcttttcattcaccccatgtgggtggagaagttcacctccacccacagttatctcatgaaacccagctgggggcttctttcaacctgcgaccacccacctgaactttttggctgaccactgcagggtgccctgtgaggaacaataaggaatggcttccctgggtccatactgggatctgggagtgcatgcagggttcttcccacagctcctacttatattccacgaacctccccaagtcatatcctgcactgaatagggttaaggccttaccccagagactggactttcaggctccctggtgtggtgggggcgtgtgtcctgcaaacagtctttccccatctcacaccctggggactcgcagcccttcacttgagtcacagtataggctgcagcccgtcacttccttcaaagggactgtggattccttcagatttcctgtctaattcctgaatcacttcttgaaaaaaaagttcacagtgtgaatctctacacagtgttttgtccttccaagtgggaggggtatgccagcaatgcctctaatccaacatgtttgctgtcctgctctttcatagtaggacagctaggactttccagaagtgcccccataaatctgcatgggccagagcttgacctccctctagctgcaagggaggctgggaaatatttgcccttcctgcctgtgggctgagaaacgttggcatggaagggagcttgaaatggccttggggtagccagtctacagtgcccggctggctccacccatagaaggttcctgaggacaaatctgtcttgtttactgctctattccaacagtcagaagagtgccgggtgcccactgattgcttcataaatatttatggaatggaagaatgatctttcttcctgctgcagatccctgcagtgctttatgccagtctgctggtgctttgaatatcaaacatgacagtcatgtgatggagaatgtttgaattttattgctattttcttggcaggtttatggagaagggctgttgctaatgctaaaagcattggacaccttatttttggtgagtatttggggaacagaaaggtcaaagcctagagatattttatgcaaggagattcacagtacttttcctgcatgtggcagaaaagaggcctgtgtataatggttctaacaaccacatttcctgacatttattctcatacactgaacattgattatgggcagccaggaagaccacagagtggatgagagtacagacacccttggaaggaatgttgctgtggtacatgtgagctttgtgacctctgaaaagttacctaacctctctgtgcctcagtttctgcctctgtgccatgtgggtgataataatagtagttatgaggattaaatgagttaattcatcaaaagcacataggacagtgtctggtagataaaggcactcagtaaacattagcaatctggctggatgcagtggctgacacccgtaatcgcaacacttgggaggctaaggcgggcggatcatttgaggccaggagttcaggtttctgatcctggccaacaggtgtgtggagctggtgcctgctacttccaggcctggctacaaaaggccttctgtggctctccagctctctcctctcatggaacagacaaggagaccttgtgccaagaggagaagctcttaaacccaggaggcggaggttgcagtgagctgagatcacaccattgcactccagcctgggcaacaagatgcaagcagcctggcccggcgcagtggctcatgcctgtaatcccagcactttgggaggcccaggcggacagatcacttgaggtcaggggttcgagtgcaagctgggtaacatggtgaaaatgcgtctctactaaaaatacaaaaattagccaagtatggtggtgcacgcctgtgatcccagctactcaggaggttgaggcacaagaatcgcttgaaaccaggaggcaaaggctgcagtgagctaagatcacaccactacagtccagtctgggcaacagagcaagactccatcacacacacacacacacacacacacacacacacacacacacacaaaattggcattcgttacctgttcatcatttaaccctttgaatgacctgaagaagtggatgctgttgtcccctccattttgctgagagccaccgggtcatggaaaggatgcgtgactcacctatgtaactggttggtgagtgcagacacagggatctataggggaatcgtatggtggttctgatccaaagcctgtctgcctgaatccacatcccagctccacctctcatgcgttagtgaccctagaaagctgcttaaattctctgtgaaaaaaattaaaaaataaagaaatgaggggccgggcgcagtggctcacacctgtaatctcagcactttgggaggctgaggtgggcagatcacctgaggtcaggagtttgagaccagcctgaccaacgtggagaaaccccatctctactaaaaatacaaaattagccgggcgtggtggtacatgcctgtaatcccagctacacgggaagctgaggcaggagaatcgcttgaacccaggaggtggaggttgcagtgagctgagatcacaccattgcactccagcctgggcaacaagagtgaaacacagtctcaaaaaaaaaaaaagaaaaaagaaaaagaaaaagaaaaaaaagaaatgaaacaaacaaaaaaaaaaaaaaaaagaaaagaaaatcaacaacaacaacaaaattctctgtgacccaatttctcctttgtaaaatggatacaatagtgcatagccccaatcttgtatatttatatcaaataaatgtaaatatacatcaaatatacaagattgggactatgtactatttgatgtggggtttaaatgacctcatgtatgtaaagtacttagagcaaagcttgacacatgggagtgtcctcttaaatgtcaatattatttttattatgtcttgtattgttagaaaaagcaagccagggccaggcgcggtggctcacgcctgtaatcccagcactttgtgggggccgaggcgggtggatcaccaggtcaggagatcgagaccatcctggctaacatggtgaaactccgtctctactaaaaaatacaaaaaattagccgggcgtagtggcgggcgcctgtagtcccagctactcgggaggctgaggcaggagaatggcgtgaacctgggaggcagagtttgcggtgagccaagatcgagccactgcactccagcctgggcgacagagcgagactccgtctcaaaaaaaaaaaaaaaagaaagaaagaaaaagcaagccgggcacagtggctcacgcctgtaatcccagcactttgggaggttgaggtgggtggatcacttgaggtcaggagtccgagaccagcccagccaacatggtgaaacctcgtttctactaaaaatataaaaattaactgggcatggtggcgggcgcctgtaaccccagctactcgggaggctgaagcaggggaattgctcgaacccgggaggcaggggttgcagtgagccgagatcgcaccactatactccaggctgggcaacagatcgagactgtgtctcaaaaaaaaaaaaaaaaaaaaagaaagaaagaaagaaaaagaaaaaaaagcagacaaaatttatttattgacaattcaaaaatttgaaaaagatgaagcagaagcttgacctaaccgacgtgtatcaggacttagctttctatcgcattttcagcacatgtggaaaaattgaattttgatttggtctcaagtaaaaagttataacatgtacaatattttaattataaggatcaacactgctactattaggtaataatatttttaaatattaagatttttttgtttttttttgaatttttacttcaatagcttttggggtacaagtggtttctgttacacgatgaattatgtagtagtaaattctgagactgtagtccacccatcagtgtatgttttagagtatgttgcattcaatatgtagttttttggttttgttttttgtgacagtctcactctgttgcccaggctggagtgcagtagcaagatctcgtctcactgcaacctctgtatcctgggttcaagtgcttctcctgcctcagcctccctagtaggtggaattacaggcacgtaccaccatgcccggctaatttttatatttttagtagagatgaggttttgccatgttggtcaggctggtctcgaacttctgagctcaagcaatctgcccgcctcagcctcccaaagtgctgggattacaggcatgagccaccacacctggccccaatgtgtagtgtttttttgtttttgttcttgttttttgagacggaatttcactcttgttgcccaggctggagtgcaatggagcgatctctgctcaccgcaacctccacctcctgggttcaagccattctcctgcctcaacctcccgagtagctgggattacaggcatgcaccaccatgcctggctaattttgtatttttttagtacagacagggtttctccatgttgctcagactggtctcgaactcctgaccgaaggtgatccacctgcctcggcctcccaaagtgccgggattacaggcatgacccaccactcctggccccaatgtgtagttttttatccccacctccctaccctcctctttctgaatctctgaagtccgttatgccactctgtatgcctttgcgtacccatagcttagctcccacttataagtgagaacatatggtttttggttttacattcctgagttactttacttagaatgatggcctccatccaagtttctgcaaaagacattattttattcttttttatggctgagtcatattccatggtgtttatataccacatattctgtatccactcatttgtcaatgggcacttaggtgggttcatatcttttttttttttttgagacagtctcactctgtcacccaagctggagtgcagtggcgcgatctcggctcaccgcaagctccgcctcccaggttcacgccattctcctggcccagcctcctgagtagctgggactacaggcacccaccactgcgcccagctaattttttttttttttttttttttgtatttttagtagagaccggtgttagccaggatagtctcgatctcctgacctcatgatccacccgcctcagcctcccaaagtgctgggattacaggcatgagccaccatgctcggctggttccatatctttcaattgtgaattgtgctgctataaacatacatgtgcatgtgtcttttttttttttttttgaggcagagtctcgctctgttgcccaggctggaatgcagtggtgcaatctcactgcaacctccaactcgtgggttcaagtgattctcctgcctcagcctcccaagtagctgggactacagatgtgcaccaccgcatccagctaatttttgtatttttagtagagatggggtttcaccatgttggccaggctggtcttgaacgcctgacctcgagtgatctcccctcctcagcctcccaaagtgttgggattacaggcgtgagccactgcacccagcccacaagtgtctttttcatataatggctgcctttcctttgggtagatacccagtagtgggattgctggatcgaacggtagatctacttttagttctctgaggactctccatactgttttccatagaggttgtactaatttacattcccaccagcagtgtgtgagtgttccatttgcaccgcatccacaccaacgtctatggttttttttgaatttttatcaatggccattcttgtgggagtaagatggtatctcattgtggctttcatttgcgtttctttaatgattagtgatgctgaccatttttttcatatgtttcttggccactggaatatcttcttttgagaaatgtctattcatatcattgggatgcttttcggtgggattattcgttttcttcttgctgatttctttgagttccttataggttctgtataatcgtcttttgtggatgcctagtttgcaaatatttgctcgcattcagtgggttgtgtgtttactctgataattacttcctttgctgtacagaagctttttaatttactcaggtcccatatatttgtttatttttgagacggagtctcactccatcacccaggcttcagtgcagcagcacgatctcggctcactgcaatctccgcctcccagactcaagcaattctcctgcctcagcctcctgagtagctgggattacaggcatccaacaccatacctggccaatttttgtatttttaatagagatggggtttcgtcatgttggtctggaactcctgacctgaagatccgcccagctgggcctcccagagtgccaggattacaggcgtgagccatcgttcccatatatccatatgtttatttttgtttttgttgcatttgcttttgggctcttggtcatgaactcgttgcctaagccaacatctagaagagtttttttgatgttatcttctagaatttttatggtttctggtcttatatttaagtctttgatgcaaattcacattgaatttgtgagttgatttttgtataaggtgagaaataaggatcgagtttcattctcctacatgtggcttgccagttatcccagcaccatttgttgaataaggtgtcctttcccccactttatgtttttgtttgctttgtcgaagatcacttggctataagtatttggctttatttctgggctctctattctgttccattgttctacatgcctaattttataccagtaccgtgctgttttggtaactataggcttgtagtataatttgattgggtaatgtgatgcctccagatttgttctttttgcttagtctttgctttggctatgagggctcttttttggttcatatggattttgggattgtggctgggcatggtagctcacgtctgtaatcccagcactttgggaggccaaggcgggtggatcacctgaggtcaggagtttgagaccagcctggccaacatggcgaaaccccatctctactacaaatacaaaaattagccaggcatggtgcatgcgcctgtaatcccagctacttgggaggctgagacaggagaatcgcttgaacttgggaagcagaggttgcagtgagccaaaattggccattgcactccagcctgggcaacagagcgagactaagtctcaaaaaaaaaaaaaaaaaggattttaggattttttgttctgtgaaaaatgatagtattttgatgggaattacactggacttgtagattgcttttggcagtatggtcattttcacaatattgattctacccatccatgagcatgggatgtgtttccatttgtttgtgtcatctatgatttctttcagcagtgttttgtagttttccttgtagcagtctttcacctccttggttaggtatattcctgagtattttattttatttttttgcagctgttgtaaaaggggttgagttcttgatttgaatctcagcttggtcattgttggtgtatagcagtgctactgtttgtgtacattgattttgtatcctgaaactctactgaattcattcatcagacctaggagctttttggatgagtctttagggttttctaggtgtacaatcatatcatcagtgaacactaacagtttgacttcctctttactggtttggatacccttcatttctttctcttgtctgatggctgtggctaggacttccagtactatgttgaatacaagtgataagagtgggcattcttgtcttattgcagttctcagggggaatgctttaaacttttccctgttcagtgtaatgttggctgtgggtttgtcatagatggcttttattacattgaagtatgtctcttgtataccgattttgttgagggctttaatcataaagggatgtgggattttgtgaaatgcttctgcatctcctatgatttttgtttttaattctgtttctgtgatatatcacatttgttgacttgcatatgttaagccatccctgcattcctagtatgaaacccacttgatcacatcatggcaaatttcaagctaccaacatgaggtcaccgagcacagagttggaagacgggtacaaaattagctctccagaacccgtatcaacagactccaacccatggctgccatttctattaaagagacgtcgctgcaggtaatctgtattttctataactagtgactttacagttaaacattccccctgcctctgctcttttgcagcccgattactgaggctgcaagaaagttcacaaggggaacatcctcccccagaaggtaagcatcctactttgccatgaatccctaatgatagtgtggactgcacactggcttgaagccagccattgtcctaaaaactttacgtgtctgattcatgtggtgctcctttgggaatggagaggagcatggactctcccaggtgcctgaggccacgcagccaggaggggcaggatcggagttcaaactgacactctgtgaaaaatgatagtattttgataggaattacactggacttgtagattgcttttggcagtatggtcattttcacaatattgattctacccatccatgagcatgggatgtgtttccatttgtttgtgtcatctatgatttctttcagcagtgttttgtagttttccttgtagcagtctttcacctccttggttaggtatattcctgagtattttattttatttttttgcagctgttgtaaaaggggttgagttcttgatttgaatctcagcttggtcattgttggtgtatagcagtgctactgatttgtgtacattgattttgtatcctgaaactctactgaattcattcattagacctaggagctttttggatgagtctaaccataggatccatgtacatagtcgtcagatataccctaggtatgcctaggatccaagtgtcagaggcagaaaatgggaacagcctgaggcaattagcaaattgagaggaaaaatacttcccaaaactacataggttgggagtcatgaaggaatcagacttgacccatggtgggagtacggagaacaagaacaaagtatcagatgaattctgtatggagaagttagattatattatggaggagactatatttgttcaggagaggctatgctgcgcaaagaaaccacaaattgctatagcttaagacacaaagggtttatattttgcttacccaaaaagcgatatgggttgagtgttcctccagggcaacttggctccatgtggggacttaggcatccaagctgtttgcgtcttttttttcctttccttttcttttttcttttttttttttggagacagagtctagccgtgtcacccaggctagagtgcagtggcataatctcagctcactgcaacctctgccttccaggttcaagctattctcctgccccagactcctgaatagctgggattacaggcaactgccaccacacctggctaatttttgtatttttagtagagacgagttttcactacattacccaggctactctcgaactcctgacctcaagtgatctgcctgcctgggcctcccaaagtgctgggattacaggtgtgagccaccgcgctgggccaagctgcttgcatctcgttgcttctcctcttggcacaaggtctccttgtctgttccatgagaggagagagctggagtgccacagaaggccttttgtagccaggcctggaagtattgggcaccagctccacacacctcctgttggccaggatcagtcacatggccccaacctaactacagcagaggctgacaaagatggtcttccttccagttgtggaagatgcaagtgtggctttttcacaggtcaacagtcaggtacagagtgaaggtaggtcctgagcacagcccttcatccacttcatgcctccctccctgttttagttgtgaaggctgccagaacaaagtgccatacataggctggctggcttagcaacaacagagattaatttctcagttctggaggctggaagcccaagatcagagtaccagtagggttggattctggggaaccctcttctgggttgcagagagccaacttcttgccacatggcgggctttaatgttgttttttgacatcagcattcaccatatgctggttatagacaagtctggaaggagaatctatctccaacctgcaaatggctaactaatgttgtgggatggtaggctggtgattgtaccactgcactccagcctggtgacagagcgacaacctgtctcaacaacaacaacaacaaaaaagaaatggcaaccccaaggtgatggtattaagagatggggcctttgggaggtgttgagaccatgagggtggagccctctagatttggattaatcccttataaaagaagcctcagagagctcactccaaggaatgcggtgaaggttgaagggtagaatttatgcaaaatgccaagatgagcctggcaggtgacgttctcagcaaacgtgagcagagctattatcagtgtgtgtgtgtgagagagagagagttgaacatcatctaattcatgagtgtggataaaaataagaggggatgccaggcatgatagctcaatgcctgtaatcccagcactttgggaggctgaggggggtggatcacttgaggtcaggagttcgagaccagcctggccaacatggtaaaaccccatcagtactaaaaatacaaaaattagccgggcctggtggtggtgcgtgcctgtagtcccagatactccagaggctgagccaggggaatttcttgaaactgggaggcagaggttgcagtgagctgagattgccccattgcactccagcctgggcaacagagcaatactctgtctcaaataaataaataaataaataaataaataaataaataaataaataaatgggagactttgcctccaaccctgaagaaaataagcgtgcaaaagatgagtagaggtggaggcagagatgaaggagctagaaaaaagaggccagaaagtcagagagagtgaggtaacatgggggtcagcagaaggcaaggggagagagggtcacctggagaaggaggtcacctcaggaggaaccgcagggcattgcagaagatgaggcagagcagggtctgtgatgttcttggtagggtacttggacagtgtctgagaccacctggatttcttgacgtagatgaaggcggtgagcctgaacacacctggctgactgagatgctcgagaattggaccaggacctccctggaaaagcaggagcagccccatgaggaccccgaaaggaaaggtaccatgtgtagtgtgataagtgtcatcaacagtaagtgccaccaaccttctcccccctcttgctcttccccacccctgtgggccagtcctgcaggggacatgaccagatgtcccactggtacagtttggatatttgttcccttccacatctcatgttggaatgtaatcccccaatgtaaattagttcaaccattgtaggagacagtgtggaattcctcaaggatctagatccagaaatactatttggcccagcaatcccattactgggtatatgcccaaaggaatgtaaatcattctgttagaaagatacaggcacatgtatgttcactgcagcactattcacaatatcaaagacatggaatcaacccaaatgcccatcagtgatagactggataaagaaaatgtggtacatatacaccatggaatactatgcagccagaaaaaggaacaagatcatgtcctctgcagggatatgggtggagctggaagtcattatcctcagcaaactattgcaggaacagaaaaccaaacaccacatgttctcacttataagtgggagctgaatgatgagaacacatggacgcagggaggggaacaacacacactggggcctgttgggggcgggtggggagaagaagagcaccaggaaaattagctaatgcatgtggggcttaatacctatgtgatgggttgataggtgcagcaaaccgccatggcacatgtttacctgtgtaacaaatctacacgtcctgcacatgtgtcccggaacttaaaattaaattaaattaaattaaattaaaagaaaaagaaatgtaatccccagtgttggaggtggggcctggtgggaggtgattggatcatgggggcggatccctcatgaatggcttagcgtcatcctcttggtgattagtaagtgcttgctctgagttcatgtgagatacggttgtttagaagtgtgtggcaccttccccctcgctctcttgctcctgctctcggcaagtgatgtgcctgctccccattcactttccatcatgattggaagcttcctgaggccccaccagaagcagatgccagcaccacgcttcctgtacagcatccagaactgtgagacaattaaacctcttttctttataaattatccaacctcaggtacttctttatagtaatgcaagaatggactgatacgcccaccctctatccacccaaccggccatccatccatctaggatgtcttgagtcattagcatgaaataataactctcctactagcaggctgggggtaggggtgacaaaggggaaatgtcagaccaagtgcctgcctggaggactcatggtctagaggacgagatggagaatagacaggtaagccaaccacaggcaagtccatccccgactgggctaatttctatggagagggctgggtgcagtggctcacacctgtaatcccagcactttgggaggctgaggcaggaagatcacttgagcccaggagttcaaaaccagcttgggcaacatagcaagaccccatctctacaaaattttttgtaaaaaattagctggacatggtagtgcgttcccatggtcccagctactcaggaggctgaggcaggaggatcacttgagcccaagaggtcgaggctgtagtgaactatgattgtgccactgcattccagcctgggtgacagagcaagaccctgtctcgaaaaaataataaataagtaaattatatggagagacaaggagaggcgagagcaggtatccggtgaaaaattctgagagtgaagtagcgtggatgagggacaatgaagacagttggtcgctgaagccactgccttcctgagatgacccaggtacagccagtctcacccccagacatccaacctctcacctctgtgatgacccggtgtccaggcacagacacacccagagtcctcctgaccagctcatcagcagctcaccaaggaaaggaaatcaaggtgtactctcttcagactctagatttcccttcctcctccttttattcatgttacataaattcctgtttttatctctgttggatgaaatcagtctattctctggtttcctttgtctacaatttaaagagggagccgactattaacttgatgtctctgagctattgttggccaagctccccttagatgggattaatgaagaagcctccttttccaaggtgatagctcagaagcaacttgaagaatgagtgacaatgagcctaccaagtggaaatgtggggaaagtcagccagagttcatctactgacttcagtctggcagatgagaggcttgggtttacccctccggtgggtaatggagagagatggaatgtgccacacgaagcctcactatgactttctataatgcctggctcctgtgctgaaatgagaacatgcatcctagccggccatggtggtgcgtgcacctgtagtcccagctattcggggaggctgaggtgggaggattccttaagcccaggagttggaggctgcagtgagctatgaatgcaccactgcactcagagtgagacccccatcccttaaaaagttttcttttaaagaacgtacttttttttgttttgttttttgtttttgtttgtttgtttgagatggagtctcgctctgtcacccaagctggagtgcggtggtgcaatcttggctcactgcaacctctgcctcccgggttcaagcgattctcctgcctcagcctcccgagtagctgggaccacaggcatgcaccaccacacccggctaatttttgtaattttagtagagacagggtttcatcatattggccaggctggtcttgaactcctgaccttgtgatccgcccacctcaggctcccaaagtgctgggattacagatgtgagccactgtgcccggccaattcttaacttactataagatatacttgagcccaggtattcaagactagcctggaaaacactgtgagacctcatcttttttaaacaaaattaataaatagataaaacatttaaaaaagccaggtgtgatggctcacgcctgtagtcccagctactcaggaggctgaggcgggagggtcgcttgaggccaggagttcaagaccagcaagcctgggcaacgtagtgagacctcctctctaaaataaataaataaaaatataagatagaatggccgggtgtggtggctcatggctttaatcccagcactttgagaggccaaggtgggcggatcgcttgaggtcaggagcttgagaccagcctggccaacatggcaaactctgtctctactaaaaatgcaaaaatacaaaattcgccgggcgtggtggcacatgcctgtaatcctagctacttgggaggctgaggcaggagaatcgcttgaacccgggaggcggaggttgcagtgagctgagatcacgccattgcactccagcctgggcaacaagagtgaaactctgtctcaaaaaaaaagaaagtatggagtcctcaggccacatttagttttctttaacatgttaaatattaaagggctatcaaagcaatgtaggtgtgatttgcttttctgctgctaaactcttgtagaagttaatatttattaagtgcctactatttgctggatgtgttaggtttcttcagagaaacagagccaataagatatctatctatctatatctacctatctatgtctctgtctgcccaaatctatgcatctatatctatgtatttatagctatctatctctatctatctaactagagatatttattttaacaaattggctcatgggattgtgaagatgacaagtccaaaatccatggggcaggccaacaggccggaaaccgagacaggattttttaaaatttaatttaatttaaagtttgaggatacatgtgcaggacatgcaggtttgttacccaggtaaacgtatgccatggtggtttgctgcacttatcaacccatcacctagatattaagccccacatgcattagctgtttaccctgatgttttccctcccaccgccccctcaacaggccccagtgtgtgttgttcccctccctgtgtccatatattctcatcattcagctgccacttataagtgagaacatgtggtgtttggttttctgttcctgcattagtttgctgaggataatggcttccagctccatccctgtccctgcaaaggacatgatcttgttcctttttctggctgcatagtattccatggtgtatatgtgccacattttccttatccagtctaccattgatgggtatatttggttgattccatgtctttgctattgtgaatagtgctgcaatgagcatacgcatgcatgaggcagaatttgacgctccagtctggaggtagaatttcttcttctctagaaactgttttgccctcaaagccttcaactgagtagatgagacccacccacattactgagaataatcttcttgaagtcaactgattttagctgtcaaccacatctacaaaataccttcacagccacatctaggctagtgtttgattaaataactggttactgtggcccagcctagttgacatgttaaaccatcctcccaacatcctaagtgctataggcaggctcttacttattcttcataaatctataagggataggtgttactctcttcctggttttacagatgagaacagagatgttaagtaacttgctcaggggcccggtgcagtggctcatgtttgtaatcctagcactttgggaggccgaggtgggaggatcacctgaggtcaggagttcgagaccagcctgaccaacatagcgaaaccccgtctctactacaaatacaaaaaaatatttagccgggcgtagtggtgggtgcctgtggtcctagctatttgggaggctgaggcaggagaatcacttgagcgcaggaggcggaggttgcagtgagccgagattgcaccactgcactacagcctgggtgacagagcaagactgtctcaagaaaaaataaataaataaaagtaacttgctcagggtcacacagctaatgagtgatgaagtcaaattcaaatcagcatctagctcaagcacccacctccctactagctttgctctcttgccactctgcccctgctgttcagagaaaggattggagctgaaaaaccaggaagagggaaatcagagggggaggcagtgttgcatcctggatggaaaagatgctgcataaggtactggcagatgagattgggaggagcagagacactgaagaggaggtggaattggcaggtcttggtgatagtccagggtgagggtgaggaagaggcaggcgtctgggataatgacctggtttatccctgactgacttggcagcctcttgggctggggaagggagcacgggaaagtgtgctgggcattttggaacagctcctggaacattctgcgtcgttctcccccatgaacctaaagagaacaagctcatttccccagatacacaggtgatcatacagtcattaaatcgccatcttttccttgccaactcccccaaccccaatggctcaaagtcatctcacctgtggctcaatgatagatgctggatctgacggccaggacccccaggcccctgtatgccaacctttcccagctcaccagatttgtcagctctgctgccctaacaaaagttgaagtggggtggcttcaactataggcttttatttcctcaccgtttttttttttttttttgagatggggtttcaccatgttgcccaggctggtctcgaacccctgacctcaagtgacccacccacctgggcctcccagagtgctggaattacagatgtgagtcactgtgcccagccttattttcttacaattctgcaggcaggaagtccaagatcaaggtgccagtggggtcagtttctcctgaggcctctctccatggcttgcagagggatggccgccttctcaccgcatcctctcagcccagcctttcctcagtgcacacgcattcttggtattcttggtgtcttcctttttttcttttttttttttttttagatacaaggtctcccttgtatctaaatgatctgagtgatacaagtgaggctggaatgcccaggctggagtgcagtggcacaatcatacatagttcacttcagccttgaactactgggttcaagtgatcctcctgcctcagccttctgaatagctgggaccacaggcatgcattaatatgcccagctaatttgtttattttattttatttttgtaaagatgcggtctcgctctcttgcccaagctggtctcaaacttctgggctcaagcaatcctcccacctcggcttccctaagtcctgggattactctggtgcctggcactctttctcttctcataaagaccccagtcctattgaattaggatcccactctcatgacctcagttatcctgaatgacccccccacttttttttttttttttttttttgagatggagtctcgctccgtcatcaggctggagttcagtggcacgatctcggctcacttcagcctctgcctcccaggttcaagcgattctcctgcctcagcctccccagtagctgggactacaggcatgcgccaccaccacgcccagctaatttttgtatttttagtagagacagggtttcaccatgttggccaggatggtctcgatctcttgatatggtgatccttctgcctcggcctcccaaagtgctgggatgactggcgtgagccaacgcgccggccctgaatgacctctttaaaagtcctgtctccagatacaaccccatgggggatgagggcttccacatatgactttggtgggggcagaaaccactcagtctcctgaactcaccttggctgtctcggcttctttccctaggctcactcagtaacttgatggattttgtgaagaaaacaggcatttgcgcttcaaagtgggaatgggggaccactcacaacttcctgtacaaacacggtgagaagaccctcttcccaccgccctggtctgtccttgcgtgtgaatgggctggagtaggggaagggggtgggcctgaaacaatcccaggctggtccttccccagagctttggaggggggtggtgtcaaagtgcccagggatctgattaggggaactttcgctcagtggtgtggtccatactgaaaaatgtgtggcctcgctgcgagtcccagtcatcgtgaaaagcctcactgatggctttctctggttttgcaaaaatgcaaaaaaccctaatttcttgtcagctagtcctaggacctggtcttcaaaaacacttgtatgggctgggcgcagtggctcatgcctgtaatcccagcactttgggaggctgaggcgggcggatcacttgaggtcaggagttcaagactagcttggccaacatggtaaaaccctgtccctactaaaaatacaaaaattagccggacagggtggcgggtgcctgtagtcccagctactcaggaggctgaggcaggagaatcgtttgaacccaggaggcagaggttgcagtgagccgcgatcatcccactgcactccagcctggcaacagagcgagacaccatctaaaaaaaaaaaaaacaacacacatttgtatgggttttcccttcaggggactgaccctctcattcaggtggaattgatgtcagactcctgggaactcacactgaggccatttaatagtctccataagctccaatgttcatagctggtggagatcctctcctatgaccatgccaatccctgcaccactcatgtatgtgtatgtgtgtgtgtgtgtgtgtgtgtgtgtgtgtcttgctctgttgcccaggtgggaatgcagtggtgcaatcatggctcactgcagcctcagcctccccagctcaagcaatcctcccatttcagcctcccgaatagctgggaacacaggcacacagcaccatgcctggctaatttttctttttctttttcatagagatggggtctcactatgttgcccagactgatcttgaacccctgggctcaagcgatcctcccacctcagcctcccaaagtgctgggattacaggtgtgagccaccccacacctggccttccccactcttttgttacaagactatcgtgaacatctttatgtttgtggtcctgttgcccttgtgcaaatcgagaaaaggtgcatcttccaggggggtgaattccaaaatgtgcccccctggccagggctgtgtgtggcctgggaagggaaccctggctggatgtcagtcctgctcacctctcctggggtgcttcctacaaggcacacaggacttcagctgtgtctgcgcaccatgccatgcagctgccgggtcttatggcctcggaatacaccatcaagcatcaagtcactggatcatggcgatgagtgttttagcatcaaatttctccctgaaggggttggatgaagtcgctttctcagtagcaatatatgagagtgtaaaccaaaaataaaattctaagccccccaccacccaaccatctgaatagacctctcctgtcagccagggcactccaaagttaacctgaaaaatgggttcagtccctgatgggaagtgggggtcggacatgcctccttataccctcctcccttttggaattcaggaaaagctgactagcagtcatgtcaacacaaatttttttttttttttttgagatggagttttgctctttttgcccaggctggagtgcaatggcgcgatctcagctcaccgcaacctcggcctcctgggtttaagcgattctcctgcctcccgagtagctgggattacaggcatgcgccaccacgcccggctaattttgtatttttagtagagacagggtttctccatgttggtcaggctggtctcaaactcctgacctcgtgatctacccaccttggcctcccaaagtgttgggattacaggcgtgagccacctcaacacagattttaagtctgataagaaacatttacattctgttctctctgaagcctgctacctggaggcatcatatacgtgataaaactttggtctccacaaccccttgtcataacccagacattcctttctattgctaataactctttaaaccaatagccaatcagatatttttattttattttccatatatttatttattaattatttttatttatttatttatttattttgcgatggagtctcgctctgtcacccaggctgcagtacagtggtacaatcttggctcactgcaaccaccacctcagcctcctgagtagctgggattacaggcacatgtcaccatgctcaactgatttttgtatttttagtagagacagggtttcaccacattggctaggctggtctcaaactcctaacctcaaatgatctgcccaccttggcctcccaaagtgctgggattataggtgcacaggtgtgagccactgtgcccaaccgtcaatcagaaaactttaaatctacctataacctggaagcccccccccgacccctcctcacccctcacctctacccctccatgacttcaagtcgtctcacctttctggaccgaaccaaggtatatcttagatatatttgattgatgtctcatatctccctaaaatgtataaacctaggctgtgccccaaccacctaggccacatgttctcaggatctcctgaggactgtgtcacgggccattggtcactcacatttggctcagaataaacctcttcaaatattttccagagtttgactcttttcatcagcaagaggaaccattcccagaggtactgtcttagtctgctcaggctgctgtgacaaaatcccacagactgggtgacttaaacgacagacatttattttctcacagttctcaaggctggaagtccaaaatcaagttgtctgtggggtgagttctttctgaggactctctctgcgatttgcagacagccaccttctcatatcctcgtatggtctttgctccatgtgtgtctctgttctaatcccctcttcttagaagagcactagtcattctattggaatgtttcaaagttttatcatgcagatgtgtgagaggcattggaaccagagtgactctatcttgaatgagggctaggaaaaatgaggctcagccttgctgggctgtatccccaggaagttaggcattcctagcctctagatggttatggttaagggaacagattcataatgtttactaaacagactcagacccaggaatgtcctgatatcctgatatcttgagaacagacgcattcctaattttgctttaaaaataataatataagttcttgtaaaatatagtaattatggtttttggtttttttttttttttgagacagagttttgctctttgttgcccaggctagagtgcagtggcacaatctcagattactgcaacctccgcctcccgggttcaagcgattctcctgcctcagcctcccgagtagctgagattacaggcaggtgccaccacgcctggctaatttttgtgtttttagtagagacaggatttcaccatgttggtcaggctggtcttgaactcctgacctcaggtgatccacccaccttggcctcccaaagtgctgggattacaggcgtgagccaccgtgcccggccaaaatagagtaattatgaaaattaatcctttatcacaaatacttgtagcagagcacatctccccatgtttttttgttgttgttgttttcctatatataacaaaaggaggaggtggttgcatttctcctcttactttccgtaacaccctactctgtggagtaacgattctttcacccctttgctttcttaacagacttgctttcgctttgcactgtggactcaccctgaattctttcttgtatgagatccaagaaccctttcttggggtctggatcgggacccctttccagtaactgatgaaggctccaggtagcaagcttcagagagaatagattgtaaatgattcttgtcagacttaagctctgggtggatattaaatgctggtcagctttccttaaatccccaaagggaggagggcatcgtgaggcatgtctgaccctcccttcctgtcacggccagaactaggttttcaggttaactctggggtgccctggccaagaggaagggttcattcagatggttggggtggtgttgtgggggggtaggagttggggagggtgttggcggggggacgggagggatgggggtgggggggaggggcttatcattttatttttggtttacgctgtgaaaggaaaataaatctcgggaccccaaaatcaccaagttaaagggaaaagtcaagctgggaactgcccagggcaaacctgcctcccattctattcaaagtcaccctctgctcactgagataaatgcgtatctgattgcctccagttggaaaggctaatggaaactctaaagaatgttggccggcccgtggctcacgcctgtaatcccagcactttgggaggcagaagcgggtagatcacgaggtcaggagttcaagaccagcctggccaagatggggaaaccctgtctctactagaaatacaaaaattagctcagcatggtggcgggtgcctgtaatcccagctacttgggaggctgaggcagagaatcacttgaagccaggaggtggaggttgcagtgagtggagattgcgccactgcactcccgcctgggcaacagaacgagactccttctcaaaaaaaaagaatgcaaccattcacttcttatctacctgtgacctggaagccccctccctgctttgagttgtcccacctttccagaccgaaccagtgttcatcttacatatattgacatctcaggtcttcctaaaatgtctaaaccaagctgtgccccaaccgccttgggcacatgtcatcatgacctcctgaggctgtgtcacggttgtgcatccttaaccttggcaaaataaactttctacactgaccgagacctgtctcagaaacattgggttaacaacgctctcacatattgctgctgagaaggcagcttcatttggaacttcacgccaaaaaccccattttaccttaattacctctttaaagaccctgtctccaaatacagtcacattctgaggtactggaggtaagagcttcaacatgtgtttgtctgtttatttgtttatttatttgagatagagtctcgctctgtcacccaggctggagtgcagtggcgcgatctcagctcactgcaacctccggctcatgggttcaagtgatcctcctgcctcagcctcccaagtagctgtgattacaggcacccgccaccacgcctggctaattttggtatttttagtagagacagggtttcactgtgttggccaggctgatcttgaactcctgacctcaagtgatccgcctgcctcagcccccaaagtgctgggatttcaggcgtgaggcaccgcacccagccagggcttcaacatatgaatctgggaagagagagaagtcagctcctagttggcaacctcacaactgctgtctacactgacaacgatcattttcccatccccctctctgccttccatttccaagtcttgctttcagtccccagaagcagctgatcctctttcttcctgggcaccacaggtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgaggtaatcgagaagggctttggggccggtcctgggtgggaggtgggctgcggcgaagctgactttgcggaggaactgaggacgcgggctgggaagcgggcaatggggaggtgctggctgggaagtccagagagccaaatcaactcacccatcgctcccgaagcacccgcagtcggccacatccaacgaacttctgatccaaagccatcccagaccttcccgggcccctcttcctggcagatgactctccccgcttctgcgtcctgcctgcccattcataccagtttgaactgcaacagcctagctcctcacctgtgcacctccttccccaggtgtgcacgtctccagccccgagcgcgtgtcttcctgctcatctgggtttcctgggcaaatagtggccctcaataaatgtttgctgagtgagaacatatgcaagtatatttgtcttagtacatattgcaccttcccagtggccactaggatccgttctccctgccttcatatcccagctctgccacttaccagctgtgtggcctgatccaatgtgcgtaacttctgtgcatgtcggtttcctcagctgtaaaattgggctaacgatggctccaccaggagttgttctgtggattaaattaatacttgttaatacatgtgaagtgcttagcacagtatctgccacttactgtggggtttataaacattttcctcccctcccctcccctcccctcatggcctcctttcgagactgggtcttatggtgtgatcatagctcactgcagcctcaacctcctgggctcaagcgatcctcccacctcaccctcccaagtagctgggactgcaggcacacaccaccacaccaggctagttttctaaattgttttagagacagggtcttgctatgttgcccaggctggtcttgaactcctggcctcaagcgattctcccaccacccaaggctaggattacaggcacaagccgccctgcccagctattttattaaaaaatatatacacctacataatatataactatatctattacatgatacataccaatacatagtagtatatataaaataatcatggtaaaacatatcatctattatatttatgtgtaatgtaatatatatttatattcacacacttctatcagtttacattctgtaatatgaattaggaacatccatcctcctccccataccatgatccagaaccaacttgtcaccatctttctagacccttggcccaggaatacccaggctttctggtcttaggatttctgctgaaataaatatcccaagacaatatgataaaggtggaatgagatatcaaggtcttgggagtccttttctgccaaatctctgctgcatgaccccgagcgataggcttaacctctgaacctcagttttctcatcctgaaaatgggaatcacatcatctggctcgcaggagatctgcagagtctctgcaccatgcctggtccatagctggtgttctggattaacaacaatgcttatctggtgatgatgagaatagcaagagtaataggaagaaaaccggcagcatttgttaaacttcaatcaaagacgacttcagagacctaagctgtccactacagtggttgccggccacatgtggcacttgagcacttgaaatgtgcctggcccaagttgaagtgtgctatgaagataaaatacacctcggattttaatgaccgagtatggaaaacgcatgtcaaagaccttattcgtaattggtatattgacatactaggcagggctctccagagggacagaaccaataggatctatgtctagatgaaagggagtttcaggatcacaaggtggagtcctacaataggccgtctgcgagctgaggaagaaacaaaccaatagtggctcagtccgagtccgaaagcctcaaaagtagggaagcccagccaggcctggtggctcacgcctgtaatctcagcattttgggaggccgaggcgggtggatcagaagatcaggagttcgagaccagcctggtcaacctggtgaaatcccgtctctactaaaaatacaaaaaaattagccgggcgtggtggcaggtgcctgtaatcccagctactcgggaggctgaggcaggagaatcacttgaacccaggaggcggaggttgcagtgaaccaagattgcgccattgcactccagcctggtgaacaagagcaaaattccatctcaaaaaaaaaaaaaaaaaaaaagtagggaagcccacagtgcagccttcagtctgtagccaaaggccgtagagcccctggcgagccactggtgtaagtctaagggtccaaaggccaaaaaacctggagtgtgatgttcaagggcaggaagtatccagcacaggagaaagatgaaagccagaggacccagcaagccagcttctcccaccttcttctgtctgctttgttctagtcacactggcagccaattggagggtgtccgcccacactgtgggtgagtcttcctctcctagtccactgactcaaatgttcatctcctctgacagcaccctcagagacacatccggaaacaataccagctttccaggcacccttcaatcaagtcgacacctaatattcaccatcacaattgattacacatcgaggcaatcacacttttgacatattgcatgagatgaaactttttcctacaaattgggtggttacaaagtaataaacagaattttttttttttttttttgagacagagtctcgctctatcacataggctggagtgcagtggcacaatctcggctcactgcaacctccacctcctgggttcaagcaattctcctgcctcagcctcccgagtagctgagattacaggcatgcgccaccacacccagctaatttttgtatttttagtagagacggggtttcaccatgttggccaggctggtcttgaactcctgaccttgtgatctgcccgcctcggcctcccaaagtgcagggattacaggcgtgagccaccacgcccggccaataaacagaaatttaagcaagacatatctgtaacaatttaacagaacctgattgtctaagttttttttcatttttctcaaattcatctttaattctttccatgatggggcttataaggaaactaaccaacatgtagctactatagttgaatgtcaaatcttttttttttttttgagatggagtcttctgtgtcgcccaggctggtgtgctgtggtgcgatcttggctcactgcaacctccgcctcccgggttcaagtgattctcttgcctcagcctcctgagtagctgggattacaggcgcccgccaccatgcccggctaatttctgtatttttagtagagacggggttttgccattttggccaggctggtcttgaactcctgacctcaggtgatccgcccacctcagccttccaaagtgctgggattataggcatgagccactgtgcccagctgaatgtcaaatctttagaaggtacttatgacagtaaattcctctgtaatacaggtatgaagcaccttcatgatatttctgttttatgtgtagaaaagtggctgggtgcggtggctcactcctgtaatctcagtgctttgggaggccaaggtgggaggatcacttgagatcagcaatttgagaccagcctgggcaacatagcaagaccccatctccacacaaattttttttttttttgagacggagtttcgctcttgttgcccgggctggagtgcaatggcacgatatcggcttgccacaacctccaccttccaggttcaagcgattctcctgcctcagcctcacaagtagctaggattacaggcatgcgccaccacacccagctaatttttgtatttttagtagagatgggattgctccatgttggtcaggctggtcttgaactcccgacctcaggtgatctgcccacctcagcctcccaaagtgctgggattacaggcgtgagccaccacacccggccaaaaaaattttttttgattagctgggcatggtggctcacgcctgtagtcccagctacttaggaggttgagatgggataacctgagtctaggagcttgaggctgcagtgagccatgattgcaccactgcactccagcctgggcgacacagcaagatcctgtctctaaagataagtatatgtagaaaactgttagactcaaatattcaactcaatataaaataagaagaagccgggtgcggtggctcacacctgtaatcccagcactttgggaggtagaggcaggtggatcacctgaggtcaggtgtttgagaccagcctggccaacatggcgaaaccctgtctctactaaaaatacaaaaattagccaggcatggtggcacgtgcctgtaatcccagctgctagtggggctgaggcaggagaatcgcttgaatctgggaggcggaggttgcaatgagccaagatcccgccactgcactccagcctgggcaacagagcgagactctgtcaaaaaaaaaaaaaaaaaaaaaaaaaagaagaagaagaagaagaagaagaagaaacacttgttgagactgcatctccttttgctaatgagtggtttctagttgtaatatcactcctctgaataaagaagccacctttgagtacataaggaaaaataaccacatgttaaaaggataagacattactccgacatctctactgggccatctcttcctctaacacttcagaaacttagaaatttaaaatattcttacgttaactgcaagaacaagataaaggagaaatgccctttttcttgagatcacaactatgaagtcatatgcttatgcaacttctgcatttgtgtgcaaaacacaaacacactgatctttttttaacttttaagttcaggggttcaagtacaggtttgttccataggtaaacttgtgtcctggggatttgttgtaccgattatttcatcgccccagtattaagcctagtacccattagttatttctgctgaccctctccttcctcccgctctccacccaacactaggccccagtgtgtgttgttctcctctgtgtgtccatgtgttctcatcattcagctcccacttagaagtgagaacatgcagtatttggttttctgttcctggaaacacatttatacatttatcttttttttttttttttttttttgagacagagtctcgttcttgttgcccaggctggagtgcagtggtgctatctgggctcactgcaatctctgcctcccatgttcaagcgattctcctgtctcagcctcccaagtagctaggactacaggcatgtgccaccatgcccggctaattttttgtaattttagtagagatggggtttcactgtgttagccaggatggtctcgatctcctgacctcgtgatccacccacctcagcctctcaaagtgctgggattataggcatgagccatgagccaccatgcccagcctctttcttgctcttgtcacccaggttggagtgcaatggcgctatctgggctcactgcaacctctgcctcccgggttcaagcgattctcctgtctcagcctcccaagtagctgggattacaggcacctgctaacatgcctggctaatttttgtatttttagtagagacggggtttcaccatgttggccaggttggtctcaaactcctgacctcaggtgatctgcccgccttggcctcccaaagtgctgggattacagacatgagccaccacgcctggcccgcattgatcttaattctccttgcttagttttgtcagtcagcttgcaggacttaacagatgcctttctaagacacagagactgagatgtgttttatgtaagtttagtaacctcagtgctacagtaatgagacatgcagtgtccttttgctctggttcaggacagcacggaaggaggccacaggaaagagaataaatgaaacttgttacaactgagaaactacttctcattaagtttccccatggtgtcacctttatttaatatttatttttaaaattaatttctcctacttctttttactttcttcaagtgcagcaagtagacaattgaaaagtacctttacggccgggcgcggtggctcatgcctgtaatcccagcactttgggagactgagacgagcggatcacctgaggatcaccaacctgaccaacatggagaaaccctgtctctactaaatatatgaaattagccgggcgtggtggagcatgtctgtaatcccagctactcgggaggcaggagaatcgcttggaccagggaggcggaggttgcagtgagctgagatcatgccattgcactccagcctgggcaacaagagtgaaactctgcctcaaaaataagaaaagaaaagtaccttcacggtgacattatatttctgttacacagtgatgatggagaatatctcatttatcttccaaatacccctgtgaggtggctattacagagatcctttgcagaggtgatgagatgcacccataccacatatctcgttgggctcctgggctcaaatgatcttcccatctcagcttcctgagtagctagggctacaggtgcacgcccccatgcctggctaattgaaatatatatatatatatatatactgtagagatgaggtctccaacatctttctgtggcagagctgggattcaaagcctcatctaggcaccattttccttgccctctgagtcccgcagcccccagccccaaaggttactctctaacctcgcgaatgttgtctctaggtgggctggggagtgcgggtgatggcagaggcttactctttcccttacagaagatgttgtccctgtccaagctgacccttgctctgttgtgtgtctgggctgttagctgaggtcccgttgggtctccaggccccaggggtcttctggaggggtcttctggagaggtcttgcaaccatttcttattgcctccttctcagaccatccgggctaccactgactactgccgccgccacaagatcccctttccccaagtagaagaggctgagctggatttgtggtccaaggcccccgccagctgctacatcctgaaaggagaaactggaccagtggtgatgcattttcccctgttcaacatagatgcctgtggaggtaggtgcaggggaggagcaggtgagaagccacctgtattagtccatgctcacactgctaataaaaacatacctgagactgggtaatttacaaaggaagaaggtttaattgactcacagttcagcatggatggagaggcctcaggaaacttacagtcatggtggaaagcgaaggccaagcaagtcaccttcttcacaaggcggcaggaaggagaagtgagtgccagcagggcaattgccagatgcttataaaatcatcagatcagccgggcgcggtggctcatgcctgtaatcccagcactttgggaggctgaggcgggcggatcacaaggtcaggagattgagaccatcctggctaacacagtgaaaccccatctctactaaaaatacaaaaaaaaaaaaaaataaattgctgggcttggtggtgcgtgcctgtaatcccagctactcaggaggctgaggcaggagaatcgcttgaacctgggaggcggaggttgcagtgagctgagatcgcgctcctgcactccagcctggggacagagcaagactccttctcaaataaataaataaatacataccatcaggtctcgtgagaactcaactcactgtcacgagaacagcatgagggtaaccacttccatgcttcaattacctcccacgacacttggggattatgggaactacaattcaagatgagatttgggtggggacacagccaaaccatatcaccaccaggccaggccgaatggagctgtgctgtgccctggggacatcttgttacgctccaacatctgatggttgagtgagtcatcctgtccacccttgggcctggaggatgccaggctgcctctctcggtcttgcatgtttatgcatgttgctgcctctctctgcagccttcttgtcctacctgaatatccaaccccttccacctgggcatcccacattcctcatccagtctcaggtgagcagctgcttggaaggcctagcatccaggatgggtggtcctccggggcctgattgtgccacttcccacagtgggctccttttagcttgtcaatcgtgtctcctgcgatgagactcccattagggataaattgtgtctgttttcttccttcatttaacgaacatttattggttacctatgctgcatcagccatggttccaggagaggcaggctagagtagtaaagaagacaggaagcgggggccaggcgcggtggctcacgcctgtaatcccagcactttgggacgccaagccggggcagatcacctgagatcaggagtttaaggccagcttggccaacagggtgaaaccccgtctctattaaaaaatacaaaaaattagccaagcgtggtgatgcacgcctgtaatcctagctacttgggaggctgaggcaggagaatcgcttgaatctaggaggtggaggttacagtcacccaagattgtgccattggactccagcctgggagacaagagcgagcctctgtctcaaaaaaaaaaaaaaaaaaaaaagaaaaaaggaccggaaggggcatggatcataaaaatatagataaatccataacctcatgtgtcaataaaactttatttataaagccaaagtagtgggccgactggatttggtccacaactgtagtttgccaagccctgatgtaaatagacaaaaatctgcagaattaattgtccaaactcatgatgccttttctttgttggtttggttatgcttcaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggtaggtgggagaccatagtcgctctgatgcctatgctcgttcagtaagtatctgttggagaactttctctgcaacaggcaggagggttgcatgggtgaaaaaagataggcagtgtctcccctacttgagcttgcgtctcagcaggggacagaccatgaacagggtcaggagtgaatggttttctgaagagtgaagcaggctgtgttcgtttgctagggctgctgtaacaaaataccactagctgggtggcttcacagaaattgatggtctcatggtgctgggggctggaagtgtgaattcatggtatcagcagcgctggttccttctgggatctgtgagggagaatttgttccacgcttgtctccgtgtatattggtccgttttcacactgctgtaaagaactacctgagactgggtaattgatgaagaaaagaggtttaattgactcacagttccgaaggcttaacaggaagcatgggtgggaggcctcaggaaacttacaatcatggtggaaggtgaagggggagcaagcacatctttaccatggcagagaaggagagagagagagcaaagcgggaagtgctacacactttcaaacaaccggatttcatgagaactccgtcactatcacaagaacagcaagggggaagtacgctcccatcaatcacctctcaccaggcccctaccccaacacatgggaattacaatttgagatgagatttgggtggggacacagagccaaaccatatctctgtgaaaggaaaatgaaatctcaggaccccaattcactatgccaaaaggaaaaacttaagctgtggctgggcactgtggctcatgtctgtaatcccagcactttgggaagccaagacaggaggatcgcttgagcccaggagttcaagatctgcctgggcaacatagtgagaccaagtctctacaaataattttaaaaattagctgggtgtggtagcacaagcctatagtctcagctactcaggaggctgaggtgggaggattgccggagcccaggagtttgaggctgcagtgagctatgatggtaccaccccactccaggctgggcgacagagcaagaccttgcctctaaaaaaaaaaaaaaaaaaaaaaaaattaagctgaaagcttaattaagctgagtcatgcaagaaactgtctttccttttgttcctaagccacagataaaaggccacagatatctccacaggtaacttactctatcgatatggtttggctctgtgtccccacccaaatctcatctcgaattgtaatccccacatgtcaagagagggacctggtgggaggtgattggatcttgggggtggcttcccttatgctgttctcgtgagagtgagggagttctcacgagatctgatggtttttaagtggcagtttcccctgctctctctctctctcgatctctctctctcatctctcctgccaccctgtgaagaaggtgccctgcttccaccatgactgtattaggttggtgcaaaagtaattgcggttttgcaactaaaagtaatggcaaaaaccacaactacttttgcgccaacctgataagtttcctgaggcctccccagccacatggaactgtgagtcagttaaacttcttttgtttatacgttacccagtctcaggcagtgtctttatcgcagtgtgagaatggactcatacagttctagaagtcagaaatctgaaacgagtgttatggagcaaaacccaaagcgttagcagggccaactcctgcggaggctccaggggagaagctgttccttgcctttttcagcttctaggggccacccgcattccttggctcatggcccctccttcagcctcttgcttctatcatctcatctcctccttgctctgacctcccgccttgctcttataaggaaagatccatgggattccactgggcccacccagatacccaggatcctctcctcatctcaggatccttagattaatctcatctgcagagtcccttttgccatggaaagtcatgtactggccaggagccgtggctcacacctgtaatcccagcactttgggaggctaaggcaggcagatctcttgagctcaggagttcagaccagcctgggcaacatggcaagacaccatctctactaaaagtacaaaaaaatagcaaggcatggtggtgtatgcctgtggtcccagctccttaggaggctgaggtaggaggattgctgaaccctggggagcagaggttgcagtgagcccagatcacaccactgcactccagcttcgatgacagagcgagaccctgtctcaaaaaaaaaaaaaaaaaaaaaaaaaaaaaaaagtcacatactcacaggctccagggattaggatagggacatcattaggagacattattcaacctgccacaaagacacagacacaaccagatgacagaagccaggggaagagttggaatattattctgaatatggtgggaagctgctgttaagttttgagcagggaagtagctttatctgagtcaccttttcaaaggcccaccctagctcctgtgcggttggtccctaggtgagataattagcaccctgaggagcagtttgggtcaatgacctcagggtcgcaaggtagagggaagagaaagccattctgggcctctggaccagtctatgttccccagagagtttccccaaaagccctgcctggcatggggcagggcggttatttgctgctcatctgtcttctaatgaggggttgtatattagtttgctggggctgccattaaaaagtaccacagaggccgggcatggtggttcacacctgtaatcccagcactttgggaggccgaggtgggcagatcatgaggtcaggagttcgagaccaacctggccaacatggtgaagccccatttctactaaaaatacaaaacttagatgggcatggtagtgcacacctgtagtcccagttacttgggaggctgaggcaggagaatcgcttgaacccagaaggtggaggttgcagtgagcccagatcatgccactgcactccagcctgctgacagagggagattccgtctcaaagaaaaaagtaccacagatcaggtggcttaaacaaccgacacttattgtctcacagttctggaggctggaagtccaagatcaaggtgtgaacaggggtggtttctcctgagacctctctccttggcttgcagatggtgcctccctgtgtctacacatgattttcctctgtgcctgtccactccccaccttctcacctgtagaactcagggcttatttatgcttatttgttgactctctctcctcataataaggtgtgcagcagtgtggggtcaggaaccacatcactttgctcaccatggtgttcattctttcattcattgattccacaaacatttcctggatgcctgctagatccagtccgcccaggtcctgcagccgtggctgcatacaggtcagatgaggctcttgctcttgtagaatgtacctcctcccgggggggcaacatgacataaacaggtaaacaaagaagtcaacaggatggccatggagagtaagtgccatggagacgaccgaacgtgcggtgtgctgaggagtgaagtgaaagctttttaggaaagggtctgggggtctgggaaggcatcctgagggagagacctttcacctggggctgaatactgagaaggggtggccatgaggaagtcttggggaacagaattctgtgcaaaggaaaagtaaatgcaaagtgtctggagtgggaaagaccttgatctgtgtcttacctatgtctataacattctgtactaatataaaggcatatctgaggctcggtaatttataaaggaaagaggtttatttggctcatggttctgtaggctgtgcaagaagcatggcgcctgtatctacttctggtgaaggcttcagagagcatccaatcctggtggaaggggaaggggggctggcgtgttacatggtgagagagagcaagagagagagaagggaggaaagcaccagtttccttttaacaaccagatctcaagtgaactaatagagcaagaactcactcattaccgcagggaaggcaccaacccattcatgaaggatccactcccatgatccaaacatctccctctgggccccacctccaacactggggatcacatttcaacatgagatttggagaggacgaatttccaaactatatcagtctattcgaggaacagaaggaaagctgttattgctggatcagggtaggggaagcacggaatgaaatgtgattggagagatggacagagatcagaacttgtgaattctggcaggtatcatgacattcgatgtaggccaaagagttacctcctagcccagctcctgatacatgcttaataagcgtagtgttggataaataaacgtttacgtggtaaaagtagatcacaagagctccacaggaggaggtggtggagctccaggtcttctcaatgaatgaaagaatggatgaatgtctttctcctaagtcatgtatgacctgtagaggcttccaggtcttctaatcttatccagtgtgcaacactgcctacaaagcacagtggtaacttctaactttcctttctccccaggctctactacccgaaggatagtgcccgaagttgctgcttggcatagatgagcctcagcttccagggcactgtgggcctgttggtctactagggccctgaagtccacctggccttcctgttcttcactcccttcagccacacgcttcatggccttgagttcaccttggctgtcctaacagggccaatcaccagtgaccagctagactgtgattttgatagcgtcattcagaagaaggcgtccaaggagctgaaggtggtgaaatttgtcctgcaggtccctcgggagatcctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactgatggattagctgtgtgtgtgtgtcttggtctgccaccacccctgctgcggcccttttcaccctctgtgtaccctttacttgttcctttcttcccttccccctttcctttccatcttcttccatctatatctcagcaattaagcatggtggttccacagctgggtttggatcttacttctgttatctgcttaccatgagaacatgggcaagagccttcgcctccatgccccagttccatcgtctgtagaatagaccatcacggagcctgtatcctagaaaggcttaaatgagttcatgagtctcaagaccttagaatagttagtctggcaccgacggagttccagagcaattattattcatacaggctttccagaattaaagcaggactgttatgggatgaattgtgtgtcccacccccaccaaaagatgtggccattgtaacccccagtgcctgtgaatgtgaccttgcatggaaataaggtctttaccaatgtcatcaagtgaagatgaggtcattcgtgtggaccctaatccacaatgactagtgtccttatgaaaaggggagatttcgccgggcgcagtggctcacgcctgtaatcccagcactttgggaggccgaggcaggtggatcacaaagtcaagagattgataccatcctgaccaacatggtgaaacctcatctctactaaaaatacaaaaattagctgggcatggtggcacacacctatagtcccagctactcgggaggctgaggcaggagaaccgcttgaacccaggaggtggagcttgcagtgagccaaatcatgccactgcactccagcctggtgacagagtgaagactctgtctcaaaaaaaaaaaaaaaaaaaaaaaaaaaaagaaagaaaaggggggatttaggggagggagagcattatgacaaatacctaatgcatgcagggcttaatacctaggtgacgggttgattggtgcagcaaaccagcatggcacatgtatacctatgtaataaacctgcatgttcagcacatgtatcccagatttgaaataaaattcttttaaaaaagggggggggatttaaagacagagacaggcatgtatacagagaggaaaccatgtgaacatggaagcagggattggggtgaggctctactgaccaagggctgccaaactattgccagcaaaccaccagtcatccgaaagaagaccttgatagcagaaggatcctgttcagaattctgtgttgcattcagtcgtagcttttttttttttttttttttttttttggacagagttttgctcttgttgcccaggctggagtgcaatggcacgatcttgggctcactgcaacctccgcctcctgggtttaagcgattctgctgcctcagcctcccgagtagcagggattacaggcatgtgccaccatgccgggctaatttttttgtatttttagtagagacggggtttctccacgttggttaggctggtctcgaactcctgacctcaggtgatctgcccacctcagcctcccaaattgctgggattacaggtgtgagccatcgcgcccagcctcggccatgtcttcttagtctcctccaatctcgaacggttcctcaatctttccttgattttcatgaccttgacatttttgaagcttacaggccagttattttgtaaaccatccctccatgtgggttcgtctgacgtctgattatgatgagattcaggaatcttacagaagcgatgctgttctcgtgacatcctgtcaggtggtgtgaaattccaacttgtcacattactgatgatgtccactttcattgactaagatggtgtttgccacgtttctccactataaagtaactcctttgaaattggtattt

SEQ ID NO: 838 - DNA, 10059 bp, Human; identical to SEQ ID NO: 589

SEQ ID NO: 839 - DNA, 56399 bp, Human; identical to SEQ ID NO: 678
  misc_feature (1)...(56399): n = A,T,C or G

SEQ ID NO: 840 - DNA, 10010 bp, Human; identical to SEQ ID NO: 597

SEQ ID NO: 841 - DNA, 234288 bp, Human
  misc_feature (1)...(234288): n = A,T,C or G
cgctgtgtaaagaaatacccaaccatagacacggcaggaaggtgcagaacatgccccttgaagtaggggcggctgctggttgggtttcactcgtgtttcgaagaggatggaagcgctgacaaccacaggaggaatgcgtcatgggttccaggacagcaactggctggacccaactctgggctgcctagctcccccagccttcacaattcaactcatgccacctcttacaggaagtcctcctggatgcccagctctggagtcatctctgtggtatactaggattccagttccaactttctctggaaccagttgggtcatcacaggtcacgagagcagatgcctacagagagtgaggagaggcgggacctgccacaaactgcaaggtaagtgcccatttaatggttgctaagcaggactgtggggctagcgtggccacatcttccaatatctcaagaaaagttaccaatctaaatttccatgtgacatctcaccatgcctgggagctggatccagcctcgggcacccttaggtgacacagaaagagtacagcttgcaggtgaagatggctgtccagctgcgatgctctcacacccaggacccacaatcgaaagaaccaaggacgtgagatcacagttagagcctgctgtgtaagtcgtgtttcccccaacgactgggacctcctggccagcagggagaggcctgagtcatctccgggtcctctgcccctggccaaagcaaagaccaaagccctggccacacagacctggggcagggcaaatgagaaaatcaaaggggtgggtgttcaccctctggggaagtgaggcagaaattgggggtcccagggcagagatgatcaacagcctgagagggggctctcaggcaggccctggagagaggccgctgagctcagacagcatgggaggatcagggccttgctggagaggagggactggggaggggttccggttggcaacgggctctaacagcaaactggccccagaatgggcccaggtgtccttggatgcttgggtggaaaaggtaggcagagcttggagaggccatttcaggttgggggccgggagtgcaatggcgggaggacagaatgcatacgtggggttgaggacagatgagggcaggagcctgactgtgctcatgggcagagagcccaggtctggcaggaagaggctgtgctgaggctgcagcggagggatgggaaggcagatgggggacaggggacagggacttcagaggaagaggaactggggactgaaggagccttgcctctctcagtaagggcaaaagttgatctttggggtcgcgccctgggtgtaccctcctaacagcatcttctggcctttgcggcctctatttgggcattcggcctggctcagaccttggacccagtagtcagtcccccctcccctttcattccctcaccctgtcctgccccagagcacagagacagggggatgcaccccttgaattccagggctgatgggtgggacccggcaccccaagggctctctaggtggggacgttcggccggcgccgctcctcggaggttgtgcccctggggtggctggcggcggggctcccccggcccggcccgcggcgcttctctgccgccgcctcggggtgtctctgcttcgctgcgagcccggcaccgcggcgacggcggcgcgaagagggaagcgggcggcggcggcggccgcgccaagatgcgccgggtcaccgcaggctgaggcgcccgccgtccccgccctccccctcgctcgcctccctccctcccgcctgcctccctcgctcgctcgctccttccctctccccgccttccctccgcgctcccccgcccgcccctccgcgcctcgcctcctccgccccgcgccctgcggtgctgcagctgcgggcggctccagctgcccccagatgtgggctgggcggctcgcggggaactttcgcgccggctgcgagtgcggggccccggctgcagtccggctgccatggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggtaggtgcggcccggcccctactccccgggacccccgccggcctggccctgtcccgcgtgccccgccgccccctccccaggcgtcgtccagcctgacttgggcaaactccgcgcgccccgcccggggccaagttggccaacttcggggccgggttggtcgcgcagggggcgccccgcaccgcccccgagcgccttgggccgggggagcctcggagcactggcggctcctgagtcgcggagggtggggacggagggccgggaaaagccccgcggccaagagcgcagagtcagccccagcgggtccgaggggggagccagggcgaggcggcgccggggctcgcgtccggggacgctccggaggagccggctgccgagcgcgtagccttgggccctaaggattggttggggcgccccgcagggaatccccggagatcggagggaccctgttccacccctcccagtcctcgggcgctcggggagacggggccggcagcgggctgagcgggagctggacaggcaggacaggccgctcgtgctcggggaagccgagactccgccgctccggaggctggcggtgagggcactcgggcggcaggggcccgccgaggggtcgtggcacacgggtaagggggccaacccggaatggcttccgagcagctccacgtcctgccaaggacggtaggtgcaagggtcgggggactctctgacggggtcgtcccttcgggcacggggaggttcccaccgagccccaaccctgaacggggcagggggcagagctcttggcaggcaaggtctccggaggagggaacggctggggagtggcggagccccggagtggtggccctgttaacgccccttcccggttgcaggaaagccggggaggtgcaggctggcttctggggtcgcctggcggaatgccccttcccttcgcagtggggcggggtctgggggggcgtggcttgccggcgggtctctgaggcactggggctccgtggtctccgccgatctaacgccccttcccgttgcaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggtgagtacgcacttctctagctcctttctctccgctgctctcgcctgggttttggaaaagggttacctgggagtcccttgggagggcaaggcctgcgctgaggactttccgcgcccttcccgtgctttagtgagcctcgtgctccaactgaagggcttggctggaaagcaggttgttttgactggtctgagcagggggccatttatgcatggggagcgcccgggtctccaaaaggctcagcaggcaggagcgtgcgcctctctcttttgcctgcctgaacaggtctctggcttgcatccgggggtgggtccgtgtatgtgtgtgtacctttgtgagtgtgtgcacatgtgttgtggaacgttggtgtgtacctgcatctgggtgcccgtgcacctgtgtgaacatgtgcgtgtgccagtgtctcttgtgcacgtatgtgtctgggtttctgcacatcagtgtgttgagcatctgttgagtttgtgtccgtccttgtgcatactggcgtgatatgtgtgtggtggacttatgggctggcagtcagtcttcctgtttccttgcgtgcgggtaataccagcccagggagctggcagtgatgctgaaatgcccagttagccctctgccccttggctgaccgggaatcattggtttttctgctgtggtttcctgttgaactccagctggttctttgaaaagttggttttctctattttgagctgaggggtgcatttggaaatgaaggctctagtgcccatgagctgctcgatcttttgggggcagcgcctgaaggacaagagagaggctaggggatcccttttgagactgcctgcgcctctctagtcctgtgactggagctctgggaagctctgcttcctggagagggcaggagggaccgtggctcagcacaagggggcctcagaggaagcctggatcgatgctgagggaggaggctgacattggcggtgctctgtccggctgcccggggcctggcacacagcagaggccactgcagttttctattttggattgggtgtgtggtggtcaggctggctgtgctggccagacatctgaagccgcccaccatgggttccgctctaattgctactcagggaactcctgccccgagtgagtggccactctcccagcccccgtggcccctgagcacgcccgtactcgggcagctgaggctcatcctacagtctgcagagccggcaattacaccagggctctgcaaccactgtcattctttttatggagacacagaaaatatcacttgttgctttggaaaatcactgcctttggctggatttagttagaacttggccatattgcaaacaactgtaaatatccctggaggagctgggttaaaatggtgagcccttgacatcgcccactgtctctgaggacatcctgggcctcagaggtgtgtcccattttacgctggaggttaatttcctaaatgaaaggagatgtttgctgcggacttagggtgaggtaaggtggtgggagttgacatggggttgcagtctgttggtgggccaacacctgtgtactatgcattcctgatggagagcattttggggaggacttgtcactgtttcattcattcagcagttcatttggtgattcatttttcagccagcaccttctcatatgtttatcccctgtactggtcagcaatgaggcaggtctggtacccacccagggctcctgtcgtcagggtggctgacggacactctggccaggacttggagagtgtgctcctggggggctgtttgaatgggggctggaagaatgagtggccagctggaaaagacgcaggttggcaacccgggcagagggaggagcgtgtgcagaggtaccaggtgtggattggcctgggcaggacaggcctgctgaagtgtcccatgtaccagacagagctgggaagaatattggggttggaagaggagctgggacctgcctgagcggcattgaatgctgtcactgaataatggccttggacagtgggacagcaccattggttctgttttctttttttttttttttttttgagacggagtctcactctattacccaggctggagtgcagtggcgcgatctcagctcactgcaagcgctctgccttccgggttcacgccattctcctgcctcagcctcccaagtagcagggactacaggcgcccgccaccacgtgcagctaatttttttttattttttttaaaatttttagtagagacggtgtttcaccgtgttagccagggtggtctcaatctcctgaccttgtgatctgcctgcctcggcctcctaaagtgctgggattacaggcatgagccactgcgcccagcctcttttcttttcgcttgtcctctttctcttctcttctctttccttccttccttccttcctttttttctttctttctttccttttgatcaggctggtctcaaactcccgacctcaagcgatctgcccatcttggcctcctaaagtgctgggattacaggcctcagccaccgcgcccggcctcttctttccttttctgactttgttgctgcgtatgtgtctgtcctactgttaaatccccctctgctgccaccacgataggcttctttgctaaggacctgggtctttacacagggcacctcttgtcctcacagagccctggtcggggaggcatctcatccctggttacaggtggagcactcaggctctgggaggttgagtgactagacggaagttattcataataatatccacagcgaggggttattcatagtatccacagcaaaatgtccctttgcacaaggcatgagcaaaacaggctgcacagagtggtgttgtgcctcacgttgctgcggaagagttttccagtatctcctgggcagcgtggtaggcgtgctaatttcacgtggtttttacatgcccattaaaaacccagtgagaagccttttggcgtaaaaggtaatgatggtaagtgacagttgactgtgttcctattaacattgtgtgccaggctctcagctgagccccctgtgccacctcgccttgtttaatcctcacagcaccctacggaacatatcccgacatcatcccccttctacagatgaataaactgaggctccaaaagtcgagatagcttgcttcaagcttcgaagccagtatttgaacacaaatctgattccaaggccatgctcactatgttttgttgccttttcctgcatgcctacaaaaagaattttaaaaatgcatttctttacaacatttcccacctttcttatttgactcctggagacgttctcattgtgggtttgaccatcgtcagtgtgagtggagccgggagcaggcctgggagctgagtggccttgactggctcgtgacctgcgctgggctgcagctcctatgggtggcctaagtcctcactggtgggggactgcagctgggacttccgtgggatggaagcaaccctgcccgcctctgcctccccactcagggcagcacggggatcctctcctgccaggctgggcagcagtggatgaagcctccatgggctgggcggtggagatggtccgccctccaaggcctggtccaatcctggggcccaaaggaggaagtgtatgcccttccctggatgcttgatgcgaaccccacaaccctgtgagatagggctgccccactgcgtggctgaggctcagagagacccaaggttgcatggcaagaagaaatccagggctgctgcctttcaggctggggctcccctgcggggctgctgtctgggccaggcacccactctgtcttgctggacattaagagtcataaaggccacagagagaagtcagaagccggcctaagggatcgagatgagtttcatttttcccagcaaggctgctgccttcgaggccacacactgggctccagcaggctcaggtgctagagcagatcaggcaggtgtgagcgggtcctgggactgtgcagtggggtgaggggcacctgagatttgcagctgccgctggtagggtcttccttcctcccaccccaccttggcactgcctggatcgcaatgagaggttgtcaggaagactaaagaggggctgcaggaacctctgggttccctagggtgtcggggctccccaggtaggagcagaggctcctgtgggccccagctgcaagcagcctacacagctgctaaggccagtctcagcctccgccatacttgtcaccttaagacttgctcagtttaagtgacagaaacccctgctcatattggatgaaacaaacaagggacagcatggccccaattatctgggggtcctgaggagtgttggcttcaggcctggctgaatccaggggctcagagcatgctatccatttctcagccctgcctctcagtgttcatttcagaattgctctccacccctcaacccccggcccaccagcggctccaggcccaactcgttttccaaggaggcaacctttgagatggaaagccctcctctctgggtgacacctgtgagagttgggggagggattggaggcccatcttcaaacccatggctgtgatgcgggcctagcccaggtctcctgcccacctttgggactgagggggagggacagactcccaaactctggaatgaagaggggcctatcatacaagaagggaggagaattgtgcagggtggtgaacacggttgtggccacccttctcctggactccagaccccatgttgggcttagaagtcctcctgggctccaggcttgcctgctcggctgcctctggaacccccttccctggatgaccccatactcaagtcacgtggctctccccactctcctccagaccccacccttccaggatcgccctcccctagccagctccaattctagagctctctcagggcccggcttccctccacgcctggtgccaacccctgctttctgctcttgtaccccccactgccccatggtctctccccgacaacccttctccactctgcagccagagggatttttagaaaccatgcagcaactcatgtcacgccttcacttaagacctctcagtggttcttactgctcttaaaaacatccaaacccactggcctggcattcaaggcccccgtgacctggtcagggccctccagctccggcctgagtcgcctgctctgctggtctggaatgagactccgggagaaagggctgcaggaggcagaactccagcgttcccctcaggtgcccctgggagggtggggcaatgactccctcccctgctgccttacgtgagctgagggcccctacagagatgcctgagggatccagcagtgcagcgcagtccctctggaggcggcggccagcctcaggagggggtccggggagcagcatccacaccatctacctctgcctggggctttgaacccagtccctgcggttttcctgtgagccagccaccgtggccccatttcacaggtaggaaaccgaggctctaggagttacatatgcaggttctctgtgtgggctggcgtctctcctggaatcctttagggaggggcagagtggagccggctcccagcccctcatgaaggccggcatagtcagcactggtctcagccggagcccaccaaggccagctctccctgggagagctgcactccattgtgtggctgggtatgtttctggcactggtaaatgtgcgcggccatgtgctcattcaggtgtggcaggcttctcctgcccaatggctcgccgtggcttccctgtcccccatgtctccagtgcttagcgagtcatgcctgagtgaatgcaggccctcctgcagagtcagctgggaggtgaaggccaggtcctcacccaggcctgctgtgaggctcacaggggcctcacctgggtgagtgagtgaattcaggccctcgtgcagagtcagctgggaggtgaaggccaggtcctcacccaggcctgctgtgaggctcacaggggccacacctgggtgagtaagggaatcagccagggacatccgctcagcagcgaggctggctttgcctcgtggctgcctgagctatggtctgggcctgcccactgtggtatctgaagacccaaagaggcaagtgtgcatggcagccctcctgggaccctgggtctgtgctggcaggcagacatgtccttctttaccccacctgcctctctggcttgggcagccctgggggtccctgtgttgctgccggcacagcaggctggtggctgcatgtggacgtgtgcgtgtcctgggcctgtgcatggcgggagtgtgtgcatgtacgtgttgcctctgcatgtcttgcatgtaggagtacgtgcatgcagtgtgcgtgtgggggtgcatatgtttgtgcacgtctgaatgagtgtgtacacgtgtgtgcacatgagtgtgtctgcatgggagggtgtgcatttgagtgagcatgggccagcatgtgtttatgtatttctcgggaggggtttcctgcactctgtagaagaggggccttaagtggggttgaggtactcaggggagaggaggaccccagccccctcaatcttggcgccacgttagacacccccatcccctactggtggttaccccggaatgggaggatccaggtaggagctgcacactctgctgcgtatgtttcatattaaatatcagctgtccacagggtctgcggtgctgccattaatatggagaagttattaccgagcccggagctggctcctcgggcttgtccatgaatttcaattacactgcacgacgactccagggctgcagagtggggtgcacagcttccgctcagaggcacagggaaccctagtgtccaggaccaaggcctgggtgctgctgaagccaggcaggctctacgccatccccaccctgccttgtgcatttcacgggttaacccagggaaggcaggggcctattgtgggctggaggctgttgcgggtcacatggtccgctgtgctcctcgtgaccggcagggcggacaagcaccacgatcctgagaaccttagttcctccaatagcaaaagatgggttctgtccgcacgcacttcagtggcagtgaaagggtgggtgtgcagcaagcgcctaccccaggcccgggggtgagaaagcggtggccgtgtctgcatatcattagctctaaggtgccatcggttacaggacacaccattactttatacgccaccaagaaagaggagacactcccatttaaactgcaactctgtgccttgtggttccctggaggcgcgggccccactgccacagtgcttggtttctctgatgctgtctgcagcctaatgggtgggccatttctgctgcctggccgtcgcttgtcacggctcccgggaactgagttcggttggcttcgtccgcctccgggggtcttcctcttgtgaattacgaagtagcggtccttcctccagggataggtatttgcctcaccaatgcaaagctacatgcgcctttctgcgtgcaccctaactttttgacctcacagcgtgactcttcaaagacattttgagtgtccagggtgttgacagtgagggactgcgttggaagtgtcgtggcccaggaggcgggggccagggccggggcctgagacccgccgattgcatcctcagttcaggggttgggaaatggaaagatgcgtgttggagggaccagccctcaccagctctgtgcagaatgtccgggattcatctttaaacctgggtatttttcctttgaaagccctaatctgaaatttcaatgtattaaaagtatttccaagtgttaaagcctgtcatctttacacccgggtatttttcctttgaaaacccctaaacgacaaggtttggagagctttgggttggtgaacaggtgaggtgctgggagggtgagtgcccagagagggcgtggaggctctgcagcccttcccgttaccttgccctgcccatccctcccacgcggctgtttgaaagcagggattgggagcacatggaaagtagggtgtcttcacgtttcatgcaaggcttgtctaaggcttgctagtggccattctgattgggacagagcttctggacatatgatgaaaaggggcttgagagctgtgagcatattggtatgtatttacatctgtctattttatgggttatagtacaccatcgccagtcagttgcaaatgaaacctcaggttaagcagtaccgcagatacattctacttttccatctttctgttcttgtaccaatattaagctgtgtttattattagaactgtaaggctctaatagtcaaagtattaagtactttgaagctttgctgtccaatacagtagctataagccacacaaggctattgaagacttaaaatgtgtctggtctgaattgagaggtaccctgagtataaaatatacattggatttcagagacttcgtaccccccaaaaagaatgtggaatgtttaatagatcattttaaagtattgattacaggttgaaatggtaatattttgggcatactgggttaaataaaatatatttctgaaattaatttcacctgtgtcttttttttttaaaaacatggctacatataaagctcgagttctatttctgttggactgtgtggctttggaacatctggctggatacgtccccctttgctggtattctcttacaaaattttcttggctggtcacatatgtttattctttcaaatgaattttataattgttttgtcgggtagaaaaatccctcgtgaatttgattgatagtaaattaaacttagaaactaattaaaggaggaattgacataatttacagtattcatcaggaacatagtatattttttcagcttatttcattctgctttgatgttgtaccatgaagtattatatatacatatttttatacaggtcatccatttttaaaaatcaggattatttcaaggattttttttctttttgccattgctcattgaatactttccatctattggtacacaggaaggctactgatttttatagaactatcttttatcaagcagcttgattgaactcattaattctaatatatctttgtggagtcccttgggttttctaggtatacagttgcactctgtaaacactgataattttggatcctcatctccaatctgcaccgtctggaaccttcagagcgatgttaagtcacagccgtggctacacgcatcctcatctgtgcctggctttaacggcaacgcccccggtatttctctgcttaatacagcgcttgctgtggattaagatggatttcatgtgaaggcaatatcctctgaattctcgttttctaagatcccatttttatcagtaaaggagctgaaatcaagataaaatgtgtcttaactcttaacgctcccttctctcacctccaaaagccagaggtgttgcgattccggggtgtttgtgttctcagcctcggcctcagctgtccactttgctgggccaggaatgaaacccagtccccatttacgcaccatgggaagccctcgtagggaggggcagccttcctgcagaaggtgggggagccagcacctcccggccacgcgggtgacttctggaagaacaggaccctgttcttggaaagccctttgggccatgtgtgggggcatttccactttcatctgtgggttctttcttccctcccagtggcgtctccctccctctgtccagtttctctggagcaatccctccattctcctcctgtgtcttaacagcggactttgcccgctgctctgaggtggtggcactgtctgcagagtctcctgctcttccagtcccactgttatctgttatcccatgtgcttctagaaggtgtttttccaagcaaagacatttccctccttagaagaaatctgtaggcggggcacagtggctcacgcctgtgtaacttgaggaggctgaggcgggcagatcacttgaggtcaggtgtttgagaccagcctggccaatatggtgaaaccccatctccattaaaaatacaaaaattagctgggcatggtggcacacgcctgtagtcccagctacttgggaggctgaggcaggagaatctcttgaacccaggaggcggagcttgcagtgagctgaaattgcgccactgcactccagccaagcagcagagtgagactctgtctaaaaaaaaaaaaaaaaaaaaaaacagaaaaaaaccaaatctgtggcttgtcttgcagaagagcatttccattgtgtgatctctctgcctgcccactgatgggcatgggatttgaggagctttgcacagcatctgtacataggccccatcctgagagattctgctttatcagacctgcgtgagccctggggtctgtacttttcaaaagctacacaggagagtcttttgtacagcatgacgggtgctcactagcgagggctgtggggagtgggggctcacagaccagacttggggcctggctcttctcttgctggcctgtgaccctccattttcccagttaagacaccacctgcctcacaaggtgtgtgtcagtgagggagcagagggggatgaggctggctggcctcagtcaaagggaattccatggggggcttgaggtggaaggaagcgatggccagtgggcatggcccggcttgggatgcgggaagctgccacagcggtgtcggctcctggccctctgctctcgggtctctcacctggaaattcagagccccggcagaaggaaggcagccgccgtcgcatggctatccccaaggccacacagtagggaggggtcctcacaggcaagcgggcaggataagggggtgagggctcccagggcagtagctggcctttgctgcagggctgtccacacttggcggccacctggagctccatgggcgttgagcactgatcctgcagacctgatcagggcaaggtgggggcagtggtaggcatcctccttggtgctcctcagtgccctcccaggcaggtgcccaggccctgggaggctcctggtctcctctccttcccttccttcccctcccttcctctctgcactcctccctcccttcctctcccatcccctccctccctcccctctgccctcccctctctgcacgatggctggccactggccactgatcccagcacactggccctgagctgaggtctgggcttctggggcaatgcaggttgggtcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtgctgcttgcgctctgtcctccttgcgtcttcctccttcctgcttcctcctgccctcttcctccttcccgtcctctccctcccttccccctcctctccctccagcttctcctccccttccctcctctctcttcccccttcttttctcattcctctttttcccactcccctcccttctcttctccctcatctcccctttttcccttttctctccattctccctttatgtcctctcccctccctgccccttctgtcctctccctgttcccacctttctttcccagagtctttcatcagccaggactcctggggacccttcctggctgggggcccttcgtcgtcagctgcactctgcacctgtaccttcctggtacattctgggaaccaacaacgagccatcccaatgtgctgggaggaaatcagggcacagcgatggggatgacccaccccaggtcccacagagcccagagccagctcctttcactgcagctggagcaccagatgaaatctgtacctcctcagaggtacagataactccccacctgtacaagcagggtgaattgctgaaaaggggaattcatgtctcctctccttggcctgctactgagttcttggtgcattttctagcaaacaaggtcaaggctgagtccctgccctgccagagcatcctccacctcagatagggcggcttggcctttgggctgtctttcctgttggggtgcccaggctgtcacgggctgtgtcctcactggggagggtggcccgatgagcagggctgctgggaaggttgtgcaggtggtgtgctgggcaaggtggccaatgaggccagcctttgctccgtctgggagtgaatggagtggaggttggagggtgcccagcgctgggtggagatcacgggcactgggggaggggaaatgtgtgccaggtgtctgcctccacagtcaggttgccagagttgctgcgttcttctctttgcagagcttctgcattctcgggactagggacattaaaaaccaaagccggggcagttgcagggaggctgctggacattgcaggtggccctgattggggcagtctcagctgtggtgactacgctgtggcctttggggccagggatggctggtccaggactgggcatggtatggggtgggtagatgtaggccgtctctgtcttggtgtcagcctgtcctgatagactctgggggctcagagtcctcacagccttcccccaacctgcctgcaggtgcccacctggctccccaaggcctgcaggagtccgctggggctgggctggcctgggacccttggtgggagtcaggcaatcgtgttattgttgaaacttgtttcctttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccacgcccggcctgaaacttgtttctttaatggctggtggttacggcccccaactttcctcctctgaagctgattggttctccctggggctagtcattaaccctctgctagcttgggtgggtttatatttgcagagcttccttttttattctgccgggctggtgttttgtttcttcggtcagctctgtcagcctctctagttgctttcttctggttactcagcctgtagaaaagtatcagcctttcaaagaaatactccattatatgttttgcttttttcctgacttgatttttaaatatataactcctttaattcaagtgaaatgtgtttcttatactgtataaggtgttggttttaagtgttcatttttttctaaattgccatgctgttgtctcaacaccattcgtttgctaattcactctttcttcttgactttggaatgtatattccatcatctgtgaagttcatggaggatatggggtttatttctggcctttctgggttttgttttgtttttttttttttttttgagacggagtctcactctgttgcccaggctggagcgcagtggcactatctcggctcactgcaagctctgcctcctgggttcaagcgattctcctgcttcagcctcaagagtagctgggactacaggcgcccgccaccacacccggctaattttttgtatttttagtagagacggggtttcaccgtgttagccaggatggtctccatctcctgacctcgtgatccgccctccttggcctcccaaagtgctgggattgcaggcatgagccactgtgcctggccttttctgtttttcttttgcaccagtccaggggtctttaattgctgttggttgacaatatgttctgacatctgatagggcaagtatcaccatcgtgaggttttaaaaaaatgcctaaagtagtgtcccctttgcagaaggccctcagcaaatctttgctgaacaaatgaacgacatcttcatgatgtttaattttctcacggaaataagaagattgattcagatgtttaaaaacatagcccagtaggtttattactaagagacttagaatgttattgccattgtcaatagggtcttttccattatattttacaccagattgttatctgggaacacttttaatttataatacagtaggtgattatttactcagaatacctgggacctgcttctttcagactaatgatattctcagaatttagacatctttattcccagggagaaaacagagttaaaaatgacacattagtgcaaatcatacatgcatgtgcagagctgccacgaaccacttgatacccatggttgacctggcaagcccaagccccagcattgctgtcctcaaggcgcgcccttcctggcaacagcccctgcttcagatcctttgctcccaatgacctgcatcttcccatgtcttagcaaagcagtctctctgttactagaatggcacaaatatgaaccacagataatcacaaaaagtccttctgaaataaatctcttgccgggtgcggtggctcacgcctgcaatcccagcactttgggaggccgaggcgggtggatcacgaggtcaggaaatcgagaccatcctggctaacacggtgaaaccccgtctctactaaaaatacaaaaaattagccgggcgtggtggtgcgcgcctgtagtcccagctactcgggaggctgaggcaggagaatggcgtgaacccgggaggcggagcctgcagtgagctcagatcgcttgcaccactgcactccagcctgggcgacagagcgagactctgtctcaaaaaacaaaacaaaacaaacctaaatctctcgcttggatgtttcccatgtttgcgttcccagatatatgagtttctctatttattttgcatctagactttttatgaacttccttgttattatttggttcctttttttggatgtttttgggggtgaggattctctacgtgtgcagttactttctgcagttcataatattgtctcttctttttcaacatgttttcgttttatgtctttagtaattttgtgtgggagctacaaccatgccttcagagcatctagccccgcttctaagggaattgagaaccaggtgctgcttcttctgtgaatgctggtggtggtagacccaaagtggacaaaccttggcctgaatggatctcccaggcccatttccccacggtggcacggctttcctttccctgctctcttgcatcaagtagagcttcgaacgcaggatgtgcccatgttgtggttttatggggatgagtggcggcggttgaccttccctttcagtcaaggaggctctctcagtccctcgtggtctgttaggtgtcccctgtggttggggagcagtgcaccgggcatgcacagggttgtttgcaggctggcaggaaaactgcggtctttgaaagatgccctgagtttctacgggggatgtggttcagtgagacactttcaggagaaggctggcgagtagattcggtggtacaacctggagactctatgaatgtggactgaggagccctgttttgagtccctgccttacccttcacaatgagataattttctgcacttcagggttcccattgtgcagggcggagtttgcacactggtgggccacgggccatgtccacccacagatgagttttgtttggcttttccagtgtttgaaaatttctcacaaagctcaagatttccagtttctcttgagaaccaggaaatctgccgggcctatgtgctggagggctagagctgagcaaggatggaaccctctagaagggtcccacagttccaggtgccttgggagtctctgctgctccctatcattaccctggcgggcttcacgcgcattcactccctgtgtaggcacctgagagtttctcttattttgagatgagtgctgcatgggctttggaacggtcatttcttcctcccctctctctccctctccctctccctctccttcccatgacttcagtttttggccatcagcccctgcaaggtcccgtgcgctggagtcagacgcgatctcgctccaacacgtgggcttggttttctgctccctccctccctgggcgagcgagcctcctgtttctcatctgtgaaaggtaaaagctgatgacggtaactactctggtgggttatgatgaggattaaatgaagcgagggccagcactgagcagcgaagggcctgttactacaagatcatattttcctgatggcgctgctaggagggaccacagtgtgaaagcgcttggacacacggagccaggtgcagattttgtctcttttgagagctctgtgggcggggcttgggcgggcatgggagtggggggcggggccgggggcggggcacaggccggggtaggatgctctccctgccccaggcatcaccggcctgggatgtgttgccagtggaggccgttactgttctgaaatggaattcctgggtcagaataagaacagatgtttactggaagaggccaggagccgctgacatcaccgagagcccctcaggacatggctgaggccaagggtcctctagctcttcccgccaatacagcattcctggggcagctgcccggctgggggtggacacacacacacacacacacacacacacgcacacacaaacgccatttctccaccaaatccttcccacctgaaaacaattagtcaagatgcggaaaagatttccagtctggaatgggagaagagtctcgtggcgggcaggccccaagaagggaaatggaggtcagtgtggcgaggggatgtgcaggacggagaggcagcctttgttgggggagcgctctgatcccttcctccgcacccctcagctgggaggacttggccgcctggccgttctcctttgggagtgaatccggagggtgtggcccagaggcggctggcctcgctcctgtcctcccatccacacctgtgcagctggtgcctgtgcccctgtccctcccacaggccatccccaggtccacactcctgtgactgcaagtgacagaaaaccggggcagaagcggctggggccaaagggggaatgcggggctcagggcggcagcccaggcctcccgcacggtttcagctcagccgccctccccgtgggtcctgcctgggcagtgcaccagccgcccggcagagagaggcccaggttccccgagggtttctgggagagcccagtggtgagttctcactggctcaggttgggtcacatgcttcaggcaaatcactatggccaggacagcggagcaggacttcggctggccaggcctcgtcacaggactgctgtggctccagggctggcgtctgtcctctgaccctctgggagtgggtcggggagaggatgggccccagaggaaagccaggctgatgtgtcaggaggagctatgggtccccattgccttctgtctccaggacatctgccctgtcttctccctgcccccgtttctcccactcccttccagctgcccatgataagcacgcggtctcccttccgtgccccacccgaaatgctccccatggctcctccactttgagggtaaagcacaggcccccagaaccagcattcaaggcccctcctgaccatcatcatttcctgcttgctctacccaccatgtccaccttcccgttcatcctgtgggcctgggacaggagctccgaaagatcacacacacccatcaactgtcaactctgcccacgttggaaacagtgcctgtggcaggtgcaggaggggaccatttgtcttggctgaagttgaatctgaaaatgacctaaggacttgaaggaaccagggcctagtgtgtgtcggggtgtgatcgggtggctgaagaagctgagactccttgggcctcatgggctttgcattagcagagcagacagtggggggtccctgaggacctctgggcttttgcctgaatgctgggaaccccataggcctggccaacttctcatcacccctcttccagcaaaccttcctgtcttctgtcctggtagttagcacagctgttccatgtcgtgaaccctcctgccagcctggtgaggcccatggacccctgatcaaaataatgtgtttagtgtacactacaaaatacaaaggaaataaatctgattgaaataaagctatcggccaggcatggtgcctcacgcctataatcccagcactttgggaggccaaggcaggaggatggcctgagctcaggagtttgagaccaccctgggcaacatggtgaaaccctgcctctactaaaatacaaggaactagccgggcgtggtggcgggcatctgtagttccaactattcaggaggctgaggcacgagaattgtttgaaccctggaggtggaggttgcagtgagctgagatcgcaccactgcactccagttggggctatagagtgagactctgtctcaaaaaaaaaaaaaaagagaaaaataaagctatcaacatacacatgcttttaaaatttttaatcattattataccttacacatttttgataataatgttattgagacataattcacatactatgtattttaccaacttataacgtaaaattcaatgaatggctttagtatgttcacagaatggtgcaaccatcaccacaattttagatcatgttcaagactctgaaaagaaaccccagaccctttagtaacccccaattaccccgtcctcccaggcctaggcaaccactgacctaccttctgcctgtatagatttgcctgttctgggcatttcattagtataaatgaatcacacaatatttgccctttgtgtctggcttctttcactcagcataatgttttcaaggttcatctaggttgcagcatgcatcagagcttcattactttggatggaaagatatgattccattgcatggatgtaccacagttttttaaatccactcatgggttgatggattgggttgtttccaccctttagctcttgtgaataatgctgccaggaacattcatgtaaaacttttttgtgtgcttttaattgatgcattaaataataagacctaggagtgcatcttacagcctctataatttaagttgtgctgagtgtaaacaccatttggtctggtctgcagcagcggtgctgacagttgccgaagcctgtgatttctgccctgatgggcgcaggtgctgttaagtctggggttgctgcctctctccagagttgaagggaatggcagctttcagttcccagttagtaaagatgaagttgaagtgttctcttttcccagtttatggagcccaggttaagaactctccagggagctcccacagggcagtgacaggacccaacggcccctggcaagtgctgtggcctgtggcaggaccaggtgtccagatcaagctggcggctgttctgcctgccctcagccatgctgacacctgccacgaagcctggtgtctgcttctttctcctccccgaagtattctctctgtccttagcttgggagtcctacagctggagggtggggggcccaggccctcctggactgctgcccctggggccccattgtctttccttctgccaggccatttcccttcgcagctatttagaagggaaggcagccaaaggcctgtcagaagggggaccacggatggattttccatcagatgtgcagacctgctccctgacactggctggctcggtgcctgcctctggagggcaccaggcctctgtcacttcctgtgcagcccctgccagccatgagacaggtgagggctccttggttttgtggagactgtcagtcttggctctggagtggcctcagtcctaggcagctcaagttctgcctcccgccagtcctgtctgcaggcaggatccagtcctcacgcacccatgctgggcacggccctgcttccacaccgtgctcaggaggagagcgtccactcccaggagaggccttgccaggcacctctccttagggacacctgcagttaggggtctggcgccagcttgtgtgtgagagatcaactccccctggtactgtcaggccccgagtgagggagccgcagcccagagaggcctctttctgtccagtttgcatcgccacatttgggtttctgtcccgcctggcctgggccccacctgcctgcggagctgccgaggccctcgtctagtgccctcccagaggggcctccagtcctggttcttatattacagaggcagccagaggcttccctgactctgtggctggcgcagccttgacaagtcatctggaattggctcacggcctcctcgcgtctcccggtgtctgatgtggcaatgaagctctatttcagggcctgcgggaggacccagcgtggctcagggtttgtcctcaagggagggcgtggatcagagcctgtagtgcggacctgggtgggggagggagaactggaccctgcactccctcctgtgtgaccatgggcgggttatttcacttctctgcactttcagagtctccaccttgagatggccccgtgaggactgattcaaagaaggcacgggccgtgggcgcatcctctgctcctctccccacctgcgctgggtcccatcagattttggcattcccagcaccggcagtcctggggtgactcacgatggctggcaactttttgtcctgtctttaagttaaaaactgtcgtatgtgccttcatataaaacagaatgcagaaataagccaaaaggagaaaatggaaatccctgcagtgccattagctttcaacatttttgtgtgtctcccacgtccatgcacatatgtgtaaacatacttaatgacaaaagggtcgtattgtaccttccctttgtgatctgcctctgcccatgccacacataatggaaatatttctggatcatccagtgttctgccggaacatctttcaatagaggcagcataatctactcaggaaacatggagaggccgggatctccaggcacttgggtctgtgggcctgggggctgagggagaggctgaggaaaagcactccccagcttttgacttgcacagatgggtggtagagaggaagggtagcttggagagagggtttgtcactggggctgtctcttggaaggagtctggcagctggaaatgcaggtcctaggtgcaggggcaaggtctgggtagaattcgggttgggagcgctctgtatggagggctgtggattccacatcctggggtgggtgggcgggcaccaaaggaagagggaggcagaaggggaaggaagtgctccttggccccccaccatgtgcagacaagtggaggaggcagtggggtcttaggagcggggctgcccacctgctaaaggatgagagaggttcaagaggagggggttcagggaattgggatggcagggggcatcaggcccagcagccaagagggggctttgcagggtcgctggggagttggtggaagctagactgaccaggtgaggggccagtgagaggcaagggagtggagggaagctggtgcgcatggcacacatgctgcggtggggcagacatcagctgcggagggtgtgcagtcttagatgtgagtgcagtgtttacgtgtgcgcttgtgtagatgtgtgtgtggccctgcctcgagcacagaggattttaggtggcttgagtttgctcagggaccgaggatgaggatccgggagatggagagtttgaagctatagaagagagagtgtattagtcaggtgttattcctcaagtgttggaaatccaagtaaaagtggcttcagaaaaaagaaaaaaaaacttattggttaatctgcaaaaagaaaaatatctagaactatctagcttcaggtgtggctggatccaggtgcccaaataaattttcagttgttttttttcccacatccccaacccttggctttgctctcctctatgtcgatttcactctcaggcctgctcttctctgaggcagaaaaatggatgcaggcagctgctgcattacctcctcacagggcaacaacccgggggaaacagcttttcctttccaacaattccagcaatagttcctggatttaacttcatggaataccttgtggcaagtcctcatccctgagctatgttcatgtagtcagatgacaacgtattctacctggcctaggctgggtcatgtgccctccttgcccactggtgacgcagggatgagagctggttcctgagtgacacaggggctgtgctatcagaaggagaagggtgggccaggaacagtggctcatgcctgtaatcccagcactttgggaggctgaggtggacggatcacaaggtcaggagattgagaccatcctggctaaaatggtgaaacctcgtctctactaaaaatacaaaaaaaaaaaaaaaaattagccaggcgtagtggtggacacctgtagtctcagctactcaggaggctgaggcaggaaaatggtgtgaacccaggaggtggagctcgcagtgagtcaagatcgtgccactgcactccagcctgagtgacagagcgagactccgtctcaaaaaaaacccaaaaaaatggaggagggtggactccaggcaggcttagggttcccaaggaagtggctggggccaggattgggagacctggaaggctggaggagggagctgctgcccaggagcacagcaggagagagaaggacacgaggcagacatggagcgggagggaatttcctccgtggcctcccttccctcaccaggcagggcagggacagtgaggctgctgaccagcctctacagctctcctgggagtcggctggctctgcaaggcaaacagaaggctggggaggttgactgatcaccggctgctccgggagccgtcaggctgggcagcaggagtggcctgaatgcagagaagcaagccttgagatcaggcagggcagtcttcctacattaggagtctgggaccaggcattctgtgggccaggccggagatgtggcaggctgggtgtgaacgtgctgaccagtggggacctgggtttgggtgctggggagccaggcgtaatgactgcgggggctggtgaaggctgagtccagtctgcacgcatgcttcctgtggtttctgggtgaaaagagggtcacagctttttgcctcaacagaggggagaggcttctattctactggttgagtgtggatggggagggctgggaggggtaggatgaggtggtagagacatacaataagcaaaaggccaaataaacaccttctcaggtagtggcaggaactgggaaagtaagcaagcaggcagtgaggctgggagcagcaggagggtgtgagtgagtgcatgtgtgtggctgatgtgtgagcacgtcagtgatgcatgtgtgcaaatgtgaggcatgtgtgagtgcatgagtgtcatgcatgtgtgcacatgtgcgggcgtgtgcatgtataatgcatgtgcttgatgcatgcatgtgtgcactgcatgcctgtacatatgatacctgcatatgatacacatgtatgaccgatgcacatgtgtatgtgtgggtaatgtctgccatgcacatgcatggggcatttttctggtgcatgtgtgtacttgtgtgtagtgcacatgtgtggacatgtgtatgtgatgcatgtgtcacaggagatgcacatatgagtgatgtgtgtgtgcatgcgtctgcatggtgcctgtgtgacgcctgcgtgtgagtgcacacgtggtgcatgtgatgcgtatggacatttgtatgtgggtgcatgcatgctgcatgtgggagtgcatgagtgcacatgcatgtgtgtgggggcctgtgtgttgagggaatagctgttgggaaccctcagtcataacagggctgtgtgaaatcttcagctggaggaagacaggagagaaatagcgtgcagctgtgttcctaatggcacacacgccccttgcccagagtgcatggtggaagagggctttctggcccagggaccagctctctttgtggcccaggcctgctgcttttgggctggggtctgaccttcctggaagacccttcggggccccgcctctcagaggccaggccccaacgtctcaacgctcaaacagcgacatcagtgtttcccccaggggagtcatcctggggaggctcagctccatcctgagccgagggggccttggcattgccccacctgccctggtctgagaaggagctgtcctctgcctctctgtggtctcatggggacaaatgccagccactggacagtggcccttgtcgtcttctaactgtcaagattccaaaaagacggaggcgaggggtgtgcgggagcaccctctgcgtgtgcttggcttcttccccaccagccttcttgtgagagggctagaagcagctgtcccactttgcagtgggccctgtccctcctggcagggcagctgtggccgtccctggctgtccccgccccgcccggcatctccttctctccccatcccctgtctagctggccccgcctctcctccctgtcttgctttagtctcatgcctttttaatgagggctcagcctcctgtgtgctgaggctcagcggcagcgcatttaattaatactctcgcatcgcagttcttcagagtaaatgctgccattttattcctcactaattggaaggggctagttaagctctgagataaatgaccctttctgctgggagtgtctcagctcagagtctccatgagagtggctggagccttggatgggaagggcaggagggctggcctgctgtgttcctcctggtccaaggggggcctctttgctaatggccagggtagagacgtggccagggtgaagcctgcctgacctttggggaggacgtgcaggtggaggctctgctgaccagcagggcttcagattcatcactgcccgttcctcatgtcccggctccaccccagccctggatgagccccagggaccccagggaaccttcagtctgggtttccagaacctttccctggcccagtctacacctgcctccctccctcactgtggaccagccccacctctaccctccatcctgtacgtctgctccactctccccaactggcgatgagtctggccagggagtctcagctggtgctggcacgctaacctcccctagacgcgtgctgaaatgtacacgtgtgtgtgtgggtgatgtatgcgatgcacatgtgggggcgtttgtgtggggcatgtgtccctcagcacacatatgctctgtgcccgctggccatccgggggacatagattacaccaacactgcagtgctgctggccacccatggtctgggcagcaggaagaggtgcaggagtccccacacagtgtcgctgggatggcctctgggtccgtgcttatagaagtctcatgagtgcaccctccgcccacctgctcgcatctctctccctccacgaggaactgtgctgtggcctcctgggtcttcaagctcctttcctgttgtgttggtgacaggaatcggggtcagaagggcagcgtccgagcaggcttggatgagatgtgtgatattgtgttaccatatcagcgactctgctagctgagtccatcttcagggacaaggatagctgtagccagacctacgcatggatttatgaggaactaccaagaaaccactgggaggaaagacgccaaagtgctgaggaaaaggatgctcagaggtggccctgctgccagctggcagagtgacaggagggctggaggctgtggggacccaggccacgtggggttggggctctgggctttgtccttgtgttcctgtaattgtctgttgctgagaattagctggaatttctttctttccttcttttgttctttccctatcctttccttcctttcctctcttctttccatcctttctcaccactgtgtattctttttaaaaaattaaatatatttcctttttttgagacagggtcttgctctctcccgggctagaaggcagtggtgcaatcgtagctccctgcaaccttgacctcctggttcatgggatcctcctgcctcagcctccaaagtagctgaaagtacaggtgtgcaccaccatgcctggctaattttttaaatttattttttgtagagatggggtctcactatgttgcccaggctgatcttgaacttctggacttaagcggttcttggcctcccaaagtgctggaattataggtgtacaccactgcgtcccgtccccacttcatgttcgacagcagttctccgtgcctgctctgccctgggccttgctggactggggttgaagaggcagccttctgttctcttggagctcacaggttcctggagggacacagcaggaaggtctcaaatgccatccctgggagtggggagggtgttctgtggggctggggagccctagggggcctaggcaggagcctgggatgcccacatgcaatgaccccctgagctgtggccgactccccagccctgctcctgagggccctgctgctctcagcatctcccagggtgtcacccttctgggttgctagatctctgctgctctggtgtggcctctgtccctgccgacccctctgagggacacagctgtcctctgctgcggtggctctggcctcggaatggggcagcctcttccctccaggcaagagcctttgaattctttgccagcaggacttcctgggctcttgtctcccgtctgctgcccggtgcccacgccccagtctgggacttggatgtctgcctgctgcctccctgtttacactgatctgatctgctctttccctctgggagcttttgaactttctctttgtctttgatgttcttaggtttcattatcgtgggtctagctatggagctttttcttatatatgtattgataaggcctctaggaacccatccatgctggaatctttcatgtaattttgttttttgaaatattccttctctcacctccccgactctcttctgggacttgcccacgtctcgcagcttttctccctgccctctgtctcttgctcctttcttagcacacagcgagagctctgtccagatcccccagttctgcggtggctgtggctgttcagttcctctgttctgctcttcggtgcagccaccaagccctctctccagtggcgtttgtgctcagcagctcctgggggcggccagttcctgtggccatctggggctgtgctttgtctctggaaggatcgttgtttcagttttcctctgcgtgccatgggcggtcctgggtacggcctctctagaacatagtacctgcgccactcagatcccagctcgtgtccccggaggtggagactgtggctggtggtgctaggagggctcatgccagcttctagctctggcttctcctcgtgagcgggacaagggagatgggaggaaagtccccagagatggcttccctcccacccaagctctgtttcctgacctgggatcctggctcccaatggtgggaaacaaaccccctttggggacacccccacttcactggcaggagtgcagtcagccctgggatcccgacatgaccttcccaaagcactgtggcctcagtgctttccagaagccaactgtggcctcagtgctttccagaagccaactgtggcctcagtgctttccagaagccaagggtatttaatcttgtccatggcgacgtggacgcgtgtcttgggaggagccctctggggtggggcagaggctgtgttaggtgggagggtctgaggcagggacccaggaggaacagaagagagagagtgagtgaggcctgctccatgcaggggcagggggaggaggaggccggggtggggccttggggattgtggggggggtgggtgtaggaatccagtaccacttccaggttccttccaggcttgaataactgggagaagggggcgtagctggctgtgattaggctctgggaggggagtcgcttaatgtcaggaaagagagttacttctaggtaggccctgggcttgaggctcccgggccatgctaagggacattcctatgtcccttgcagctcttggttgggcctggcacaaaaaagtgtgtgcccaagactcctgtctgtaggtggaggtctgctggagtagaggttgggggcactggcgggggacaggagccccacctgggtgcaggaaggctacaagggcttggtggaagagcgtggaagcccccagaatcaggggcttgtaattctggcccgtcaccctgtgggacaagcacatgggcctctgcatgctgtctcacctcatctgtaaaagggagacagtccagtgaggatgtgggcccgtgagagagagacacggcccggggggctgcagaggcaggagcgctgtgggtgggagggctgcttcctgggctctgagtacagcacggtgcatttactactcttgtctcaaaaagcagggaaaactgagtattccggccacgccacgccacgccacggggtggggaggagcctggccttgccgctccctgcactctcctctgcgctcacttagctcagagctggcggccgcccagctcccagtgagacgtggcagccaggaggctgaggcccagccaagccccagatggctggcgagaggtgcttcccccgagctgagcaagacaaggacagggccgacccggtgggaggggcaggatgggaccaggagcccgggaaatgccagtcctggccctggccctggccggtctgtgtgctcccaggctgcgcccaatccgaagcctccgtgtggatgcagagcctgaagctggaggtctgggcataggcaggggtgtggggtgtgtgaggaacccccccgccccaccatcaggttctgcctgggaactcctggtcctggagctgacacccctgctccggccaggccctcctctgtctcggtgtgagtgtgtgtgtgcacgagtgtgaatgcgtgtgcgtcccctctgctgacacccctgctccggccaggccctcctctgtctcggtgtgagtgtgtgtgtgcacgagtgtgaatgcgtgtgcgtcccctctgctgacacccctgctccggccaggccctcctctgtctcggtgtgagtgtgtgtgtgcatgagtgtgaatgcgtgtgcgtcccctctgctgacacccctgctctggccaggccctcctctgtctcggtgtgatgtgtgtgtgcatgagtgtgaatgcgtgtgcgtcccctctgctgacacccctgctctggccaggccctcctctgtctcggtgtgtgtgtgtgcatgagtgtgaatgcgtgtgcgtcccctcttcacaggccactcctgaggagggagccccggtaaggctttaggctgctggctggttctggggttgccatgaagtcctgaaatgctattctattgctgtttcttgatgtatcgggtttcgatgttgtccattgacttcctgccctggaagaggagggtttagctcactgacaacactgctgcccctcccagccccattcttctaccataattctctcaccacttttagtccatatcagagttccccattgtattggtttctgaggctgcctgcaaattactacaagcttgctggtttgaaacattagaattgtatcctctcacggttctggaggctgaaatcagtttcaacagggcaaaacgcaggtggcggcagggccgcgctccctccggagcctctaggggaggatgcgtcctgggctcttccaggtcctcgtggcagccagcagtgcttggcttgtggcctcttcgctctgggcttcagggccgacatcctccatctccctctgctctgcctgtacgtggccttctcctctgcctggctcatcttgctctgccttcctctgataaagagaagtgtgattgcatttagggcctgtcttagtccatgcaggctgctatagccaaataccataaacggagcggcttaaaagcatcggaagcttatttctcacggttctggaagctgtgcatatggttgtggtgagggtctgctccctggttcaagaaggcatcttgttgcatcctcacatgctgaaagggtgagggagctctctggggtccctctgatcggggcacaaatcccattcgtgtggatggaatctggtgacataatcacctcccaaaggccccacttcctaatatatcaccttgggggagtagctttcaacatcggaatttggggggaatataaacattctgtctatccctgggcccacccggaaaatccagcagtcactccatctcaggatccttggactcaccgcatctacaaagttcttttttgccatggaaggtaacatttatgggttccagggattgggacccggacgtgtcttcgggggccatttttcagctgaccactgccatggtcgtctgactgttatatttgcacctctgcagcttctaacattagcctggggcagagggtctagagtatgcccttagcggcacagggttcccatgccccttctccctcctccccactgctgtcatttctaccttcccttcagcaaggcagagtgttgttaaatgaaaaatgattcaatgatacttattaaagcgcggtaaggcggactttattcaggaccatggagatagacacaggaaccgctagagtgggctcttgcagtcggggagagagactgggctcaactccgaatacagcacgggcgagtggggggtgatagccaaggagcagggtaggggccaggggatggggaattactaagagcaacatcaggggtcggggattctagctaaactcacctaacatgattctagctgaagacaggctggggtgaccagacatcaccagaggggtgatggggaggacgagcctgaccagatatcaagggtgatcagatatggagagatggggcattcgtgacttagcagagttcttgataaactggatcttacaaggaagtgggcgaaggagaaggttcaggagctggactaaagtttggtcaagcaggagagtccctgtcagtgtccactgttcaggtcctttgttgtcattgaggctttgctggcaggtggatgtccctgtgattcttggcatgctgctcaccactgtctgaccctggcccattgctgtgcctctgagccaggcggcgcctgcccatgggctagagagagcagagtggaggggcatgaccctgcacaggacagagctggacgaggcccttccagagaagtggccagccagaggccagctccacctgggccaggagcgccaggccctgggggagagggatggggacgtggccttcctgttcagagggcgggggaggctcggcctcagagtgaacatctgctgaacatacgcatcctccccttatataatgctgtctggaaaaatggtttcctgttgttgttgagataggagtcaacgggccctgcactcggtgggttggggggtggggggctggggagtggagagggtggtctttggctccaacctggggtggaaaggggcggaggtccagaggacccagccggcaagtgggttggggcaggcaggggcaggtggggttgggcaccctgctgagctgctgtcctgggccatgcctccctgacccctgcagtttggccatggtctggggtggtggccctttcactgtccccaggaggactaaggccctgatgcctctgcgtccccagggcagggcagtagggcctctacacccacctttgagggaccctgggagggtctagagcagtgtgtcccagacttcaatgtcatcagaccacctgggaacttgccaaaatgcaggttttagttcagctggtctggatggggcctggattcagcatctctaacaagctcccgggggcccccaggctgctccaggccacattttgcatagccaggctctgcaccaccatccctcaccccagccgggattctagcaccggtgggtggcccagagacgccaatcagattcttctgtggacttgaacctctccttgttcctggaaatcctgagatatttaatgaccaggggagccctctggggctctctaggccatactgtaccctgcaaggcagcctatgggggggcttcggaaaggcttgtagatgcctcctgatcctccagcttggagctggggggctgagcccccaaagacaacaagaccagttctctgtctttcttcactgtgtttctgccttgtggtatgagcaaggcatgcctagatccctgcccgctgggagctgcagcctggtgggggaggagggccgtccacaggcccccacagcagacagcagagcatctcagcgcctgagcgctgtggggacatgggacgtgcagggagccctgggcaggcgtagtccggggtggtctctcctggagggtcctgggtgacaggaaggagcagtcaaggcatcaacctgggcagatccacaggacattcaggggcacccttgtctgtccccagggccgcaggctactcccaaggcctccctgacttgaaccccagaagccagagggcaggggtggggcagggaggacaggagggacatgcagtgggggcctgctgggtccagggtcctgccctgccctgaggcaaacccagggtgttttgccctcagagctcctcccctatgcattttaaatagaagaaactgaggcacggagaggtgacccacccggtcaagtggcagggccagagcctttttttttttttttttttttttttttggagactgagtcttgctgtgttgcccaggctggagtacaatggcatgatctcggctcactgcaactccgcctcccaggttcaagcgattctcctgccttagcctcctgagtagctggggttaccggtgcgtgccaccatgcgtggctattttttttgtatttttagtacagacagggtttcaccatgttagccacgatggtctctatttcctgacctcgtgacccgccccaccttggcctcccaaagtgctgggattacagtcagccccagctttctgcagtgtctggagggaccaggcttcaggcttgggggccgggctaggaagctgtgcacagttagagttgaaggtcaggtctgggtcactgttgccaggggagcaggtgtctgcagacatctgactgggatggctttggggggacatcctgtgacctgggtcccgaagaggtggcctttctccagctctatccaccaatggccccaggcctgtggccactgaaggcagaagcagtgggactgggtctgccccagtgggtgcctggctgaagtctccctgcacaacccttgggaggcatgctggctcctaactggcctctacccggggaacacagagttttcaactgaattggtgtttgcgcctctctgctgagctggcccatctctccatgtagcttcctgtggatggcgcagctgcagaactccagtccacagtcaggaggcacggggctgccagggcagcggaagagacccaagggcaggaacgcccgcctcagccctcttcgtatctttccctggacccagggcctcaccatggcctggcctgtcctcctagaagaatggctgaatgaatgggcagctgagggggatgctaaaggcagggaacagtaccccgagggcttcagtggctgtctggctcccagctggcctagctgcatcccagggcccctggggtgggaaggaagaggaggcagaggggccaggaacctgcaggagggtggggttccatggcagcccgcgccctgcttccactcaggacgccagccagattcatctgctgggacaccaccttaggaaggaggcacttctctgagaggccttgggaatttcccccaatccacatacacatgggcatcatgttgggagaaactgttttgcaaatacaattaaaaaggatcctcccaaagttttgcctagaaaaaaaaaatgaggctgtctattatgggggcctgcaggcatggtcatcgcattgcaggagctcctgtgggctctggtgcccctgcacccttgctcgtgaacagtggcggctgcccgttcctgtcctcagcctgcccaggggctgcgcggctccccttccagctggcgtgcgtgacctttccagctggcatttcgagtgctctctctgggcaccgctgagctccacggatccccaaggcggtcatttgtcagatggtcctggtgactcccgacatcccatcagcgtctcctgctgctaagacaattgtgtcagacaactctcagcgcctgtcttcccacctccaccgagcagcctgaatgctttactaactggggagaaatcagagcaccggatcctccacttaaacccctgttttctccttgttgtcgctccagaaggcggcaaacttggcccactctgcaccacagggaccttggcaaggaaaccttacaccatcctgaagtaggggaagggagcctcgggagggccggcgacctcccgtactcaactccatgcctgtgagatgccaggcactggtctggtgacgtggacccagcaaggacaactttgctctcgtaagatccctggtcagggggcagagagtgacccaataaagaacccacgtgtcgatgattgggaaatggtgttacaaaaaaataggacaggatggcagtgtggagtgtgatggagaagggacacccttcaccaaggtccttgtgaggaggcatcggagctaggacctggacttctggaagaaggccattccaggtggaggcagcagcaggtgcaaaggccctgaggcaggtgctgagttgaagtgtgccaaggacacagaggagatctccacggctggcacttgagtgaaggagaaatcagcggggaccggggcagtcatgtggtgggaagccgctggagggctttgggcaggcagtgacaggtctgagtcgtgtttcagagattctgtggggcagccgtgaggagcatagagaatgaggtcacaggcttgggacgcccgggctcccagcctggcatacgtgatggtgctattagtggatggtgcagcatgacccgggaagcccctgcgtggtggtgccccccggaccgggctgttgaatgctcatgggcagagctgcttctgtgtcatggagctgtcctggagtgctgagcagtggccacccagggttggccgggtgctcgagccctgagagggccggtggacctcctgtgggccccaggtcttgccgtccctgaaggctgaggcttgcagggtgcgatgctctcacagcactgctggggcagatggcggagcacagcagggcaggggcgcgtgggccggggcagctctgcagtgcgggccccctgtgtctgtctcatgctagcagggcgagggtctgggccgggcttaggctggctggccactgacttccccgagagattcttcttactcggctgcccctctactacgtgctggcctcacctccaaggactcaggcccagggttgatcctgccagggccacaacagatgtgggactggccctggtggccaattccccacccagcagaagactgccctgccctctcatccctcaggctgtgctcctgtcaggcctggtcctggaataagagccatgtcctcagagcctgtgggagcacttggtgctatgagactcgatctcatggagttgcttccttcctgggtgtcctttccctggttgagttcatctgcctggctctctgctggcaccgggcttggcactggagatcaaagcttcatgaggctggagcaggagggcccccgcttcccctaggctttaggggccagtcacccttcctggacatccaccttccccaggaacacgggttttggggaagctctctggggccctttcctgccctggcctgagggtctgtgctgggtgctgggtgtgtacagaggtgctgtctaggactcaacccaaggttgagtaggagtcgtgaaaatgctccttattttaggggaaaacagtttctcaggatgcggtattgtgttagctttagtttttttgtagatattcttaccaggttgagcacgtttctttctctgttagttgagagtttttaatttttagtcatgaatgaatcatatcatatggttttctctatcacttgatataagcatattttttttccttcttcagtctgttaatatgctgggttacactgacttttggatattgtgccagactctgcaaatccaggacaaacatgacttgtctgttgtgcactctgctgtttatacatggctggactagacttgccagtgttttgctgaggatttttgtgtctatgttcattgagggatattggtttataggttcatgagggatattggtttgtagggtttttttttttattgaactgtctttgtctggttttaatatcagggtaatgttgacctcataaaatgaatgggagaattggtgccattttttcctgagaggttagtagaattttccagtaaaaccgtctagacctggaaatttcttttttgcaggattttaaactatgaattctttttctttaatagttacagaactttttatgctatctactttgtcttgggtaagttttggtagcttatagtttttgaggaaatcatgcatttcttcaacactgatggatttatatgcatagaattgtttatactattccattatcttttttatggctgtgatgtcattagtgatatcctttttaaaaatattctgatactggtaattcatatttttttctgtttctcttcttcagtctcactagagatttatcagttgactgatctttacaaagaaccaaatttggtttcattgatcttctctattattttcatattttcagtttcattgatttttactcttatcatttcctcccttctacttgctttgggcttattttgctttttctatttgagcatgttttggtattcaattttaatttacctattgtgtttggttgtatatctttgtatagtgtttactggttgctccagggattataataaacctatgtaactcttcagagtctttttcaaatcaatattttaccacttcaagttgaatgttgagaccctgccatcatataggtccctctgtcctcccctgaatgttgttgtcttttatacacctacatacatggaaaactacatcagacagcattatcattcctctttaaaatacgcaagagcctaatctgttatattttttcaggtatttctgttgctcttcctttattcctgatgttcaaaatttctttctagcatcattttccccctgtctgaagaacttccttcagcaaccatcttagggtagatctgctggccacacattctataagttttgcttcatctgagaatgtctttatttctccttaattcttgaagtgtatttttgctggagatagaattctgggttgacagttctttttttttttttttcagcattttaacaatgttttgcacttcctttggacttcacagttttgataagaaatctgcagttatctgaaccatttttcccctataagtaatgcactgtttttctttgactgctttcaagacttttttttgtctatagttttcagagtgtgtttataacgtgtgggattgtgtttccttggatttctctcatttgaggtttgccgatctgttgaattggtaggtttatgcatttcacagaatttgagaagttttcagccattatttatccaaatatttgtttagtaatacattctttctcttctccttctgggacatgactgttagttagatctttcggtattttcccacagtctctaaggctcttggcattataaaatatttttactcgctgcagtttgaattgggtaacttctattgctctatcctcaagttcactgactcattcctctgtcatatccattctgctcttgagcctatccagtgagttcttaaagtttctgttattgtatttttcagttctaaaatttccgtttggtcctttttaaaaatatgtcttccgtttcttgctgagactatctttccattagttgccagagtttttgcccttactttatggagtatttttataatagctgctttaagatcattgtcagttaattccaacatatgtgctatctcagtcttgttatctgttggttgtatttgcctggaggagttgagattttcctggttcttggtatgccaagtaattttggactgtatcctggacactttgatattaccctatgagactttggatcttgtttaaatgctatggagaaggtcattatttttgtttgatcaggtaattaacccttgggttaattgggttccggctgcaagttccaatgtgcctgtggattgcggttcaatgtcaggtccattttcaaagcctgtgcagtcctattctgatcaatcccatgtaaacacaacccagtggcacgtctgggacctgggcattggtccacctcctaagtcagtccccagaacctatggcgtgttgtttagggtcagacccactcgtgcacggctcaagcacgagcccaggagtttctaaccaactttctgatgccagttccccaagctctgctgtctctgccatcttcctagccctgtccagtttcctgcggctccttgttaaatctctctggccagaaagctggggctttattgaccctgctgtcttgcacacttcctgcaactacactcctgggaggaccaaaagaggaaagagcaatggggtttcactccacctttctaggaccacagcacttccagctacacagccaggctcccctcttagagttttaggtgcctgtgggctgccatgagctggcgtgtgagaacacgaagaaaagaaaaaggaaataggaaagaaaaatgaggtgttggcttggctctgagcattcggaaatgctttttctatccttgagctacaacaacagggcttgtctcgagctctgtctgtctgtacccagtgcccgcttctggagtttgacctgccttgtatctaggctgaggaataccagagaatgaagagtaaactctgcgggtttgctgaacctcacattctagtcttcttccccaatctgcatgctgttatttattttgcagggtcctcagctagctgctcatgaatccagtgcatttgggtggctgcaggcagtgggggatgcaggtgaggcgtgctcacaccatcctactggaacctgaaccttctcctagggacctctctatgtgttgagcggtttataatcagggagggacttctaccagcagaaatacagccataggcagatccctgctgaacaggaatttcatagagagagggagggagatcctgcccccagcaattctcacaacatgcccagagcaactgacaggggaatcaggtctcttccaccctccaggggctgcccactgcacagaggagaaaatccaatctcctccccacagcagaggaagctctgtgcagtctgcccccgcccaccactctgacctcctgtaccccacccaggcccaccactctgccctcctgtaccccacccaggcccaccactctgccctcctgtccctcgcccccgcccaccctttgctctccacactccactcacattggccttcttccctttcctcaaacatggcaggtctgttctgacctcgggtcctctgcatgtgctgttctctgtgctggagcccacttccccagatctctccatcgctgcctctttccaatcatttaggcctcagctccagtgtcatctcttccaggaagtcccccgcccccctcaacaatactctgtgctgttgtcctcacggctgcgtcactctctgtcgacttcctctttgcttgcttactgccatttgcccccccgggagatagcacccagggtctgcattcagccacaggtcgcaaatgtgaatgcacctttgtggccacatctatcggtgctgctggcaaggtggaggttgggaagccggacccactgggccacaagtcctcagggctccttcctggtccagaggacccccaggaggaggcagctctgcctccgcagagaatcttgctgcagtttgggttgtccggggccttatcactcccccgcttttttttttttttttttttttttttttgagacggtcttgctctgtcgcccagagcagctgggactacaggcgccccccaccacgcccggctaatgttttatatttttttagtagagacggggtttcactgtgttagccaggatggtctccatctcctgacctcatgatccgcccacctcagcctcccaaaatgctgggattacaggcatgagccaccgcacccggccatcacccccgtctattttcatacatgcagtggggtgagaggcagaagtcccggcttctgctcctgtgtggcttcctactcactctacactccccttcctgacgctggccagaggctggcggaagggctgtgctgggccaggactggcttgcagttcctctgcagggagtcccggagcctggggcctgagggctgccttggaagggcacccaggggcgaggtgtgcaggctgactgttcccaagcagctgggggcctgccctcgctcctctcccgggcacagcacgctgtgagcggggcatcccgcacgccctgctgccaccggctctccggctgcactccttcttcacacactggatgagaggacactgctggggcagcagggcacatggtgcaggggtcctgccctcatttgtgtcttttcccagaggatgggttgtctccaagttctgcgtcaaaactgaagttcagcatacttaagcccagtggttcacaaaggagatgcttgaaacccacttctctcccccagttactcaggtgctgcccagtggagagagatctgtgcacacagccttgtctccctgcggcatctgggcgccacagggcagccctcaagagatgcccctgtcccagtgcggggctggggaggagcccagccctgtgcgagcagatccggatccaccactcattagctgtctaatcctgaaagagtcatgtcatctcttggagcctgtttcccaatctgtaaaatgggcataatgatactgagctcacttcctttgccttcattatcttattttcaatcccttgacaactctgtaaagtaggtaatattgtgccattttagacacggaaaagcagaggtcgaaagaggccaaatagccacaagtgacagagtggggatttaagtctaaagatctcaagtttcggctgggctcaattctttccttcagcccaggatgttcagggatgacagccaggctgggcccctgagcaatgccctctgctgtctttttttttttttttttcctgggggacaggagcgagcagagcctccagaacctttgcccagatcacagtaggcggttcttgcagctgggaccagttcctcccacttggacagagtgaggagtccaggcttcactgaggccaggagggggctggccgccggctccagactggggaagcctgtgtttggggcttgtgctcagtgtgtggggacatcctccggcctctgtcctgcgggacctctccgacttttaattggctttcttctggctccgcgtagatgaagagtttttgccagagccagagccataacggtttatctgtctgctggcttgcgtttctcagactgttactgaattaagttgtatgtatgaagactcttaaataaaataatatcatcgtgtttattcggagcttggccttaaagtgcacttttgagtgtgcacatcattcttcttaaaccagggcctcctttataaggggatttatcttcactttgagaaacgtctgctaaagcctgctgtgccaaagtcctcatgcttactgctagagccacagaagtgaaggggggtctggcttgtcctcaggcagctcaaagtcagggggacggggacaaaagaccagccaaaaagtgttgcaaagacatcaatgggtgctataagaggatgctattcttttgtttctttagttttccattgtttacaattaaacattattcacaacaactgacaaaacatgattcacaataatttacattattcacaattaaaaattacttttgaacatacaaaacatatggtcattatcattgaataatgtagaaaagtattaaggagaaagcaaaaaccatgaaatcctacccttttgagatagtctctgtgagagacagaataatccttctcccaaagttgtccatgtcccagtcccgagaacctgggaataaatcaggtgacatagcaggggcagtgaaggttacagatggaagtcaggttgctaattagttgacttttaagataaggagattatcctggatggcacagtgtaatggcaaggattcttctttttttttttttttttttttgagacggagtctcactctgtcgcccaggctggagtgcagtggcataatctcaggctcactgcaagctccacctcctgggtccaagtgattctcctgcctcagcctccagagtagctgggactacaggcgcctgccaccacgcctggctaattttttgtatttttagtagagacggggtttcactgtgttagccaggatggtctccatctcctgaccttgtgatccgcccgcctcagcctcccaaagtgctgggattacaggtgtgagctggccatgacaaggattcataaaagtagaagatggaggcagaagttcagagtcagagaggggtcagtagatgctccggtgctggctttgaagatggaggagggggccacaagccaaggaatgtgggtagcctctaaaagctggaaaaaaacaaggaaacattctccttagagcttccagaaggaatgcagccctccccacaccttgattttagcccagtgagacccattgtggacttcagatctctagaactgtcagataataaatgtgtgtgtgtgtgtgtgtgtgtgtgtgtgtgtgtgtgtgtttgagttggagtcttgatctgttgcccaggctggagtgctgtggtgtgatcttggctcactgcaagctccgcctcctgggttcacaccattctcctgcctcagcctcccaagtagctgggactacaggtgcccgccaccacgcctggctaattttttgtatttttagtagagatggggtttcaccgtgttggccaggatggtctccatctcctgacctcgtgattcacccaccttggcctcccaaagtgctgggattacaggcgtgagccaccgcgcctggacaaatttgtgtttttaagccactacatttgcagtaatttgttacagctatacaaactaaccgtttttccatcttgttacatatatgtcacactcagaagtgagatcttgtcactcatgctatttgtatcaacatctttaggtttatggttgctctctcttctgccctcttgactggagcactggcttcatttattttcactctggtctataattaagaaggttgtgaacttgcttctggtggtggctttggtctcatccacaggttctgatgtgctgaattctcactgtcatcattttaaaaagatttatgattttgattccagtaacttaagagctatttagaggaatgttgaaaaaacttccgagtggttggattttaggttattaagctttgcgttgattcctagtataatccaaatgttttcagaccttagcatctctgggtttaaattgggtcttgtcagcatttatatctgcatcttgccattccagtgacaccccacccctaaccagcgcagatctcagtttcctacaagggcttgtgaatgcctccccctcaacccctctagcatttctaggcatctcccagttccgtagagcccgtccacacccctcctgccacgtgtgtattctgagcatcccaggctctgcaggtgtccctccgttcaggctgccataacaaaatatcacagactgggtgtttagaaacaacagaaatttatttctcacagttttggagtctcacatgtgagatcggggcgccagtgggtttggtgtctggtgagggctgcttcctcgctcatagctggggccttcttgctgtgtttgcacacagtggagggtgcacaagctccctgggcctctctgataagggcactaatcccattaacggggtccccaccctcatgacctcatcaccttccaaaggcccgcttcacaccatcaccttgggacaggaagagctcatctccatggaggcttggcagggccaggcctgccacagagttaggagtgaaggggacagcctgggttccccgagcctcggggaatttctgaaattgcctctgtctcctggtgtttgctcagcttctatgaatgtcaggtgggcttctgaagggagcacggaatctgcgttgcagggtcactgtggcacgaggggaccctggcctctggtgctgtggaaaccggagcagctgggggcggccagagagaggctgagcaggagggtgtggaggtccccggggccctggggaggagggacagaggccatgggcattggtgcgtgggagggagcagcagaggccagcctgctgagaagggctgtgagggaagggaggtcctgtggctggaggggaagcagagtcttcttgttcaggattgaagagacccggttctgttgttgggctgagagaggactttagagaggaggaggccgaagacgcagcaggggaggcgagaagggacttgtggagagccctgagggagctggtggtgggcagtgggttgtctcggctcagagcaagagctctccgtcctctgggattatagtggagggcgttgggggcactctgccagtgacttcatcagtaggggtggggagttggcattatgccccatgatgcaagggcccaagtcaccctggagagggaagccggggtcttgagggagggtcctgggagacatggggcctcagcgtattggggaagggaacagtcaagagaaaggggcaggctgtggggagggccttctggctggacagtactagcagggagtggggcagaagggggtccccataccaacttcacctcttggttcttggtgccgagaagcagcaatctcaggtttctgcattgccaggcaggtggggtgggaggctacggctgacaggcttgggggattcaggccaggcaggcaggggaggccgggatcaatttttgtaaatgctcccccatgcttgtaaagaatactcatttgctttcggttgtaagtcgtcagatccatccagaaatcaatccggcccatttcccgagtcaatgagtctgtgcccctctgctgtggtctaggagacctgtcacccactgggagtggccgttcgcatttccctttgacagggctgttgagccacttgtgtttctaaccatggcagatgctgcggcccttggtttgtaaagcttggtgactgtgtgctttcaccaagccttgtcaatacaacaggagtttccagtcatttagtacttgctctgagttctattttgatgatactacagacaccctgctttctgggtttgcagttttctctgtctctcttttagcatgtttcaggcatgtgttacagacggcatgccttgtttgttccatctcagtctggttgatctctaactgcaatgttaaacccattgatggttgtgttagtgataccagtggcccgtccttttttcggcctgcacctttgcatctttatgcttgacttgtcccctgtccaccctgggagcaggcaggcagctggtcttcccaggcaccaccctcctgacccacagcacgcagcagcctctctctgcccgccgcctctccctcctgccctctgcccaggccgcccctggggaccttacccactgagcccatctccacctgccttgcggtccttccttatccgagtcggatgccactggtcctctttgctgtacttgctccctgcctgtaccactgtctcccgcctcctgctttccttgctgaattgctgggtccagccccatccctcctcccttactttcctgcctccgagcaggggccccagcctcgctgaaggatctacttcgacattcctgactgctggcctctgcaggcagcatccccccttgggaccttcccgctccctgctcacccacctccttgctcacccacctccccctcctccgagcacagacaggccccggcattgcccctgcccgtcccttgagctccggctgctcccgggtcccatcattgtcagcattctcagaagcacagcccctgccgccacctcctccatggctctctggcatcacccaaagcgtctgctgaggtcccacggaccacagaggtgtggatcctgtggtcattctcctgtccccacggctcaggcctcccccatcctcctgcttcaccatcactgcatcgtccgaggcaccgccagctcctcggtttgctcttcccctgggctctgcaccttggcacgtgctgtgtggctgagcaggaccctcagtctcctggaccacagccagaaaggcatttcctcctgcagtggggcgtcctgggttggaggagccttccctcctcatggcagcctccttccacagccccacctgtctccacgcctcccttgctcccagcacaggccccactagtggtttcagcggaatatggaagggcttttgaggacgtgtgtggaaggtggccttggtggctgctcctgaatcccttccagagcctccagctcctcccaccccgactctcacttgcgggactgccccagccgccatggacggggctcctctgccctgctcagaatgttctggaccagcctgggactttgtgtcctgagtctgtggtggttgcagggaactggctcacccgtgtgcttcagggtggaaattgggctggagtgtggaagtcccatcccaaaccctagagatgggaccagcacctggactatgagagtgagggctgcctggtcgggctacagggcatgtcggatcagtcaggggcctgggacacataagggatcaacagaaaggagttgacaaaggcacaactcacagagctgcgggcaggacgagggagcttgcagggcggggaggctgggggccaccacagcgggagaaataaaaccttctgtctctctccccagccctggcttcctgtcggtgccccccttcacccagggagagccaggaggagccagtccatcaggtctgcctactgggctgtaggacagggcagaaggtgaaggggtggggagcccaacagagacccgccagcccagaacatcagcctggaaggaagggacgcagggacctggttcttctctgtgtcttttcaaagccaggtttcctttctaatccagaatctatttattcagccaggcctggtgccagatgctctcaggctctgaggatgacagacaaacccagcagcctccagtagggtgctcaaggcctggttttgaagtggaaacaatgatccatgcggccagtgggaacccgccaagttccccacaggcccgttcgcctagaggcagtagttgagagcgacaggagggcctccatgccaggagtctgcacagtgactcttccttccttctttagactgcctcagaggctgtcagcatttggggtggaaaagagttgtcctgttgagtgtatacatgacctaagtctactggagactcaatgagggaattgaaggatttttcagggaaaatgttgacatttcctgctgaccctagaaagcaagcccctccgcttggccagcaggaagtttctctggcatcaggggcaggccaccttggaagctgggcacacggggcaggggccaccctgcggatgtgggtgcagccctgcggggaagctgcagtgggggcgggggcagggcttggggtggcccttccactccccaagtctgtgggtgcccaatctccagaccaccattccggacctccacaagctgcctccttgggccacgtgggtgggtcagacttgcatgggtgctcagcatccctgggtcgggttgatcctggcaccccctagggtgggtctgctgggcagccctcggagcctggacagagcttctagccatgcacccatcttccctgttcatgggattgagtcaccaaaggaagggcattcattaaaaataattggctggctggacgtgtttctgggctgtcagctctgactgtaggctgcgtgccttcatcaacatctttctcccggttcccagtcatattttttctttttgaaagtgtctttttctgttacccaggctggagtgcagtggcagcatcttagctcactgcagcttggaccttcagggtttaggtgattctcccacctcagcctcccaagtagctgggaccacaggcatgcaccaccacacccagctaatttttaaattatttgtagagatgaggcctcactatgctggtctggaactcctgggctcaagcagtcttcctgcctcggcctcccaaaagtgctgggattgcaggccccagttcccagtcattaagtggaatgtttgagatgcacaaataccttaaaacaaaaaaacaaaaaaacaaaaaaaccttggccaggtgcggtggctcacacctgtaatctcagcattttgggaagccagggcaggcggatcacagggtcaggagttcgagaccacctagccaatgtgatgaaaccccattctactaaaaaaatacaaaaaaaaaaaaaatttagctgggtgtggtggcgtgtgcctgtaatcacagctactcgggaggctgagacacgagaatcacttgaacccaggaggtggaggttgtggtgagcccagatcatgccactgcactccagcctaggcgacagagcaagattccatcttgagaaaaaaaacaaacaaacaaaaccctaccctggaatgccaactccggtgcttgtcttgggctgggatctatggggcactggcctgttctggcctagcaatgggaggctgatgtcccacgcttgtcctgggctgtggcccggaggcgttggcacactccagtccacatgggaaggccatgttccctatctgtctagctcagcgcacggctctgactcactgcagttagcagggaaaatactcttcacattgagatgtcagttttcacttcaagcctgatttctgatccataaacaaagcctgcaagaatcagaggctgctcatgtgggagtcagctaattaatctgactttcctcaaggaaggcacaggccgctgcctcttttgtgaagattagcactttttaaggacgtgtgagtctgtcaggacaaagcaacaccaataacgttccttattttcggggagcagaggaaagtggggtcagactgtcttccccgtggacaaggaggagcggcttcaggttagcacttacaccagtgctgtgagtgagaagctgtggctgtcaccaaggtgaggtcatggctgcaggaaagacgcttcccaccctctccccccaacaacagaggatgtcccaagcccaggggaccggccagcgtagctcctgacaacctctaggaaaacaggagggcttctctttggatggcaaaactgacctcaactcacttaagcagaagacaattcaaggcaggctattggggggctggggctggaggcctggaaatggggtaccttggagggccccagccaggacctcaggaagccgtctgggcagtggtctgcactccagggtggggtgggagcttggattggccctgcttacaatgggcttctctctcagatgtatcttgcaaggagagagagtcaccttgggcaagctgactcccacccacccaggccccttcctgacagtccttctaggctgttcccaaaggcatggctggctgtccctaggatacatggggccctgggcatatatttcctgcaggactcctgtctatatagacaatttgattaaaaaatttataacaagattcatgagcccacatggggaatagcaagatgtatcaaggaagatttaggggacggggaggagaagcacgaacacatttgctcactgtctgctcagtgcttgcagagaccctcgttactgctcaggctcaggagctatctcttcctgttctttatggtcgagtgtgctgtcccagctaatttcatatttatatctcccacagctggggggtaatagcaaagctgttaccgctcacaatgtgtggctctttggaacctgtttgtgtggagatgctgtatatcttcttgccccgcattccccagccccatgtatttagtgctggttgtggcatttctcctgactccgccgcttctctctgcccccgggaatgccggcttccgttgttcccttgaaggtggttaccgtgcttcattaatgatgaccaccaatgtggatcttgcccagagtgtgcaagaaaatgtgagccatacgtcctcatctggtcgtgttaaatttaatgtttgggccaggtgtggtggctcacatctgtaatcccagcattttgggagaccaaggcagtaggattacttgagcccaggagttcaacatcagccctggcaacatagcaagacctcatttctacaaatttttttttttcttttaattagctagctgttgtggcacacgtctgtggtcccagctacttgggaggctgagttgggaggatcacttgagcccagggggtccaggctgcagtgagctgtgtttgagccactgtactgcagtgggtgacacagtaagatcctgtctctaaataaataaataaataaataaatatcgtttggacctttatagcgaagggaagaaccacacatcttgcagcctcatcttccccatcagtcctgaggctgttacttctgcactcccagaattcaacctcgtttaatggtgggcacactcccgccttccacactctgccaccagcaggcagaatgacaagagaagagggatcccagttgtgacaggcattccatccctctgcagaccagcctgggaggagagcatgatgtccagcacggcttggaggcaagagaggacacgggaagggtcgtggcattgcagggcaacagcttccctctgaaagcactccaagcaggtggatgcagccagccctggaagactgcccggaaatgacacggaacctttgagggtgtgggccaccgccctgggcaccagtgacagaggcacagagtgaaggatgtctgctgccactgcccacccctgaacaccagagcccggaggtggccccacagccgatgcaggagcccacaagtgccactcaggcttgaggcttgggcagctgtatcccagagccccgcactcattctgtctgatgtgagtgggaatcctcaaaacccacgtgtcagcatcatgctggtggctcagtcccattcacacctgtgaaggaagtcccctcctggccagtgagggtggctcgctcatcaagccactcactgagacctgaagcaacctcatagtcaacagccctagagctcctggggcatccgtggccccatgcacagggcagagggttggagagtgccctgaagggaacggcagggcccacagggcggctcaggcataggccctctgcacaagagcattgctccggctacacggttctccctggtgttcctggaacacgccaggcttgcttccttctcagggcctctgtacttgctccccgatccctggaacctaccaccttctacaggacctgctccctggacactggggatgcagtgggcgcctccactccagggaaaggcagccaatgtgaagaatggaccggccagagagcactgagggaggctggggcccagttttatttttatgtgtttaaagttttaattttgaaataactttagatctatgctgtcttggaaaaattgcaagaaaagttgcaaaaatagcatagatttcctctgtgcccttcacccagcttcctccgtatgcaacgtagaacaaggactgaaaccaggaactttgtaggttgatactaagcgttggtacttagtgtcttagttttagtctattttgtgttgctataatggaatacctgagactgggtaatttataaagaaaagaagcttatttagctcatggttctgcaggctgggaagttcaagagcatggccctggcttctggtgaggcctttttgtgctgtgtcataacgtggtggagagggtcaaagggaaagcccatgtgtgcaaagaagggaaacccagggagtgtcctgcttttataacaacccaggctcgggaactaatcaagcctctccagagcaagaattcccttgctaccttgagaacagtatcaagccactcacgagggatcggcctccatgattcagatacctcaccccaggccccaccttccaacactgccacactggggaccaaatgtcaagatgagttttggtgggaacaaaccagtcacattctaaccgtagcactccagactgcactgaattttgtcagtcttccgactcatgtccgttgtctggttcaggctccccctcaggatcccacgtggcatttagttgttgtgtctctcccgtttcctcccatctgaggtttcatgacctggatgtttttgaagaggactggtcagctgttttgtagacggtgcatccccatgggtttttctggtgtgccttgtactggcttgagcttacgtgtttctggcaggactgtcacagaagcactgtgccctccgtagggcaccacgctgggactgtcacattgggatgtccagttgtctcctattgtcagtgatgcccttcttcatttggctaaggtgttacctactgggattccactggatgccccgggagctctagggctgtgactgtgaggttttttcaggtctcagatgagtggcttgatgagcaaaccactctttcactcttttttcccattgcgatgattaaatctcccgtgggtagctgctgtgacgtgatgtgagcattctgtttcttgttatccttttgctcactaattgtagcctccacggataagtcgtacctgccgcagtcctgactgtgctgttgccgatggggtttactaccatgattttctatctcatcatttcttttacatttttagttgaattaccctgtgagaaagagctgcccttcccctcccacttatttattattcagttatttgtttctaccaatactgatctgtggatatttattttattcaatgggttctaacctattactatcatttattattgtgttcaaattgccccagatttgaccaccgaaagcaccttccagctgcctcctccatcgttccgctgtgcttgggtgtgatttcacacggggcggtgggacaggccgtctctgagcagggagtgtgggtgtgagcagagccctgcaggaggggcgcagtcctgtggcagtcagaaccagctggggggctgcagcctgctctcggggaaggcctggtatgcacaaggtcagcacctggcctggagctgccacctgctcacctgtctggtttctggtgggggccctgagatcccgggcttggcactgccggagggcggggctgtgctgcggtatggatgccgtgccgtgctgtgctgtgcaggcagggttactggacataagcctggtgtggcctttcataccctggggtgccactgtctcccagtgtgacacctggtggccttgtcccttgtgaggaccaggatctgtggggcacttgatcccatgagttcagtctccccgaatctgtagtggcatccagggagggcaggtgcgcctgagcctgcctgcattctggatacggcgcctttggtcattgctggcctcgctgctccggctctccagtgggccaaccacccacagaggggcctagggccctggcggctgctgtcctggctctagaataaatacacatcccagagtcaccagtgtgggctcaccagtgctggggccctgcccccgcccctcccccggagccaccctgggtgggtggggacacgggctgggcagtgtctgaaggcctgcagagcagcctggccacagcccagacaacctggccctcagagccctggctcttcccataaataaaccagacaggatccttcgtcagatggtatggcctgatttttgttttgggaactctggacagaaggggaagcagacagcctcgggcctggcagggctgcccgcccgggagtggcagctgggcaggcgggcagaggacggtcggcggtcagcgtgccctggatagcacagtgggccccagagatcacagcaggaaaagaagcccaattcaaaggaagcaggagtgaggcagtgcacaggctctgtgtgtgcatgaggccggaggggtcctgagaggggcctgtggcccagggacccggggagatgacagcctgtgatggaaagtgaaagggggggtcctctggctgggaaaactgcctgatctgggcagctttgcacaagcagacatggaggacatgccccactgagtctcaccatcaactctcaactgcagccccctctgggggaaccgaggctttgagagaggaaaggctgatccttgttgcacagtggagtggggggactggcgttgggcgggctgcgtcccagcctgtgctctccccatgggagttcctgtctgcccctgcttctaagggggacgtccgtcgggtagtgtgtcttccccacactgctgggagccagccaggcagctgggcccttggtgggcactggtttccctctgagcacctggcccctcctggaggagcacccgctgtgggaaggagcagaccctgcctcctgggtcctcgagactggggacctgctctccgggctgagctgccacagaaagggtattggatgctgttcaaaacacgccacacatctagaattgcataccccgtcttccaacagctgcgtagactcagccttgggatcgcccagaaaattctggggtgcagtgggcatggggagtgcccccacacgggagccttagccagcctctctgcaggaatgtgagacaccagcctcagctggctccagtcgtgggctctggagcagggctcctgctggaccgtgagagagtggcctgctgctggcggaggggtcctgaggcccgtccaccacccaccggctgtgcagcattcttgtctccctgcgcctgcactcactgccccgtgtccccatgtgagaatgcccagtttagaaggaagggtgagatgggcatcccatgtggccagccctgggcgggctcctacttccctggagtggcagctttcctccatgctggatttctggcccctggggagtgatcctggcattgaccttccggcctgtccagagtggctccccaaggaacagcccgcccagctctggccaccggaccctgccagcagcctgctccgattctgtgtggacttggcgcctggaggctgttatgggctgagtgacgccctccctagatcccccagttcctttgttgaggtcctaaactcccgtagatcaggatattggctgtatttggaggcagggtctttaaagagataattaactgaaaatgaagtcactgattcaacatgaatgactggtgtcctaagaagaagcgattaggacagaagtacacacagggggacggccatgtgaggacaggggaaagatgctgtcgacaagccaaggagagaggcctcgagagaaaccgcctctgcccacaccttaattttagagctctagcctccaggactgtgagagaataggttctgctattcaagccccggcctgtgctgccctgtgatggctgcccgagcaacctagggaaggcgccggccccgaccttttgtgggagggggtgctggcagtctacctgggcagcatctcctggtggatgtgggtgagcctgctgtgaatgctgggggacggtcctgggtccccaggccctcagttcttggagtgcagccttgcagggtttggttgctctccagggtgggtcccctggggaatctggtaaggaagcatatgttggcaactcccagacatgtgcccctgccaccccagccccctgagcagacagacccaccgtgccggctctgtctctgggagtgctggtgctcaggcgtgctggtctcccgggctggttggaggaagggaggggcggtgtgtgcagacctccaaggaggcagggaggctggcagggaacagctgtgcaaaggtgttaggttccagctggtgtgggcaggtgccagcccagggaagggcctgtcgacagggtcttttttttttttttttttttttgagacaagagtctctcactctgtagcccaagctggagtgcagcggtgcgatcttagctcattgcaacctccgccttctgggctcaagcgattctcatgcctcagcctcccgagtagctgggactacagacgcccaccaccatgtcccgctaatttgttgtattttggtagagacagggtttcaccatgttgcccaggatggtctcaaactcctgacctcaggtgatccgcctgcctcggcctcccaaagtgctaggattataggcgtgagccaccgtgcccggcctgttggcaggatcttgaatggggaagttggaccttattccatgagctctcctccaccacacgtctcaaggccacaatctgctgtggtccagctggtgagacatggaagctcagaaagaaaaatcttgctttttgatagtttggcaaatgttcctgcagcacgagtcatttttcttctttagtagagagcgccctgttatttatgtgaatgttaatttgtgactggggacgttccccgacgtgggcttcatgctgaacgagacctgggaaatgtcagccagagaatctggccgggacgagtgtcagttctcgtcacaaataggcaggcctgttgcagtcccagagtctgggtctgacccactgacctctgtgtcctggctgggtctggctggccagctctgtttcctggaggctaccccggcattggtgtgtgcaggagccatggagatgggggagctggctgcagagggctgagtgtgggacattctggacaggccaggtcccgagggagccactcaagcgttgcttgatttagcagaaggccgcctggctggcccctgcgctggccccgtgaggcattcttgtcggcatcttgtttattccattttcccccttatctttctctctgtgctctccccctttccgtctctcctgtcttcacatgaattgtctgttttgctatatgccctttgtaaaaatgtaaaacaaaaaaaatacagaaaatattaataaaaagtgaaactcacccccgatcgtaacactgctgaccctttgttacgcgtttcctaacagctgtcatgccatgatcatcatgatggtgatggtgctgccagtcggctgatttatcacgtgctgtgcccagtgctagagacgcggtatctcgcttagccctcacatcagccatggaaaccctgttattatctccattcaaccctgcagacactgtccacagagaggccactcagtcagaggtgaagtaaacatttgaatcgaggcagagtgactcggaggccacatgcttaattattagactgtgctgacgtttggcacagagatatacatgattttacgtaaggaggtcatgctgcagctgggcttgccgccttcttcggtcaccaatatgtcatgggtgtgtctgttccttaagtggtcaaaaaatctgagaaactcttttagcctagcataaatctgtaaattttgtaaaattattttgcagggcatagagtgttattgaaataatctgactggctgggaacggtggttcacacctgtaatcccagcactttgggaggccgaggtgggcggatcacctgaggtcaggagttcgagaccagcctggccaacatggcgaaaccccgtctctactaaaaatgcaaaaattagccaggcatggtgttgtgcacctgtaatcccagctacttgggaggctgaggcaggagaattgcttgaacctgggaggcagaggtctcagtgaactgagctcaggccactgtactccactccagcctgggtgacagaacaagacactgtctccaaaataataataataataatctgaccatttattgtttttgttgtctgtttttgtttgtttgtttgtttttgagatggagtctcactctgttgcccagaatggagtgcagtgatgcaatctcggctcactgcaacctcagcctcctgggttcaagcaattctcctgcctcagcctcccaagcagctgggaccacaggcgcgtaccaccaagcccggctaatttttgggtttttagtagagacggggtttcaccatattggccaggctggtcttgaactcctggccttgtgatccattcgcctcgtcctcccaaagtgctgggattatggacgtgagccactgcgcccggttggattttgggtttttttgagacagggtatctctctgtctcccaggctggagtctccaaaataataataataataataatctgaccatttattgttttgttttgtttgtttagttttaggttttggtttttttgagtcagggtctgtctctgtctcccaggctggagtgcagtgacatgatctcggctcactgtaactctgcctcctgggttcaagtgattctcccgcctcagcctcctgagtagctgggattacaggtgtgcaccaccacgtctggctaattttgtatttttaggacagatggggtttcaccatgttggccagcctggtctcaaattcctaactgcctcagcctcccagagttctgggatcacatcatgcccagcctacatttattgttatatatttgttcttacttctgtcatctaatttatgttttctgtttttctggatttttttttttttttttttttttgctgtttttctagtctaccatattttctatatggtctgccttcagtcatttggaaggtatacattagttttactagttgtgacttttctaattttgagtagaattcttcagcttgtatctactgattttagaaacttaccagtaactgttgatgctaactgaagattctgaagattaggaaacgagtgcaattaaactgtaattccttttttcttcctctactctttgtctgattgttgtgggcttgtttggcaattttttgcctgcccccatttattaaagttaaattatgaatagtttatatattacatagctttttttttccagaatatatgctaaatgtcttctgatttgtaaccctcattatccctgtagcatagatgcagagggcaattccgctatttcgacctgtgatttccccacttgccaggtgtctcagttttaaagtcaagtccaggctgcgtaaagtggcaggtggggggtgctggggagggatgccaagcagaactgagacagacgctctcgagggcattctctagcagcagggttgaagccatccctctgtgcaccctctcccagggcccagagttgctcacagtggctcacctggttagttgatagacttagggctcccatctcaagatgacatggttttaccgtgttagccaggatggtctcaatctcctgacctcgtgatccgcctgcctcagcctcccaaagtgctgggattacagggtgtgagccaccatgcctgaccaagcccttggtttctaatgcagagtttctttgtaggccaatgtttcctaaacattggcctaggaggtgaactaatgggtaccaaacatgactccagaatgcatttaattctatcaaatcccagctagctttgtggcagaaattgacaagctgatcctaaaattcatacagaaatacaagggatccagactaaccaaaatgctattgaggagaagaacagaggaagggctcatgctttgtaattctaagacttactacaaagctgtagtaatcaagactgtgtggtgttggcagaaggatagacatatagattggtagaatagaactgagagtttggaaatacatcctcatattgattcttgacaaaggtccaagacaagtcagtgggggaaagaatggtcttttcaacaaatggtgttggcacacctggatatccacatatggaaaaatgaagttggaccccttcctcacaccatacacaaatattaactgtaaatggatggatcatagatctacatgtaagagctaaaactatagaactcttaaataatgtaggagtaaatctttgttactttggattaggcaaagtcttagatatgacaccagaagcacaagtggacaaaagaaaaaaataggtgaactggacttcaagaaagtccttcatgacttcagtggacactaataagaaagttgaaaagacagcccacagaacaagagaaaatattcataaattgtatatctaataagggatttgtgtctagaatatataaagagctcttacaggtcaataaaaagaaaatggtcttattaaaaatagggaaagtatctgaatggatgtttctccaaagttaaataaatgacctataagctcatgaaaagatgcttagcatcattagttgtcagggaaatgcaagccgaagcatgatgggacaccacttcacacctgctggatagctagagtcaaagagcctaagaataatgagtattggtggggatgaggggaaattgaaccctcacacactgctgggggcactgagaatggtccagcccctgtagaggacagtctggcacagttactgtatgacccagtaattccactttgagaggaatgaaaacacatgtccacacaaaaacttgtccacagatgttcatagcagcattatgcataggagccaaaaaccaacaacccacatgtccatcaactggcaaatggataaataaaatgtggtatatacatgtgatggggtattatttgacaataaaagaggaatgaaatactgctatatgctacaccatggatgaaccttgaaaacatactaagtgaaggaagccagtcacaaaaggccacatagcatgtgattccacgtatatgaaatgtccagaataggccaattcatagagacagaatgtagattagtggttgcccagggctgggttggggaggagaggttggggaaaacatggggagtgactgccaatgtgtacggggtttctttttggggtgatgaaaatgttctaaaatcaatagtggttatggttgaattgttcactttcagcatatagtttagatggctgagatgtatggaatggtaatcacagcaccataaagctgttatatattaaaaagcattgaactggccgggcgccatggcttatgcctgtaatcccagcactttgtgaggccgaggcaggtggatcacctgaggtcaggagtttgagaccagcctggccaacatggtgaaaccccatctctactagaaatacaaaaattagctggatgtggtggtgtgtaccagtaatcccagttacttgggaggctgaggcaggagaatcgcttaaaaatgggaggcagagtttgcagtgagctgaggttgtgccactgcactccagcctgggtgacagagcgagactctgtctcaaaaaaagaagaaaaaaagcattgaactttataatgaaaaatgattcccttttcagttgcattttaaactctctggttgagtcgaggggagtctcagtttggtgctgacagatctttaccagctctctgctacttactgacctctataacaagagagaagggcagtggtgtaggctttgaggtgcaaatagaagcccggagagagaggaagacactgggggtgcgcccagggacagagggctgctgggaccccatggaaggccttgcgtgccatgggacggccttggcctttattttacaggagtgggtttctggtttttggtttggttctttctccttggtcctagtagagttttagaaggatgatcggtacctgccaacgtgtgcggggtttctttttggggtgatgaataaacaggataagcagtaattcataggttacgtagtccagctcctcagtttgcagatgagggaactgggggcctgcaagggggcaggactggccatgaccgcattggaaaccagggcccctggctcagcgtccagtgcttactctccctgcctgcctcgccccccaccctgcccttcaaagtggagtctagctttccttagagcctcgctgggcatgtgactgtcggggctccttggtcctgttggaaattggctccggccagcttaggccaaaaaagagactttctggagtaaaggtctgtagggcctgaaaccaggtccagggaaggttagagtggccaagcaaagtcatcaggttctgtggagctcagaggcaactctgttgtggtcactgtgctcagcagaaccctggaaggcccagctccagccatagctccaagacagagccctagacaaggggtcgctctccaagaggaaggacgggagtggctggcacctggcgaggatcccatgagacagaggaggagctggtggagatgcgggtgaggacagctgtttcctaaccccatggacagctcctgcccgctggcgtcccttttggaaaagtggaaaagtcagtgtgtgaaatcctctgggatgctgaactgtaaaggagcccccagtggtgaggaccgagtggctcaaatcccactcgatacttcccactcctgggactgtccagtggtgaggacggagtggctcaaatcccactcaatgacacttcccactcctgggactgttcagtagtgaggggtccagcccccttccctgaaagctcccaaggttgttagagacctccctggggagctgggagaggcaagagagtgcccgagcaggctctgagaggaggcgccctgggaactgcaggcactgtgcagctctccctgtgagaccgtcattccaccaggcagctgtcacagcaggggaggctgcctggccattgccccgttgtccagcagatctcccaggttcattaccaaaaggaagatggggagaaagaatcttggagttagaatactttcaggaatgggaatcttagcagatgccagcatctgggggactcttggcaaggtgcgtgctgtgtgtgtatttcggagggaggtgagtttgagggcaacagggacttgcagccttgtcccttggcaaagtctgggtccctctgtgcatggacctgtgtgcttcctatgctttgtgccttctatgcttgattgttgccactgcaaccttggcacacacctgacagtgtttatgctggaggttgacagggttgagtgacagaccaggtcccagtcatacacaggtggggggctgctgatggctgcagctgtggcttccatgggaaggggcagtgggaaccagccagcctgggtgctctgcagaaggaaacaggatgcatgcttgtgtttcctgtgaacccctaacttccaggctgtctgtggttgaatacttaaaaattcagagtaatagaggagagctgttaagcctttggatctttataaatttttaacatctagttgccatttctagtaactactttaccatcaatccaactgcaaaggagcaggttctatagaaggaagaggcagggcaggcgttgtgtaactcaccaggatctgaatgccggcaacttgacttgatgacccgggtactaccaggctctgggcccctgcggtggcacctgaaggtcagggacagagccctccccatgatcctctctctgtcccccaggggagaacctggctgggtttgccagacatccacagacttcaagagcagagcgggactcacacttagagccaggtcggggtaccaacctttctgtaagaccccaggctggacagctgtggggttggacagacaggccaccagcaggctcccaactgagtgcttttcagcctagtgtgcttctggagtttctttaatatttattgagtggggagaggaaactgattctaattaataaaaattacatgtaaaaacagatacacttgacactggcagcaggaaaatcaaagtcccggaaaaaaatgcagcaaaacatagctcacattttgtgctttgctctcctgtcaattttcttctgtgtgttttagacagatcattcctgggatgcatatactgaagtgtttgaaaatcagggaataaaatgatctccacttcttccgtgaagtgccccccgccccgagcattattctggccagcggtcttggcaggacgtcagctgatggtcctgggggggtcagcctttggtctcgggggggtcagcctttggtctcgcggggggtcagcctttggtctcgggggcggtcagcctttggtctcgggggcggtcagcctttggtctcgggggggtcagcctttggtctcgggggggtcagcctttggtctcgggggggtgtcagcctttggtctcacgggggggtcagcctttggtctcagggggggtcagcctttggtctcggggggggttcagcctttggtctcggggggggtcagcctttggtctcgcgggggggtcagcctttggtctcgggggcggtcagcctttggtctcggggggtgtcagcctttggtctcgggggggttcagcctttggtctcgcgggggggtcagcctttggtctcgggggtgtcagcctttggtctctggggggtgtcagcctttggtctcgggggggtcagcctttggtctctggggggtgtcagcctttggtctcgggtggggggtcagcctttggtctcgcgggggggtcagcctttggtctcgggggggtcagcctttggtctctggggggtgtcagcctttggtctcgggtggggggtcagcctttggtctcgggggggggggtcagcctttggtctcgggggcggtcagcctttggtctcgcggggggtcagcctttggtctcggggggggggtcagcctttggtctcgggggggtcagccctttggtctcggggcaggtgccaccatgttcatcgtccagcatgcgttgtgcgcatcgcacggtggtcaacagagacgggcggggctgtgaggagcatgttgaacgtctgtgttggagaatgccaccgcttggaggcttctggctgtgtgaggaagcctgagcccaggccctgcttcagatggaccccagtgtgctcctgtgccctccgaggagtcgcctgcaggggtgcccttccaggaggcaaggcccagggcagcatcagatggagctagtgctgttggctcagcccagtgattgtcctcagggaggcagccagggaggggagcctgacccctgctggtcagggagaccccaaactgtcccccgggttactccggccagagagtactgcccttccccaggctgagcctggcctcattgtcacactaggtccctccagaataaccccagggcctcaggcctgtggcatcgatggctcccgacctgggctgcaagttcccccagaagatggagctgccataaggggtcctcatgccccagtgtcctgccctaattggctcaatcggcccagtctggcccagggacctgtctgggagatgccctttccgtgtaggtgtgagttctgatccctagaacctgtgtgtccccagcagcctgtctgcccatctaggcctcggtttcctcatttggaaagcaagctggctggatgaaatcacttgggtggaggcgtggcctggttctcagtgtctcccaggctgcatgtgctcctgtgtgagtgtgcacgggaaatgaccggcctcatgtacagacgagtcactggacgcttggggagcttgacaccttgcctgaggtcacctggccagatagaaagggtgccaggaagtcagaacttcacgctccaggacagcttgcccgctgccgccccccagggttaattcctgcacttcatccaatgagtttcagtcataagatggatttgaggcaccagccttctccacaccacgcaccgggaccatcagtgctggaccctcccaactcctgcactggtaaacacactgcccctgtgccagtggacaggcctggctgtgttcttcccgcctgcctgctcggtgcctcccttgggggacgtggcctgcagctttggggtcatcggttcgctcattccacaggcatctgctgagtcttcgccaggcctggttgagccctgagacccagggatgagtcagaagcgtggggcctgcagggttcccaccccctcttccgctctcctcccacagccctgctgacctccttctccgacctcggtcttgccctggtaactctggttaccactgcctcctaggcctcttccccagaagcccaggatgcctgagcccagagggtcctgcgccccttgcccttcttctcatgcccctcggagaatggcacccactttgccggccacccaccaggaccctgaattacttttctgcggctgctgtaaggaaccacttaaaacagcaggaattcgttctctcacagttctgaggccggacgtccgaagtcggtataacctgacccaaatccaggcatcggcagggctgcgctccctctggagactctgggggaggacactttctggcctctgccagctcctgggggctgccagcattccttggcttgaggccacatcgctccaatctccaaagctggcatctggcatcctccctgtctgcccatggcctcgtcctctgcgcatctgcctaatccccctccactccccggcataaggaagtgggcaaggactgcattcagggcccagccagccccagagctgacctgatcacacccgcagagtctctttccaccatgtccactaccctcacagctgccagggatgggggcctgggtaactttgggggccggttcttcagccacagacctggaagcccaccaggtgcttcctcctccctcccatctcagccggctctaccctaccacgtcctgtccatttcgctcctcacctccttcatacctgccactcgtccttgtctctcatgctcccgtctggaccattacccctctcccaggtgcctgtaacaccttctccccaggaccccagacccatttttgttccgcagcccattccccctgccgcagccaccatgcttctgaactggaatcagatcaaggctccccccagaagccctgggctgcctacaatctccctcaccagccccctgagtgatgggccaccgggcaccgtgcccttgatgctcctgtccacccacctggtcagctcttcccaccagctgtgctccgtccacctccccggccatggcatgtgcggtttcccccatatggagcactggtcctctctctgactctttgcctggccagcacaaagggattgggtgggtttgggtagatgtcacctcctgccggaggcatccttcattctggagccaggcctgatgctgggctctgtgttcctccaggccctgcacctccaccagcccctgcctggcacatcagcttcccgagggcccaggctgagtgcgccgggaggcatctccagcctccctcgctacacttgaggctaggggcagccgcccagcaggccctggggggcactgactgcatctcggtctgcagaggctcccagccagcaacaggatggggctcaccgagcacctggggtcagggagaaggaggggcagcccgtgcgccaccgtgcccccccacaaccaagatgatgatatggcagaggccatcatgaggttactttggggggggtgtggtttccgcacatccagatggcaggtgccgggggctgcccaccagagggcacactcctaactggacaggggaccccggccagcgccagctaagctggagtgtcgatgggtgctggaaatgccagcttttctgattttcaagagagtctggaaatctggtcgtttatgtgaactctcctgtttcttaagtttggcaacaaattcaagcttttaaaatcccctgcatgggtcataagcttgtgatctgaaggaaacactctgaaggctggacacagtgtgcacttccagtgtgagaccttggtttatggataatggaccagaagataaaagtgtaggagctggagttgtcatgggatgggtggacctgatggtgccagcaggctggatggcagggtatggcaggggagggcagggtatggcaggggagggcaggctggatggcaggggagggcaggagacgtgaggggggctgaatcaggccttgaagggggaacacaggtttaccagatggccgagctggggatggggtggtggggtgggagaatggggattcctgagttggcagcatggggttcaggggctgggtggctcggcagggtgcacccagcccagtgagaagcatggggtggtgcaagccgcggtctgggagggtggggcaggccaagagcctgaatgccagcatatagagcagcctgagtcccaacggaaatgaggacccagcgaggagtttgtagtcagggagggtgctggctggcctagggggtcaggggcagcagttcagctgcctgtagagtctgggctggtggctgacacagagagcaggagagacagttggggggcagtagggactggagccagttgcaggggcatgtgttccatccaagacccgctgtggtcagggcctgcgtttccaaggaaagctgggattccatgttcaagacatgaaatctcatcattctgagtgttagcttcagagctttaaaaatattgtttggcccagatggaacatgtgtgtgggcagattcaatccccggctggctgttttgacctttgtcttggactctgggctcctgggagtgggggcagcacttggcccatattgatgcactttggtggatgccctcctggggacacgcacaggcccacagctgcccttgaatgtctccctgcttctctggacggttttgactttataaacacagtaacttttctgaaagcagacagggttggtgtataggggtggagatgacccagacagaggcccctttcctagacagggtgggcggcggggggcggcctctgggaccacatgttcataccctccggccagcccagggttcaagctgagcaccagctggggtgctgggcagggtcttcaggtgggaggtactccctgagggggtctcctcgctgttccccttccttggtcttttgtgtgctggaaatctgatcctgttgtctttgtcccgcaggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggtgaggctactgcaggtgggcaggctgtgtggagagccctctgaggccctggtccccaggggagcatcccagagactcaggcagctctccacagaccagcttggctgctgaggctgagccccggtctcagtggctcagaaatgggccagctgcctggctgacggcagggcgtagcagggctgctggggctggggcctctgttctgggtgcatgtgggtgacaagcagcccagacacctctgccttcatgtctggggcctccatggtggactatgaaggctgtccaagggcccatcttctgttgcctaaaggcaagcaagtgtcgtggagcggggcgggggcccccggccaggcctgagtccagtgcctgcgtctctgagtctgtgcctgtgaagaggcctccagagccccagacagcgcctctcctgctctgtgctgccatggtccctgggagggtgcctgtggtaggtcccaaccctcacctggctgctcagggagaaaggccctgcatgctctttctggatccctggaggcatgtgccctacaaggactctggaggtgctcccagcagcctcagcagtctctgcacagactcatgggcgtctgtctttttcaactcagaacccacgtgtgccctgggcccagaaacgtgaaaggagctgccaggcggccatggtgacagtccatgactgtcgcctcagatctggcctcactgtgccagcccacacctcccagcatcccccagtctctggtcctggattgtggtgaagccagggttggtgtctgatgtggttctgcaggcccatagttctcagggtcccccgtgtggtcagggactcctggcctgtgcttggctcttgctgggagagtgggaagctgcgagctcagccctcagcctctggtcaggacccctgggtgaggagagtctggagtctggggcccaggatcgggcacacctgcacgttcacagcgagtgctccaggggcctgggctgggccagcccccgtgctgtgatttactaaggtactcccgtcactccatagcagccccgcctcatttactgtaggtctgtctgacttcctagcttgacagaaaaattgggtacagcctggcaggcatacttctaatttcatgaaacggcatcagatacctttgcaaaggaattgttccatcaggaagcccaatgtactctggagccaatcagtgcaaccggtggccccttgttccttggtgacaaatcagcgtctgctatgctgcagacagccgggccactgggtactgcctgcccagccttttccagctgtggtctcagcctcgacttatccccacccttggactattttgcagggaaggaaggaggagtaatctaggagggccagcgtggaaggggctgagcgagtgctccagacccgggggcagggccccagctttgctccttgctagctagctgctgtcgggcaagcccagtggcattagcaacccctgtgtccccgagagctcaggggctggtcacttgtgctgtgggcttggtgcttctggctggcctctcctggaagattcagggtggttctgggggcctctgctcaggcgaggtgagctggccacgtgcccttggccatgtctctgatcccagattccatatggtgcttgtcttcctgaacatggcagcccttcccccacagcctggccggccttgccttattttctgggcttctgctggtgtttggcatcttctgctgaatcctccctccacccccacccccaatccacatatctttaatgagaacttgaaattcagaacacaggaaaggaatttcaatctcagaataagcccagaaaccattggccttagaagacgctgggtgaggccagctgccaggtcaggggtgaggctgggctggaaggtgggggtttggtaatgggctgtcggggaggaggtgagcctgtccagccttagctccaggcctggggcccaggctgtggatgtgagcgtgggcctggggctataggtctggatcccagaacttggggctggggccaagtcccctttgcttgatgttcctgtctggtgtcagcagaccctgcatgaggggctcgggccttcagtgagctagctcccacgccatgcacctaatcgttcccacgtggccctgggctgagatcgacacactgactggaagggcaccaggcccagtgagtgccggagctgggtggagggcccacggtgacctcaggcgtccagctttccatctgcctgggccttttcagggcccagagtggcaactgggagatacataaaagctgtgtcctgtggccaggcatagtgaggggcacagcctgcctggcacacaactccaggacctgggtgcgggtgtgtgtgtatgtgtgtgtgtgtataggggaccctttcttccagtgaattctgagggaaccctgatatatcagtgtggccctggcagaagctggcaggaggtgctggctggcagtttcttcctgcctccccaaaagcaacgtctggaagtgggtgtgaagcaccctgctatttatgttctgccggggaaggtgacacacctgccctgggtgtcccagtggggggtgggcatctgtctgggtggcaggatatccctgcagcgtcaggggtgcctccttttcaggatgtcctgttttccccgagaagcccacgggctgctcagggtgatctcggggactcatggagcctcagggaatcattttcactaatagtctctgtcatccaagatcagttgctggattgcagattgcctgggggaaacggatagaaaatgacggttttaaagcatttcacagacaggccagggatgagtgtgtgcactgggcagcttaggcaacacccgggagaggatgttattaggaggggcaaggggtgagggagcggggagggtccttttctctcctccctggccatgctggccttggcagaagggtcctgctcagtgctgctggcctgggaacctggccaggaccggaggccgagctctgaggctgggtggccttttggggagcagtggttgaggtgtccccccaggcattctgacaggcatctccaatccctgttctctgcccttcccaaggccagctctgtgtccagggacactgtgctggggtacagggacagggcaccctgtggcattgtcctctctggtgtgtgtgcatctcatcctgtgtgggactgttgaggagggagtcctcacggagcttgaaacaataggaacattgatatggtttgtctctgtgtctccacctgaatctcatcttgtagctcccataattcccatgtgttatgggagggacccagtgagagatgattgaatcatgggggtgggtctttcccatgctgttctcatgatggtgagtgggtctcacgagatctgagggttttaaaaacgggagttgccctgcacaagctctctctctctcggctgctgccatgtgagacgtgcctttcatcttctgccatgattgtgaggcctccccagccatgtggaactgtaagtccaataaacctctttcttttgtaagttgcccagtctcgggtatgtctttatcagcattgtgaaaacggactaatacaaatgcctctctcacagctctgtgggccagaagtctgaaatgaatctcactgagccaagatcaagggtggacagggctgtgctccctccagaggctccaggggagaatctgtttctggcccatccccgctcctgggggctgccagcctcccttggcttgtggctgcatcatgccaatctctgcccccgggtcatgtcgccccctcctcttctgacgtgtccctgtgcttccctcttgcaaggatgccttgattacatttaggactcacccgagtaatccaggacaggcttctcatctcaagagccttactgcaagcacatctgcaaagccctttcttcccatagaaggtacccgtctcaggttgcagggatcaggatccagcatctttgggggcaccatgcagccagctacaggatgtgaatggccctcacgtacaaggctggccatgcagtgcacagcacacccgggaggcgcccgtctgggtcacgcggaggagcagcactgtaggcttcacttaggcctccccagggcatatagcccagaggcacagcccaggcaggccctggtcctgctgcctccctcactggaccctccaccctgtcgtgtgggagctcttccctgcatgtctaagtgccagtctcagcctggcagtcctcccccaccgcccgcgttaagggacctggagcggctgactccaagaccacgtgcacagagaagccaaccctgtgctgacactgagggcctgtcttagcttcccagagactgaccttgggactctgtgaaggttgccacacagtgagaaagaccccgagtcacgtgttgagcatgtggtctctgtttcagacacacagtgccatttgcagaaagacaagagctgcaaactcagagcctgcagggcctggcaggcaatgccaacaaggacagcagtggaggaaaaaaagataattgcacccacccttggcctggctttcatttctctccttttgatggaaacgtggagaccaagaatacatctccactaaaaagaaacagcagtgggaatgcagccacacgtggtgtccagccctggccttgccatgggcacagggcgtctgggaggccctgcaaggagggacagaccctcctcaactcccttgacctcaatttggtagaagttgggtctggtgcagctgaacatcctatcaagaaaatccagacatcagactttttatgtgaactttcctgatgttaaaatgtggcttaaaatttctggaatgagaggatgaactgagaaggctccaggaatccagccacggcgctgagctcagtgagtcggcaacagctggcttggcagggcccaggccgacccgggtacgagagacagcccctatcaccatgcgaaaggaccaggcctcaggggtctggggagtcactcaggaagtgcctggttggagacacagagacaggtcctggcacaaggacgctggccaggtccagggctcagccagcaaatccagacaaagccctctttccacagaagcctccacatcagctctctgcctccagccctgggccctgcacacccagtgggagctgtcatgcctggggtcccctcccgtgctcactatatagaccaaacaaaacacggtcccccattggctacccatgctttctgtgatgcagaggtagaagcatcttctgccctcctctgtgggctgctctcctggggctcgccccggcctggccttgggacagaggaggggcaggtgcttcccatcctggggaactgctaccaggctgctgtgcacacaccctgctgggctgaaggaagagaagtcagacagcaacgtgccagtgaccttggctgcctccaccccagacaccgccggtgccaagcctctgcctgctgctgtcaggctgcagcatcctccctgacgggcagacgaggcacgccaccacgggagcctctcagcctcgctgcaccaaggaaggccctccaggagacagaggacaagcgccggcactgggcagctcctccatgtggctgagcgtggctgccacctgcagcccacagccagcccttccccaccaggccaggaagagcccctcctgacccacagtctccaccctgtgactttgccttgagttgggtaggagttttccaggccgcaggggatcctgggggaagagtgggcggcgggggtgggggcggacctcaggcatgacagttccccctgggtgtgcagagcccagggctggaggcagagagctgtggggcagcctccatggaagcagcagccttgaatgacccaaggtggggatggcgccctccagtctcacaaagagttgagtgtttcagcaagctcgtactggttgcagtgtgagggaggctggtgggggaggctggagcaatggcacaggagagagagaggagctctgttctgtcagaccacaggactggggagcaggcgagactcatccattcagtggcgagcagatagccagccccactgacacagcggatgtgaggcttggcccaggtgggggctggggggcccaggatggggcaggagggccgtgtgctttgttggggggtgccaatttgctgaatgccaggtcagagagcctttctgccctgtagctgtcgacgtccatctcagcttcctgtggctgctgtaccaggttacccacaccttaatggcttaaaacagcacacctgcattcctcacagttcgggagctcagaactctgaaataggattttaggggctaagatcaaggtgctggcagggctggttccttcgggaggccccagggcagaatccattcctggcccctcccagctcctgggggctgttggcgttccttggcttgtggcaacattgctgcagtctctgcctccctggtcacgtggcttctcctcttctatagccagctctccctcttagaaggacacttgtgataacatttagggcccgctgggaccatccaggttactttccccatctcaagacccctgatttaaacacatttgcaaagtctcttctgccatataaggtaatgctcacgagttttgggggattaggacatggacgtccgggggtcatgattcagctgacatgtctaagtgttgaaccttgggtcctaagggagaatggagagagggctttggctggatttgcagggtgagccctggacctggccagcgtcttgtgcccagacctgtctctgtgtctccaaccgggcacttcccaagtgactccccagacccctgaggccagggcctctggcgtggtgataggtgctctctctcataccctggtcagcctgggccctgccaagccactgttgccgactcactgagttcagcgcctcggcgctggatccctggagtcttctcagctcatcctctctttccaccctggagctgagcctgcagcccaggccccgggaaacccagggagaagcactgattgtgaaacccgaggcggctccgggaggcgtgcttcagggctgagcgcacccttggcagacgccgcggcgctcctgtcctcgtgcagaccgggcccttgggatggctgttggagatgccagcgcggtgatgtggcccacgcggaaggggtgggcgggggccggcgctgggaaagccgaggctgcacattctccgaggctggagttgcctggggtcagccggggagagcaggaggggccagctcccgggcctggctggctctctggctggagtctgctgctcagagcgctgccctgtgggtgcttcccaccccctgggctgtgaaggcagaagcgaggcttgcagccccagcgagggctgggccccccttattccacagtggagacgtgccagggtgtgctccccctccacggcgtctgggcctggcactccgcctgacagcccccacgtgcgcagcaactcccctgtgcctccgacataaatttagtccctgagtctcaggcttgcccttcccccgccacctctcccctcccgacatggtttctggttcaggggtggagccgaccaggtaaatgtggctggcaagggcctggatctttggtggagcaccgtgggcaggtgacaagcctgacccggaggatggtggccttggccctggcttggctgcagccccaactcgagtgcaggggacagttctggaagaccggccagtggttctgaggagctgcattagggctgctcccacagatgcttccagcactaggtgggtgagtggggtgggcagcgggcagtttggtgcagggttcagtgtgctcagccccacccggcatgctgctgttggtgcaggggtcagtgtgctcagccccgcccggcatgctgctgttggtgcaggggtcagcgctggtgcaggggtcagcgcgctcagctccgcccagcatgctgctgttggtgcaggggtcagtgtgctcagctccacccgacatgctgttgttctggctcactaaggggcccagagcagctcacccagcccctcaggatctcagaacctgggtgctgagatctccactgtacctgggtgcagtggcacaggggctgctggaattacgcagggcacagggcgcctgcccagtgctcactgcgacacttgctctccgtcccctttccctcctctgcctcgccatcttccacagacacagtgaattgatactttctttccttcccttggatctgtgttgggaatgtcctccaaagagcttttcgggttttgcacaaggtaacagtccctggcatgcagacagtacacggctcaggggtgaagctgtgatctgctcacgggggcatctggcgtttgatcagcaactgtgggctgggcatgccccctcttttcaggtccccagcatggcagaggcaggcttctgggagagaggcatgtgtccagggcatcttttcatgtctgtgacatctgtgccttggatgtaggagcctgctggctggggtgaagtttgggcaaggagcagtgggacctgcttgggacccaggtgaggcttccttcatgccctggctgccccatggatgacggtgaaagagacatgggcaccctgcataatggggacaaagggactgcatcccatagtgggtccctagacagaggcctcttggggatagagaggggtggggcgacaggtgagaggcgttgggtaccagcatcagggctgcagaggcagctgtagggacatctgaaggggacaggaagctcttccccagcagcagcgaggacaggcctggctcagaaactgcatttgggtccgaggtccaaactctgccagtttgtgccagccggaggcctctgaccacaggccccatctcctctcagaattctctgcaggttggcagacacttcagccagctccaagcctgaaatattttctataaaaatttccaattttctttgacccgtttctctttgaaattaatcctaggcagcgctgtgctctgggccctgaaggagctctgagcggggaaaggtcgcgcagtcagatgggcgtgctggcgtctgtcttctctctctcctgctctctggcttcatttttctctccttctgtctcaccttctttcgtgtgcctgtgcacacacacgtttgggacaagggctggattcttcggctgggatgtctctcagagctcttgacttggtccctttggctggggcttgccgtgaggtgtgggctgcgccacgagcacagctggtagagaacccggccaggagcgcagctcacgcctcccacgcctcccatcccaaactgtcggcacacccagagagagcctgcaggacaggacaggaggtgacctgggcactgggcctgtgtggagaggtggctggtgcgctggtctggttgggaaaaggccgggcacctgaatgccatgcgggttcattaatgctcaataataatgctgctccccaaatcatgggggaataatgctgctccccaaatcatgggggaataatgctgctccccaaatcatgggggaataatactgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatgctgctccccaaatcatgggggaataatactgctccccaaatcatgggggaataatactgctccccaaatcatgggggaataatagcattagcagctctactgcttagggggagactgaggctcagagagggcaccttgcctgctgccacaagtgtattttcctgcattcactcgtcacgttcttgctatgtgtccaccatgtgtctgacaggactgggtgctggggctgtagcagcggaggaacccgatcgagtccctgttctctgggctcacagccccgcaggggagacctggtgagcagatgctcgcagacagtggagaatcctgtgaacaaagtaaaacggggtgaaagggcagcgtgagaaggcaggtaagggagggaggcgccccaggttggtgatgatgggaaagcccagccctgggaagggtgttccaggcagagggaacagcacatgcaggagccctgaggctggagttaccgcagcgtgaccaaggggcagaaggaagagctagtacctggaactgaggacgtaatgggggagtgggaggcgtgcagggccgggagggatgggtggcactcatcgctttgaagggacggtcacggtacggggtgagaattcattccctgtgcggtggaggcctttggagggttttcggtggacggtgtggaagcagggaggagtcccggtgacagatggcggtggaggcagtgggttcaggatgagtttgaggtggagcttccgggacgtggtgtgaaggaaggaatcaaggacacatcctgcccctgagaggtcacgtggctgggaggctggctggtggcctgaggctggccgggcaggtgtgctggtgggggtggccgggcaggtgtgctggtgggggtggcaggttaggtggtctgggccacgtgcaggagtcagaattggcacccatcactctgactccacagctgcccgcttccactgctctgcactgccctggcccagagggaggtgttttcccaggaaagaaggtgccaaggccaagacccatgtgttcccagactcacggggcgggggcaggagcccccaatgcagccccacaggcagccaggccctgggatgcactgccacctcctcttgctccgggaggcagaggctgtgctctgtggggcgggctgtcagggacagtgtgaggtttggggtcccatggacgtgtgtgcatccttgtttgtctagcaggaccggtccagcttccccttgcctgccactgtggggagggaccccagactggccgggatgaatggatgcaggaactgtggcctgcacgtacttaggagtgtgcagggcagggtgtgtggctgcctctaggcctttgcaggcagagccttcctgtccaccccaaggggccgcaggcagcgctaccagctgttccccacacaaaagctgcccgagacagctggaatgctccctgctcctggtgcaaactctcttgaaactcaggggtggggacatcctgggagctgacctcaggttctgttcctgcaaataggtatctgttgctgacccggcagatggcggcctgagccagcccagacgcgctcgagccctggccctgagcagccatcagggggcacctactgagtgactaaatgaattaggaaatcccagcgcttaacagactcaccactcggggcagagccagactggctcccacagcagctcctggtttctccaaatcctcaccagcacgggggctttagtgtttaatattttgctgctccggcagcaaagcggcgttgctttttgcgctaatttgcgcttctttggttactggcgaggatgagtgatcttccctgggtttgattactctgcatgtctcctattcctaagtcctttgcctgtttatctcctggggtcttatatattgggataagccctttatctctttttagatattgactttctgtcatgttcgatacaagcttttccccaggccatagttcctctttcctttccagttttgttagcgttagttgcacaaaagtctgtttttctgtagctgagtctgaatgatccttctcctgccccgttggagccaagtttgcgttcaaggacatgcccattcaccgagggcctgcgcgaaggtgggcactcttcatggtgtcatttaataggcacggtagtcctggaagcagagagaaaactaaggtgcagggctaccactgtccaagcagtagcgggaacagcagggagcaagaagaacgtgacgcgttcctggagcacttaccgttgaccgcgtctgccagcacgctgcaggtacatcatctcctaggattcttgtaatgagccccacggtgggttggtgcttttgctgtgcccacgttacagatgaggaaactgaggtgccgacggtcgcacagatagtaagctgtagaaacagtgggagccaggccttttgactcctgcatcaggagggaggagcaggcttagaacccagggctgctgacacccagtgcagtgccctcctgtccccgctcagagcctgggctggcaaaacccggtagcctgtgaccccatctgtttgttggacagagggccttccaagcaccaaggcctggaactccacttaacggctgcagaaactggggcccagcgagggtgagtgaggatgtgtctccaggtcacttagcacgttagcttcggggagaatcttttgcttacagtggaatttgcagcattttgaggaatgcctggcacacggttggtgcgtaaatatccgtgaaaagaaagaataagcatagtgcctaggaagcccggtcgcccaggagctcactccgggagcaacagttgctccctgcaggcattggagggcttggcactgacgcctcctgttgttgccacagtgtcagggctgcagactcaggttggcagctgtgggtggctactggtcccatgggcccatgggacattgggtggccctgggcctttgctagtcccacttcctcacacttgagcaggactgacttcgccggcttgtgacccatccggcagggccctatgcccactttaacactctgtcattcctgccttagaagtcgtaatcactttttgaacaagggactgtgcgtttccattttgcactgtgccctgcaaatcaagtggccagtgctgttcatcactctttcttctgtgactctgcttcctccctgtggtctcatggagctgtggtccaggccccgaggttgaggacacagggcactgcacagtggccaaaattgggggtgcccagtagacacgggctcccttccttccaggcccaagcaccagcactttctgacagttaactgtctgtcctttatttgggaatgtctgatgccagactgcagatggcgaggaagatggccctgtccatgctggaacgacagacccggtatcaggaatgtgcccctgtgactgccacaggcccgtttggtgcctgagggcagcaatgcgtgaatcccagcctctgccctggggatgccgtcgggctggagcactgctcccagcgtgccttggccactgttccctgcgcggttgtctctggacataaagcacctgtggaatcccagggctgctccccttcctctctcccttgattcatccaacagatctctacccggcacgcacagcaggaccgggcactgggccaggctctgggaccagacaggcacagccctgacctcatacagcccacagtgcactagtcagtccacaaatacctgcacaatgaaagacttgggaagtgccacagagtgagcccgcagtcactggacgttgggctgaggcctggagtgtgggttgcagttccccaggaggaaaaggggccagggcagcagatgcgaagtacctgaggggtgaggacggggcttgtttgggggtgtggcaggaggggcagggtgagggcctgaggggactggaggtcagatcacgatggcttctgtgggctccgtcgtggaggaggggctgtgccatgcagcaggtggcatggtctggtttccgaggagggtgagcacggaagaggcagggagccggcaggaggctgctgtcctgtgtgcagggagagactgcggcctggatcaggtggccatgggaatgagagcagcggccggatcagcccctcagcgccatcgtgcaggaagggtgttgggagtcctggtaggcagtccacaggttggtcagagggggatactccttgcctggcagaaccgtattcccattccaaatcaccgtgaggctgggaggacccagatcacagccccacccggctgcctgtgacagctccacccctgtctggacctcagacctgtcgaggtggcgctcgctagaatcatttcctctgtgggatccgggcctgggaaggtccctgtgtctggcccttttctcaaggacctttcccagatcattctggacacatatttgagtccagctgcagattcctagctgcgagcaatgctgcccaggcttgagccttttttggacgactgcagggactccgtggggtgtgccatgggggctgccttcagcctcctcatgctctgcctttgacaattcacgtggcaggagctggggccgaggctggggtggccaggcttggagggatggagtcaggagaacaaagggctgagatggctctgcaagtctggccaggcgacgtccagcagggcgaaaaggactaggtgctgcccaaaccacagcaggagcacctggtgggctgcggggaggagctcaggggtcaagttgacgaggagttcagtacacattgtctgggttggcggggggcggtctgggggtgtcaggctgggaataagaagcatgatggcctgctcaggtctgcccacccaaatcagagcccacagccatgggcagtcccagccccagcgtgtgcagagggctctggagggcagagctggataacactggccccaggaaggccagagcccccaggatgagagcatctgtcctctcaaccttgcctggagcctgggggtcaggcgttcgctgaggacagtggtctcgtatgggcacactgatgggggcctggcaggtgacgccagcagagatcactgggcccaggtagacacggggtcggccagcagcaggagggcctccaattttataagagaagctggaaattgattttacttacaatctcttcattttaaactgttggcagctaattcaaaatttgtgaaagccgtgtaagggttgagcagcccggggcagtggccgggatgggggtcaggaggcggcctcagtgctggggaccttcactggagcccacggcgctcaggaccgagcttcttggatgtggccagggctgcctcggagttgaaatgtacttcagaggaatttttattttcctttcgggaatgtcaagagaggcctttccagcggttccgtttctgtgaggcgaaacctgcggtcgtcctgttgttcttggaggcagcgatgaagcccatctgtagcgcatcagcgggagccagcagcggggagggtgcagggccccagcccaggcagacagagctgttggatgcggcactgagggagcaggcgtggcgccgggttcggagcagcccctggactccccgggctgggcggacagacccccggctggtgcatctggtgcccagttccgggtctgaggttctgttccccgggctcccggcacctatacccgtgcctggatgtcctccaggcccccgcagcctggagagcaaacggccgatgatggtctcaagagggttctgcccttgtgtccagaacgtcaggtgcctgtgctcctttgttctgggcaatatcccgggagctcccagcattcttggccttcatcaccacgaggacaaagctgggcttggatttgtcccgaggccttgaactgggaaggagtgtggggactcacaggcctgtaggaaccacctcggccacctttgaaactcacaatgtgggcccttggtgacagagaccccggggaccaggcctgggcctccctttcttggtgtccttggtgctccccatgggctgtggtgaccccagtgatgggccaggcagccggggccgccagtgtgggcctggcctgcggagtccttgctctggcctgacctcagtcttctcgtctgtatgtacatcggggtgctggactaaagccaggcctcagccctgcagctcttgggcggcctcgccgccccaccccgcaatgttttatttgactcgtacaacggcttcagaaatgttgagtgtacacttaaaaatcaggaggtttcacatgaaaatctcaattttcagttccttcagaaggcctggccaccctgggcgtgttcctgccagcagcactgggtgggaggctctgtgcctcctctggatgggcgaacacaacccctccctccctgccgattcgtgcctggcccccccactcatgctggccccgcctgcctggtttgcagtggagtgtgagactcctggactctggttggtagttacacgtacataaactctctccgtctctctctcctctctctctctcacacacacgcaggcatgcacacacccatggtcagagcagacacatccacatcttcatccatgtaggaaatgctggagtgaaccgagccgcacccaggagcttccctgagctgggcaccaggagcccagggtctgtcctgtctctggatgagtcctgctgccttggcctcagctgaggcctcaggcccaaagctccatggcaggcctgacactattttccttataataagcccccgtcctctttcctgttgggcacccgtgtccccaggggcgggtcacaagatgacaacttgggacctggcggcttactgttctgtgggctgagctggctgctgggccctgtgcgaaaggcacctgtgctcccacctgaaggagcctggggcctctgctctgagggcagaacaagaccctcccggtctccctgtgggaagaaggaccgtgtcagagacgctgtccacggtggaccaaggccaagctgcgggagaggctggggacagagaaggagactggtgggtacctgcccatgctcatgtgttgggggtgtaggcagaccccagggcctaccagagcagccagtggggagcagccagttcctaggcccagcagcatctgtgcaaaggggtccagtagggtcacagtgcccgaattgtgtcacacactccagggctgcccagccctgcctgctgctgcagagcccctgatccccgaggatgaagacaccaggaaggagcaagaagtggcccctgtgccatcagtgtctgtgccgtgccacccctgcttgggggcacattggttttccacatggtgtcctttgaatggaggtgaggcgggccccagccaggccataatcttgggagacggctctacctcagggctttgctgaccccattctgagtcaggccccagccaggtcttgggagatgggacagaaagtgaggggaccccaagattgaattgtaggaaggatctgaactcactggtggaggcagagagggaagatggggatgaggctgatggaaatgcagtctgctcacaggcacaaaggccacatcggcagccctagccctgagcccaccccacagttcctgacccccaatcctcaccctctagagatgacctgtggtcaagcatgaccgattctgccccaaaaatgtgtataaatggcaacagtgacaaatgacgctgctatggtcttgcctctgactttgttacccggttcacttgccatggatgtgaaggattcactttccagtatcagagtctttctgtctacccattcatccatctatccaatcattcatccatttatccatctgtcatccgtccatccattcatctatccaatcatttatccattcattcatccatcgtgtattcattcgtctacccactcattcatccatccatctatccatccatcattgatctccattcatctacttactcatccatctacccatcccccatctacccatccatccatccaattatttatccattcattcatccatcatccatccatccatccatcattcatcatccattcatctacacactcattcatccacccaatccatccatccattcatccagtcagtgtctgcaagcaccccaggccagcgccctgctgggcactgagtatgaacaatctggtctctgtccctgaagagtctggctgggggaaaaggcagactcccagatgaaccatgacaaatgctgctaataggctgcttggcagcccttcctcattgtgccctgttgtgtttctttcagccaaaatatatttctgtgcatctttgacgccatcaacagttgataggagagtcaggcagagggggctatgggcttcagggacagtgagagggagtgtgtgtgtgacctggtagcttagagaatattcttgtgggcttaatctgcacgcccccccgacttcacccatctgggcctcttctgacctcctacaagcatttgagttgcttcctctgaccttttaaaaatcaatggactataatacatatgagtatgaaagtgtgtaatccagtggtttttggcagtgttgtgcagccatcatcaccatctagttccaaaatgttttcatcaccccagtgggaaccctgcacccagagcagtcactccccattccccttcccagctcatagtgaccactaatctactccctgtgtctttggatttgcctattctgtatacttcatagaaacccaattgataatatgtggcctttggggtctggctggagtccttctaaggattgatctaaaagctccagggccccttgtcatgggagcatcatatgcccagcgacatgaatataaaataataatactgcataattccagaataggcagcagcgtgtgtgtatgaagctcgggactgtgagacaggagggagaagtggggactgtggttaaaacagtccagagtgcctcttcctaagggaggcccctcctagttcctgcagtgagatccgtgttgacactgaagtggccttgtgccctgctgccccgccctgggatggcatatattagagggggctccgatcacctctgaactgggaaatgtggagtagtgcaggacacagcagcaggaaccacagctcccagccccaccccagagagaaaggcccatgagcagctggtgcagggactggactggagccgatgatcagatttggagttggtgtggacatggcgtgtcacctctcaggagagggggcaggaagtgaggagcctgaggccaaagggtgagaagggtctgaactcactgctggaggggcatgtgtgtccccagggttgcagcctggctggggcagccagcacagtggtgacaggacaaattagagaaaaagggatgcctttttttttttttgagatggagtctcactttgttacccaggctggagtgcagtggctcgatctcggctcactgcagcctctgcctctcgggttccagtgattctcctgcctcagcctccctagcagctgggattacaggcatgtgccaccacaccccccgaatttttttgtattttttgtagagatggggtgtcaccctgttggtcaggctggtctcgaactcctggcctcaagggatccgcccaccttggcctcccaaagtgctgggattataggcctgagccactgcgcccggccgggatgtctttttttataagacaaattataaaggagaaaaaaggacagaaaaaccaagacaaattgagatcatagagtaagatgggagaaacaagcccagatttatcaataatccaggtaaatgtaaatggattaaactcacaaattcaaagacagaggctgtcatatctgacaaacgagacaaaccccaaattcaaaatctggctggacgctatcaccagagtaaagtgtaaaggcaagaaaaagtggaaagtaaagtatggaaacagacctatcaggccgccaaaggcaagccgacattgctgtatcaatctcagactcaacagacctcaagacaggagacgctgctggggaaagacaggtcaccgtttaatgagaaaaggttcatttccccaagatgataaagcagttctaaaggtagagtcacttaataaaataacctcaacatatttgacgtgaactttgttagaaatagagaaattgacaaatttatcatcatttttgagagaatccaaccatttttttccaattggtgttggatcaagtagacaaaaaacccagcacagataaggaagttctaaataacacaaataataagcttgacattgatgaattttgcatctgacaagtagaggttatttctttttctcaagcacataggaaacacttgtaacaactggtcaattaagtgcaaatctcacagaaactaaaagaatagtgtcagcaggtcttgttccctgaccatcatgcctgtgagagagaaattaatagcccccaaagcaaaaatccccattatttggaaattaaaaaaaaatacttttaaataattcatgggtcaaagaagaaataatagtggaacttcaaaaatacaactcaatgataataaaagcactaaatatcaaaacgtggatggaaatttacattagaaaagaaaaaggtctaaaaattaaagagataaatttccagtgtgagtagttagaaaaaggcaacattgatccaaagaaaatagaaggaaaaagataatacaaaataagatcagaaatcagtgagacaaggccaggtgcagcaaagtgcctataatcccagcattttgggagtctgaggcggatggatcacctgagctcaggggttcgagaccagcccgggcaaaatggtgaaaccccatctctaccaaaaaaatctaaaaattagctacacgtggtggcatgcacctgtggaaccagctacttgggaggctgaggcaggagaattgcttgagcctgggaggtagaggttgcagtgagctgagagtgcaccactgcactccagcctgggtgacaaagtcagaccctatctcaaaaaaaaaaaaaaaagaaaagaaaaagaaaaaaaaatcagtgagacagaaaacctctgagttctgatcattgttgctgttaggaagattcggggtcagtgttgccagatcctcagtttttcaagataagtcaaaaataggtaattctgcagacaatctctgcattaaaaaaaaagtgtcagtaatctgaatttggcctgtgcacgtctttcctcccagagctgcttctgcacacagcacctcctctctgggccatcttctctgtggccagcttctcctcgatggccatttgtggacaagtctttgtgtgtacatatatgttcattactcttaggtatatgcctaggagaattgctggctcacatgataacacagtgtttcactttttgaggaaacaccaagactgttttccaaaatgtcctgcacgtagtgtccctcctggagggccggggctaggtcaccatacacagaacacgcagagacaccccagaaggccaattcttgtgtctagttagcagggacctgtctctgtggggtggggggctgctggtttctgactctcatctgcagacccctcaggcactggcctcgttgtttaattcataaattggggaggtgatggagggggtctgaggcctgcttttttggtggcagagtaatttctacattgggtccttgctgaagtaggtcaccatcaggcagaaatacgattcctgagactttttggagataacaagttcaaaccctgcctggctgggtttctagcagctctgcttccagtaccgtgtggatgtcattttcacttacgctgtctcacaagggcatgggtggaaagaactctgtttctaggtaagggatggaaggctcagagatggcacaattagaaagtggaggatctgggatttgaacccaggcccgcctgatgcagaattgggctctttctgctacactagcttcaggtgccggctgagccctgggagggaggagtgagcaaatgcatgaggctttgcctttgccgaggcaggacaagctgaagaggtctttctccttccctagagtgagcaggatctctggacttctctcctgtctagtgtttcagctggggctccactggcggaagcaatgtgcgggcaggatgcgtgatgcctgtgggtggacagtgccactgtcagaagacaagccgaggctgctatgggagggcgttagagggtgacattggcctcccatcagccaggtttcgaaagttaggagcagatgtacagggtttgtcacccaactacttgctccccttcttggttaccgcatgaccaacccagtggcctcccagggccttgcgctacacaacactggacagccagaaagcaggtaatgctgcgtcacccacagagggttgcctggggcctgggctgggctggaaatggctctgagaacagaggtaaggagtagatcattgtttaatctttcctttatggtgggtttattgagctgtaattcacatatgctgtagttcagcgtttcgggcgcataattccataatttttactatattcactcagctgtgcaaccatcaccacagtcaactttagatcattttcattgctcccaaaagaaaccctgtacccacgagccatcattccccattttccctcaagaagtgttacttcttcctttgcaatgtggatgccttttatttatttatttttttcttgctgaattgctctgactagaatgtccggtactatgttgaatacaggtggtgagagcaggcttccagtcttacagttgaccatgatgagtacttttggcttttcgtaaataccctttatcatgctgaggaatttcccttctagtccttgtttcttgagtattttttgatcacaaagggtgttgggttctgtctaatgctttctctgcatcaaccaagatgactgtgtggtttattttcctccattttatgaatgtagtgtattatatggattgatttttgtgtgttgaaccactcttgcattccacggataaatcccacttggtgattgtatataagccttttaatatgctgctgaatttggtttgctagaatatcattgaggatttttgcacctatatttataagagacattagtctgtagttttcttatgatgtttttgtctggtttcggtatcagggtaatgctggcctcatagaaagatggatattaattctttaagtgataggtagaattcccagtaaagccatctggtcctaggtttttctttattgggagtttttgatgactgattcaagctctttacttgttatagatctgtacaaattttccatttctccttgagtcaattttggtagtttctgtgttgctaggaatttgtccatttcttctaggttatttaatttgttcgtatacaattgtacataatattctcttataatcatttttatttctataaggtcggtagtaatgtccccacttttgtttgtgattttagtaattggagccttctctctttttatcttggtcagtttggctaaatgtttgtcagttttgttgatctttcaaagaaccagcttttggtttcattgagtcttcttattgtttttcaattctctattttgtctaccttcactataatcttgattatttccttttttctgctagctttgagtttctgttgcttttcttctggttccttcatgtgtaaagttaggttattgatttgagatctttattatttttaatgtaggaatttgaagctataaatattcttctgggcactgcttttgtatgtcctttaagttttgggtatgttgtgtttttattttcatttgtctcaagatttattatttattatatattctaatttatcttgtaacatattacctgacctaatggttctttaagagaatattgttaaatttctacatatttgtgaatttttaaagggtttcttctgtcattgatttctagttttattccactgtggttggagaagatgctttgtatggtttcagtctctttaaggttattgagacttgttttgtgacctaacatatgacctatcctggagaatgatcatcatacatgagaagaatacacattctgccgctgttgagtggggtgctctatgtatgtctgtcaggtctagttgatttacagtgttgttcatgtcctctattttcttactgatcatgtgccggttgttttatccatttttgaaagtggaatattgaagtcttcagctattattgtaaaatggtctatttccatcttcaattctgtcagtttttgcttcatagattttgggattctgttgttaggtgtgtttatgtttataattgttatatcttcttggtggattgactctttcatcaatatataatgctgttctttgttgtaaaatttttggacttgaagtctatcttgtctgatattagtatggccatcccaggtctcttctggtttctatttgcatagcatttctttatccatcttttcattttcaaactatttgtgtattttgaatctaaatttggtcccctgtggataagcatatagttggattatatcttgggattttttaatccattctcccattctctgaattttaattgcagcatttagtccatctgtatttaaataattactgataaggagggactgaattctgctatctgctatttgttttgtatatgtcatattctttattcctcaattcctcaaatatttccttcttttgtgtttaacacattgttttttagtgtactgttttgattcatgttttcatttattttgctgtatatttaaaagctatggtcttattggttatcctgggaattacagctattatcttaaacacataacaattttgtttgaattgatatcaacttagtgtcaatagtatacaaaatgctttgctcctatacagctctgtcttccccaccctttattataatattgttacatttcatacatgtgtgtctattaatgtagatttataattattgctttatgcatctatagactaaatcatataggaaaaaagagaagagttacaaacgaagattttggggttccctttattagtattcttcatttcatcatatggctttgagttactgtcttctgtccttttatttcaacctgaaggactttctttaacacttattggagggcaggtcaactagaaaacaaactctctcagtttttgtttctctgaaagtgtctaatttttcttgtatttttgaaggatagttttgttggaatttttagccgcaggacagtatttttttcagcaccttaaatatgtcatcccgttggtttctggcctttattgtttctgatgacaaatcagttgttaagctcattgagagcccttgtatatgtggcaagctgctcctctctcgtggatttcaagactctctttttgtctttgtcttttgacaatttgattacaatgtatcttgatgtaactctttgagttttcaaacttggagtcattgagctccttggatgtgtagaatcatgttctttttatcaaatttggggaatttggagccattgttttttcaaacattctttatgcccctttgtttctctattctctttcttgaactctcattttttgtattttggtgtacttgatctcttaggttctgttcctttttcctcattctttttccttctacttctcagattggatgattgctgataatgtaagtttgctgattctttgtttgcctgctcaaatctgctattgaactgatctattgaaatttttatttcagttattatgcttttcagctccaaaattgtttgtggttcctttttataatttctatttctttattgatattctctattttgtgatacattatgttcttgctttacttacgttatttgcccatggtttcttttagttctttgaacacatttaagacaatttatttaaaatctttgtctggcacatgaggtgtctaggcttcctcagggaaggtcttttttatttcctgtgagtggaccatcctttcttgttattttgcatgctttgtattttttgttggaaactggacattttgaatgtggagactctggaaatcagatgccccccacttcccggggcttgttgttttttatgtgttgttgcttgtttgtttagtgatttttctaaactatttttgtaaagtctgcattgttcattatatatggccaccaaagtctctgttttgttagcttagtggtcagctagtgatttgacagagactttcttaaaagccagggtaggaagaaatactctcctcgtctttgtagattggttctgtgtttgagcacacctttgatgcttagccagactgtttacaactctgtcttagccttcacttcctacttgtacagaccctaaatgtcagccagaggtgaaaacttttgagtcttcttagaccttttctgagcatgcatctcaccctagacatgtcagtggtagaatcctagattctctggtatgcacaagagctttccaaaaaccttatttcctcaaatatctccttccctaccctcttcctccccaagcctttagatatgtttattgtgcgtcttgccccaactattgtcctgtgccccaggtgtctgcagctaatacatttacctttaaatacttttgacaaacactgtctgggaaaccacttcagtcctggggaagctccgagacagttgaaacaaaggcaagccagcagatgggttaaaacccacaaccacaattctctggatataaggtccatatttctttcttttgagttttcaaactgggagtcattgagctccttggatgtgtaggttggtatcagcaacctacaccaggaatgtggtctgccatcttcatggccactgctgagttggagaataagataatggtaagcaagtaaattaaaacaccataacccactgtcaccaaaattcagtagctgctttcttcattaagcattccctggttgttgtaggtttctggttaaattctggagttccaaaaaagtcgattctgagatttactagcttatttcctgtttttgtggaggggcagaattttggagtcctctattctgtcactttggtgatgtcctctcccttgtcgtatgcatcttatcagaatctttagatttatattaacttaattcctgtgagctatagaaacattactcttatatagctctattcttccacccccatctttggttttttttgtttttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcctgcctcggcctcccaaagtgctgggattacaggcgtgagccaccgcgcccggcccacccccatctttgtactgttcttgctgtgcaacttgtgttggtttttgattgctgcggtaacaaattaccacaaatttagtggcttaaataatgcaatggtattattttgcagttttggaagtcagagtctgaaatgagtctcactgagtttaaatcagggttttggcagggttttgttccttctgggtcctcctccggggaggatctgtttccttgccctttccagtttctggaggccacctgcattccttggctcatgacttctgtccttcgtcttttatgccagcaacatcaggccaagtccttcccgtgcagccatccctccagtttctctcttctgcttcccccttccccctctatggacccttgtgattacactgggcccatctggctaatccaggataatttcaatattttaaagtcatctgatttacaatgttaattttcctttacatataaccttacagatagataggttctggggattagaatgtgaacatctttggagggccacagttctgcctaccacacagctatatatgctacaaacctaacaattgttgtaattattgctttatataatttcatgcttaaagaagctgaaaaaagagaggagagtacatatatatcaacagtttgccttcctgttgaccatttctggctctcttcatttgttgcggtggattcaagttcccatctggtgtcatttttttactccagtagctgtgtttctgttcacctgctttgtgctgttagtcaaatatattacatttatatattatatgggcccaataatacaattatatacatcttcttctatattattgctttttaagccagttaagggaagaaaagagaagaaatacccatttatattgtcttttaaagttgcgtgattacctttactggtactgtatgtgtgtgggtgtgaattcaagttaccaactgaggtcacttgctttcagcttgaagaacttcctttagtatgtctgataaaatgggtctactcataattctctgtttttacttatctgggactgtctatattgcaccttaattttgaaaaatagttctgctggagaaagattcttggttgacagcttttttacattggatatgccattctgctgccttctggcttccattattaggagaagtcggctggaaatcccactgggattcccacatatgtggcaagtcatttttcttttgctgctttcagaattttctctttgtctttggctttcggcatttttactatgatgtctctgggtgtggatctcttggcatttatcccgtttgaagtttgctgagtttctcggacacgtaggttaatgttttcaccaaatttagggagctttttgccactgtttcttccatcttttctgctcctttatactcacttgcctctttctgggactcccattgtgcatatgttcatgccctttatggtttccacatttttcttaagttccgtttacttttcttcattcttttttccctgtgtccttcaaattgcataatgtctattgatctgttttcaagattctttcttctgccagttccaatctactgttaagcctctcagttatggtgcttttcaactccagaatttccatttggttcttgtttataatttctctttattgatagtctttatttgatgagatattgtcatcatcactcctttacataagcatggtttccttttttcaaagacatatttccaatggctgctttgaaatctttgctgcaaaatctgacagctgttacatctgacatctgggctttcttaccagcagtgtctgttgccgcctttttttctgtgaatgagtcatttgtgtttctgttgtgtgaaactggacattttgggtcatgtggcagctctgcatactgattcccctcccccatctctgaggctgtttgcagttgtttgtgtatttatttgtttcctgatttggttagactgttttcacaaagtctgtattcttcacagtgggaagcctcagctgttggagggcacagccttgagcgtgtgcagggtcatcccgggatgacagtgatttcagcagggctccctatgactgtccctttctctgatctgtctgttacactctctgcttcatttggtatcacacccagctactaggcttcactaattgagggatgattgctctattattttcaacaatgtcctgagacataaattgtcacatagtttgatccaattaaatttgggtagggatgattttgaggccagtctttgaaattcattctccccctggaagagatcctcataacgatctgttctcctgattttttttttttttttccagtaaataagctggtctgtggttcaggttgttgttctcatagagctgtcagcctcctcttaaattcttgccgccagaatcttcactgaagccaccactccaggtattgggcaggaggtagcctctgatcttcttggtttgcctccccctagcatggaatatttttctagcaagcaggctggacttagggtgattaggagcccagcactctcgccctgctgcacctgagacggagctcctgccctgagttagggctgggtggaggaaggtgctccggcctttcggtcacactcagcagggagttaccctctgtcactgggagttggagatgatgagaaacgctggtggcccatctatcctggtgaaatactgtattccttgactgggatctgagggaagagggagccctgtgttcttggccacacacccccagagtggaactccccataagctgaactggaaggactagaagcggggaagagagagcaagtgatggctcaggtgccaccgattcttgctgttcttactgggatttttcttcccaagatttggttgattttcttgaatagatgatgttgcttagtttgttgtgtgctcttaggataatttctagagactttaaattgttgttgatggtgacttttcaatacttttcaccagttatggttgttctgaggggaatgtgtccatggggctcctctcaccaccattccagaagtggaattctcatggcagatgattcctaatctttttttaaagggccacagcaataaggaaggtagaagacactggatatgtcagggtcattcaaggtataattagagatccaaatccaattaagccaagaaaaggaaatttgctggcacacgcgagcaagacagcaggcaccgctggcccacacgaggctgccaaggctcagcgtctctcctcctcctaggacttggctctcttctgcagagacttccttctcagattggctcttcacatacgcagccccaggcctacgctgtgagcttactgagccaggaagggaatatttttttctcccaatgttcagatctcatggaagacccatgattagtctcactccagtcatgtgttcaccccctggaccaatcactgtgctgagggcattgagtaccaggtgtgggctatgtgcccccccaccacagccactggggagtagcatgggcatgaattacccatccaccagagacacattgggtggggcaaggcccttcccgctggcggaaaggggctactggtgtgaaaaatcaacaagatggtcccccacttgccccttttaaaaaatgcgtagagataggtacacacactattttgcctatagtttattttaatgcactgtaaatctcttcgacatactcagaacttaaaaagaaacttcatgtgcattatctcttttgactacacttttcctgcaaaaatggtcacttcctgaaaaagtgaaataaattcaaattgcacaagtaaaagaaagaggaaacttgaattctgcccaaaggaaacttcttcaagaaggctgtgctcttttgattttaatacactgaaattacagaatggcctttgacatggcaattttcatgtcgttttgaacgtcaaattgattttgactctgtttggaaggcagtgaggcccaaagccctgactcatgaaagagcagaataacaacccgaactcgcctcgttttgctggacgtggaagcccggctgggttgatctgctgtctcctcgttttccaccagcgtgaggtcatctctggcagtgtgtgcctcacagaggctggctggggcagcaggtactggccactggtgcagggtcccattgcctgcgatgagggacacagctaacgttcccgaggagcttccaggcaccttgcactctgtccctggcaacacagtgacaaggctttgttcctccacccgaaacaaggcagtggcatggcctccggttctcgaaggttcactcctatcttccgctcacacttcagtttctttgtagtcttgaatcattgttctccagcatattctacagagggccttggtctacctcacccatgcagctaaacccatctattagggaaaccaacactcaagctcactcctgccattaaactctcctgagatttgagtttcctcctctttcacaaaaccggaaatcccttgtaagttaagccaagctcattaacgttgtcttctgcggcatccatagagttctgccaggagagttgaaccctgttcctcttccctttaccggacaaaacctctgggagaggtgggctcaagctctgaatctggtgacgtttatggtttccgcagcagtgtgtctattggcatcgcgtatcagggtcgagggtggcaaggcatggggtctgcagagtttctgccctcccccaaacagcaagatccacacgcactgacacgcgtcacgggaactcatttgacacaggatcaagtttgcaaaatttcccatgaggtcgaccatgaccacagctgtcaaggtttccaaaaaggactccccactggatttggccttggtcataccttaaaccttcttttgccagcggcccctatacctgcataatccgttgcagtgttgcattctgatgaccttctattttcccggttcccttttgctccgacctgtgctccagcaaacctgcaggccattgatgctgccgccttgtcacggtctctcacaccactgatccttccctccaccccttacccagcctccttctcttaaactgcaggttccctcattggagtcactcttgctttgtaacatctactgaacaatgccctagtcctggtaaaatgaaactttctacctacttcatgctggcacgggtacccctgaacaaagctcagccctgcttctgctcttgcttacgatgatgttcaccagcaaggtgccgctagcagccagactgctcccctcagtctgtttgcctccttccagatgacttttcatatcttccgtcctctgaacacctccaacatctgctccctatccgcattcacacctgacggcttccctcgtctgtcacctactctcccagctttttgctctctcagcagcaccccctaggtggagacgccatcttcgattcctctcctctcactgtgtcttaaccccacttggaccaggcctctgtgtgtgccactctgccagaggcaccctccccgaggtcatcatgctgctgcatctccctgccaatcctcagtcgccatccctagcacgtggcaggctagtccctcctgctcccttggtgtggcttaccggacacccactttcttggtctaatcacagcactcacagttcatccccgtttcctttgctgatccttcctcttcccgcaccctctggggttgatgcgcccagggctctgtcctggacgctccttggtctccctctgcacccctctgtgggcgatctcattcctcttgttgctttatgtaccatgaaatggctcccagatttgcgtctccagcccagatctctctcctgcacccaagactcatattccaactgcccctccaccttccatgctctctgtattgcccacgctcctgactccagcagaatctgcacctcatctgtctctgcactcttcaaatccaagttccaaggcatttctctacttgccaacctcaatttggaagtaccacctcagcacgcccctcactgaactcgcgctcaccctctccgcactccaccctcggccttccccagctctgtgcacggctgatccttccttccatttgcacagccaaagctctgcagttagggttgacccctctcttcctctcacactgatgagaaacctgttgagaaatctttttaggttttctttcaaaatccaccccgaccctgatcacttctcaccatctccacggttgtcacttgcgtcaagcctttgtcctcttctgatgactttgggagcccccagcagacctccctgcctccccacccccatgtgtcctcaacacagcagcagggattcttttctctaacagctttattgagatataattcacatactatacaggtcacccatttaaagtgtacgattcaatggtttttattatattcacaacatcttctccctccccaaagaccccacaccccttagctgtcgtccttcctcccccaccaccttccaggcaaccattcatccacttcctgcctctctagatctgcctactggggcatttcctgtaagaggaatcctgcactatggtggaagggtcctggggcggtccgtggtcagggatcctttgatgccttctgctggatcatgtctgtcttctgctggaaatcccacagtggctcctgcttcgttcagctcagaagtcagcacccagcacccgggccacctaccagaccccacacgacccagcgcctcgccctgggaccccgtggcctccattttccttctcactcacttgattcctgccatcctgggcctccttgcccttcttttcaaaaccccacatggggtcctccttccgcctggatgccctttctagacaccctcagctcaccctcccacctcattcgagtctttgcttgcatgttcccttccagtgggacctaccctggcgctctaaggctttgtagacagctccccccgcaccacctgccctggcactcgcagaccctgtgccctccagccccttcccgcagcactcactgccctccggcatactcagagcactggcaccctctgttccttctgctagcgtggccgctccacagagcagggagctgcggtgactcccacggtctcccaggagcagtccctgaggggagctggcccctacacagtagctgggggtgaatccgtggacacccagcaggtgaaaaccgggactcagctccctggagagacgtctgcggttccacctgctgcatgttccagagaactagagcagctccaagttccgctgtggcttccttcaagctcaggaggaatatctgtgagcccagagtggatggaactgcttgtttcttccaagccacagaacagcttggctgtttccagagtgcacagcctccccaaagtctctccaagaacatggcttcggtgtgtgtttattgtaggatgttcaaggcctccgtggggcggggcagggggaccccaagttctggttaagtaactgtcctttaacaccgccgttctcaggagccacagctacactgcggcgtgcgtgtcgggagcgatggctgcctgggactcttcagcttgtgggtttgctcttcctttctcaagcaccttgcagtacaagaagcactgggtttttgtgtcctggtgaatccagggatcaaggaaaaccagaggacacagatgctccaagatgcctccttcctttcaccattttccagacaaagcagacagggacacagagaggcccagagcccctcatcaggccccgtctcctttaattccgtcctcattaaaccctgctagactttccaacatgctgaccttgagaatcacacatcgcctcatctcccccagcctcccagagctgggcagcaccgcttaactgacgcgactggatccaggtgacgaagcctttcttgagagtagctgaagtgacactgtcttagtcagtagaggctgctaccacaaaaagcacccccaacaccaggtggcttacatagtgtttatttctttctcatggttctggaggctgggaagtccaagatcaaagtgctggcagattttgtgtctgctgagggcctaccttctggttcacacatggcaccttcttgcactttgtcttcatgcattgcaaggggcaagagagctctctggggcctcttttatgttatttctacatttttaatttaaaaaaatgtttagagacagagtctcactcatcacctaggctggagtgcagtggcacgatcctagctcactgtgtccttgaactcctgggatcaagcgatcctcctgcctcagcctctcacgtagctggggctagagatgtgagccaccacatgcaacatatttttttttatttttagtttttgtagtgatgagggcttgctgtgttaaccaagctggtcttgtacttctgtgctcaagctatcctcccgtctcaaccccccaaagtgctgagattactggtgtaagccactgcacctggccatggggcttctttgataagggcactaatcccattcatgaggccccaccctcatgacctaattaccccccaaaggccccacctcctaaaatcatccctctggggattaggtttcaacatatgaattttgggggtacaaatattcagtccatagcatacatcgaagggggaaattcttttttctgaaaccaggtcttgctttgtcacccaggctgaagtgcagcagcatggactcggcttactgcagcctcaacctctcagggtcagtcagtcctcccacctcagcctcccgagtagctgggactgcaggtgcaccccattacgtttggctaattttttttatgtgtatggagacagggttttaccatattgcccaggctgctcttgaattcttgacctcaagtgatcctaccgcctcagacttccaaagggctgggattacaggcatgagccgcagcaaagaaagtctttttaaacgattctttatcagaggcctctgacagctcattcttgttccccaccttaagcacctctggctttcattgatattgcttgcttgggtcttagggcctcagtcagggcctggaggttgggatttcctggtgaatttgatggttagtctcctggttcacccttacgggagtggctggaacaattggcgtccctcttccccaagcacctgaagacaagtcctgccctttgtgtgctcagagaggagggagggaaagtgatttctgggcccaaagtccaagacttggagggagggaagaccccaaacacagcacagagggacgatgcccatcattgctcccaaggcagctcttccccctgcctgggagcggagctgacctcatggcagagggctaggcagagtgtggttaatatctcacaaggcacaggacatctggaagctgagatgtgccaagaggctttgaggctgagcatatttcagggctgggatgggagggagattctcatctgtttagtggcagctagaccaggagggcacctgggaccaggaccaggctaggtggacatgagtggtcacaggaggctgaggctgcagggtgtctgggaaggcacttggccagatgcagagggcaacccatgccctgagggtgggggcactgttggagcaatcccagtgcagggagacccccaggatctagcaggagctctgtgcagggctcacatggttcatgggggcccagcaacagagaggaccctattggcaaccatcagcactggattctgcctttggtctgagcagaggtggtccaccccgcttcccctctccttcctctctgcccttcctctccagggcaaggcctggcctaccagcactttcgttggccctgctcagatgcttgggactaggtgggaacaaggccctctcctatgagagttcctggcagcaccaacccctaggacctgagacaaaggggccaggtgagtttctttaagggcccctcgctcattcgatttggggtccctctgatttccatgcagcctgggacttggtaggacttggacacacataggctggcacctggctccattggtgtgaaggcgtcagttctgtcccacacaccctgagcatttcatgctattctgaggcatgaggatgagctcgtattcttgctccttgtctattccttcatcccattgtgccaaaccttcatgagcctcctctcagccaaggcaggtgacccagagatgaatctgatgcatgattttacccctggagctcatggtctggttaggggacttggaaactggtgagcttatacttctgcatgatcagtggtttaaaagaaggaagcacagggtgcttgagtctaggagagagagtaacttgctctctttgcgggcctaacgagctgggagctgggttttgaagactgaataggagtctgccagaaagggcagggcaggcattctgggcagagtgagcagtgttttctcggacccatggctgtaagggcgttgcgggaacatgagcaggtccctgggagggttggcaggcaggtcaggcccatcaggaggccctagccagtgtgctcgcactcccgcacgggtctgctaggcttgggaagagggaggtacagaggattttaatgggggcaagctcaggtgaggactcgagctacagggagtgaagggcagggagcagcagcggatggggccaggtctgggaggaggctgctgcatccaggtagagggaggggctgagctcatcatggacggggagatggggaaggtgccaggatgcggtgactccttggatgtggagatgagatgggcacagcagcaatggctgatgggttggggtagggaaaggtgacaggtttgtttgggacttgttggcatgaaggtgccttgtgacaccccaggggcagttgcaggcagcagggggcggggtctggagcctggggaggtgcaggctggaggtgggtcggggggcacctgtcagcaggtccatggtcatggaggtcaaagcagcaggtgtggagcaggcagagaggagagcgagggtgaagccctgcacacggaagcccagtcctagtggatgagcagcgtccagggcacggtggactgggccccacttcctgtgggggtgcagcctccacttctctctgagatgcatggtgaggccttctccatgcagagctggagaagtcacctgaggactgcccacctgggtgaattcaggcagagcagcaggaatcccccacagagcaggggttaagcctcgagggctggtgatatctctggcatctgatggggagggcgcctgtggcaggagagggtctcttctggcagagagcttgcatgaagtccagctgccctgagccaggaagagttactgggaggacattaggaaacctgcagagtccacggggagtcgggctgtggaagggcctggcagtcggggtcctggacacaggagggtcttaaccattgtgaccaggtgtttagtgacaccactaccttttcctcttctggctcctgcggctcaaatcccacactctgtgagggagaggatgtttggcttggggagggctgtgtgcatgcagggttccaggaattccaggaaataacactgggctgctgctctgagaaaggggagaatggatgctgggccacccccagaccttggtgcctggtccttggggacctggagatggctgctcagcggcttgagggcttcagtgtagtcagtgtagtgtgtgtttctgtttttttgtttttgtttgttttgtttgtttgttcattttgttttgttttgaaacggagtctcactctatcactcaggctggagtgcaatggtacaatctcctctcaccgcaacctctccctccgggttcaagcgattctcctgcctccagcctcccgagtagctgggattacaggtgcctgccaacacgcctggctaatttttgtattttttagaggagacagggttttgccatgttggccaggctggtcttgaactcctgacctcgtgatccaccctcccccaccctcagcctttcaaagtgctgggattacaggcgtgagccaccatgcccgggctgtttttgtttttaatgtgacacattttaacaagcatagcatttaacaaagcagataatatgatacaacacatacacacaagatacactgtcacagtcatgggagatggcactgatgatgttcagtcagtatttaggcaggattggaaagaaaaatgtctctgctgtgttttgcacacttgtacacagacacagaagttttttattccaaaatgtggagttatctgcaactctgcaaattatacttgatatttacttttcttgatatatttgctgaaaaacgattctcccagtaaacagtggtgatttctcagaacagtagttatttgtcagcagcctttaactacggcaaacctttttcacttgagtttgaagggtgaacgccttcccgcctcccgacacagatgctcatggtcgtgcataatttcatgtgcttccattctccagacttgttggaaatgccatattttatgcttgtaattagtcagatgagccaaaggatttgaaatttaaacatttgaaccctaagagaatcttgaaactttaaccaaagaaacagaagaagaatgtatacaaacatgggaattgcagttcaacagccctttattaaaaaaaaaaaggtattgtgctggcagtggaatcaaagacaaaaatatgatcatcacagtctacaaggcactttaccgatctactcatcctcatcctgatacagacacgcgtgggaatcgtctgagtggcaggacctgcagccattgtcacccgactttacagatgaagcagctaagaaatgactcaataaacttatagtgatttgcttgacatgtcagagttaaaatgtaacagccccagaaggagtggcctagcacagcgttcaagagcacagactcttggtagccatgccagggttcatatcctggttctgacacttccgagcagtgtgaaattgggatagcctttctcagtttccccatctgcagaatgaagataagcatcacagctaactcacacagctgctgcgaagaatcagtgggcaactatagacgaggtgcttggaacagtgcctgagccaccttaagagcagtatggatgtttctgtctgtcagggatcccgtgtggcttccatggcgccgcacttgggcatagtcggagatttgataaaacattggtgcaatgtaacagccgcacacaggtgcactggcttagcaaactggagtttggattaatttaatcaaaaccaagtgtcgagagggcaccaaagtccaggataaacgtggaatatcttcctggagcatcgattttactttaaaaagatgcactctatttcataatgtaaaattgacactttttaaaagacagaatgcggaggcaactgtggagttctcatttttggcaaaagctgatacgggttctgccttcactctctgggatattggctaatttcctctttttttttctttttcttttttctttttttttttcctagagacagggtctcgctctgtggccccagctggagtgcagtggcacaatcatggctcactgcagcctctaactctggtactcaagtgatcctaccccctcggcctcctaaagtgctgagactgcaggggtgagccactgcctctgctgacttcactattcactgcaccgagaagactctcatgtgtatttataacaatttggataaaaattttggacattgatccatgtcagctgcgagacagggaacgacttgttatatgcaccaatttgtcctttaattacttgttaagctttgatttgtcctattatcagaattctcatcctcttctctgcaagtttatgctcgccatggtaggcgactgtagaggtcaccggccccttacagttcagcaagtgtggatttgtgcagacaccgggacgccatcagcacatcgaggcggtagacactcgtcttctcccacggtttccttctgtcccttcatttctgttgctgttgttgtttgcttttgtggaaagaacacttaacgtgagctcagacctctcagagaatttcgaagtgcacagtgccacatggtcagctacaggcacaacgttgtacagcagacctctagtacttactcgtccagcatcactaaaactttacacccattgaacagcaactccccatttcccgctcccccagctctggcagcctctatggtgtcatctgctttcatgcgtttgattacagatcctcatgtgagtggacgagtgccgtatttgtccttctgggcctggcttatttcagaatgcgtgtgcatgcggggagggggtctgcgtaccattacactgtcactgatgtggatgtgcaatacaggcctgggtccctctcatcttttggtagcccccccggctttttttttttgagactgagtttcgctctgtcgcccaggctggagtgcagtggcacgatctcggctcactgcaacctccgcctcccgggttcaagccattctcctgcctcagcctcctgagtagctgcaattacaggcgcccaccaccatgcccggctaatttttgtatttttagtagaaatggggtttcaccatgttggccagcctggtctcgaactcctgacctcaggcaatccgcctgcctcggcctcccaaagtgctgggattagaagcatgagccactgcgcaggccttgataaccctattgttttacaaaatgaaagagtgcctgacagtacatgaatggtggtatgttttaggtacatgcgtgaaatggaggaagtctgtatagacgcagacacaccgcagtgcagtggtgccagccaaatccacgctcccagaagtgagacccaaggtgacagtaactggacccaagtatccccaagtctcaccgtctctgtgtgcctgtgtgcacagccctcccgggcataacgtcaagcgtatgtatttgatgtgtgtttgaggctgggtcttgccctggcatcagcagaagcaggccctggagcgcataagtgaccaccagacctgcacaccctctgcacagctgagcatctcggcatcaatgccctgtgagtgcccagggccaggtaggcactcaggaagcctgcaggccctgggatgtccagaccgcactttctggtaatcccacattgcccatcctctgcctctgcgcatcccctccccccttgcccccgagggcaccctgcctgcccacctcacgcccagccctgcccagcctgccctgccctcctcccgccgggaccacctctgctaaatcacttaatccggtgatatgtttcctctggcaggccaagcccatccctcctgactctcagggatttgattatagtgttttctaacaaagtcaaaaacagatttccatgagaggcttatagctcagtaattctatggtgctttggtgcagtgtgccaaggcgcagggatgtacggggtcaggatgtcgagagaaaaggtcacaaaattaaattagaaccaaggagggtaagccttggcaagagaggcctgtccggccagctgacaggggcatgcgccctggagaaccccgagaaaggggagttgtgaaaatgagccatttcacgcctaattacgatttcccataaggtacttaggagggatgatgtgcgctggacttggacaattaacgtaattaaacattcatgctgcctgcggcccatttcctgcctggggatatctttggaagctgaagcatttcttttttcttggaggtgatttcaagaatggctgcagaggaagggcttcctgcggggctgggccttgggggatgtacctctgcaccccagtggggcaggacccctacaaagagtgtttcttggtggcagctgggggcctgggggccggggaaggctggatgccactgacctggaattacctctccgtcgggaatgggcagcggggtctcatgtttgtggagtgggcagcggggtctcgtgtttgtggaattacctctccgtcgggagtgggcagcggggtctcgtgtttgtggaattacctctccgtcgggagtgggcagcggggtctcgtgtttgtggagtgggcagcagggtctcgtgtttgtggaattacctctccgtcgggagtgggcagcggggtctcgtgtttgtgactctgcctgtgttttgatcacggccaagtcacttaagcccagattctctggcgtcccctcctttcctccgattctctgacagaagcctgtaaggacttccttggcttctctgggcctcaggttttctatgtgtcttacttgtggacactgatcaggacactgagggtctgacggagagagggtggcctgaccgaggtgcacagctggaggtgcctgaccgaggtgcacagctggaggtagctttgctgggaccagaacccagggcacttgctcacgtgctggctgtcacctctcaagcacaggccgggggaggagctcaggatccagccagactgactgagctgttctcaggtgaccgcacaccacagacttcagtgcagactggcagagcttcggctccctcctctgggaaggagcaccgggcttcctagctccagagttgtggatgctggatgaggaggccgtggtgaaggcaccgccccgggtctggagccccacaggagccttccccagatgctccgcaggcagtggatgtccgctggctttggttagtgttctgcctgccttaagggcaggcacagtcggcccagccgcgcatggtgggttctggggctgggggcacctccaggtctcagggcacctgccttgctgccgagagactgcatcaggcaggaggcaaggcagtggccggcataagagctgggccttgctgcggagtctccttccgcttcacacccacactggttttgggctatggcaggtggagcagggaggagccagggccccggaggtcttcaggctggggcaagtccacccccaattctgccctgctggctggagaggagaagaaaacaggctggtgcccagactgggttctggtggagtgagctgagtcaggaacagccctgtccgtgcacctggcccgttcctgtcacctctgtgggcctcaggttttctatgtgtcttacttgtgggctgtggccagcatcgttatgcctacttttcagatcaggacactgatctgtgtgcgccactgcggtgctctgcagctgattcatcctggaggccgcccacacctggggcctccggcccaccctctctctgtgctccagaccactcctgcctgagtgtctcatgggtgtctgtccttgtgtccccacagaaatctcagcccaacacgccccacacggccttctcctcctcccacgcggctcctcccgagggtcccttgcagggaaggcttcccagggtgaccggttgcccaggtcagaaacccggaatcctccctggccccactttctgcacccaagctgtgactccccctctcagtctttgtccacacgctgcctcccctgccttccaccctccttcctggctccctctccagccccaagccagggctgccctgccccctctagtctctctgcacttctgccctcctcccggcctcggccatctctcctctcctggccctccctccttggcacagcaggggcttccctcactcccaggccctctgcactgctggtcctgtgggccgtggtcaggaacacccttccccctctgcctgcctctcagccctccccatgagcgtcaggttccctctctgtgtctgggccctgcagtcctagagggcatctggggttgaggggatgctggtcctgctcactctgtggtcccagcccagcaggctcatcatcactcaaagggccccagctgggggccctgcagcccaccagatactgccgtgccagcacccagagccaggccaagcagatcggtgccagaccagttccaccccagatcacagctgggccttgactgtcagggtggcccccttcagctgccaagtgtagagtcgtcagggagcaggccaggctgggggctccctctgcccctgacccctgggggagctgctgggagagtcctggcctctcctgcatgtgcgtggcttgctttttggctggactaaggattgcagccatatgaaatgctcattgctgtcctcatccccctcccattggctgtcctggaagtcagctcctttctgcagggcagccactgcacacctttcttctgtgtcctttcaggatgtcctgtgcacacacaagtatatatatatacacatatgtgtacacacacatatataaatcctaggattagaatctctggctcaagggattttgtgtcctgtagatactgtgttttcgtttttctgactttttcctgcacactgtagactacaccgtgtgctaccctgcatttgcgattatcagggaacatgtcttggacgtcgtccacagcagcccctccagacctgcccattcctcctgctcaggcattccatcctgtgaatcacttgcttaaccagaccttgactgatggggacgttacttcttttcaccgtttcttataatgcagccgtggatatccttacacttatttccttggctacttgtatgaggacatttgtaggattaaatttgataactagaattgtggattcaaaaggtttgtgcattttcaactttgataaggatgaccacaaccctaggatggttggctggatccgtttctctcagcatgtacccctgatccgtacatttttatttggacaatctgatgcaggttgtttctttaattaagggtgaggtcgagcgtcttctcatacactgaaaagctgctcggtggctcatacccgtaataccaacactgtgggaggccagggtggatggatcacctgaggtcaggagtttgaaaccagcctggctaacatggtgaaatcctgtctctactaaacatacaaaaaaaaaaaaaattaaccaggtatgatagcaggcacctgtaatcccagctgcttggaaggctgaggcaggaaaactgcttgaatccgggaggcggtggttgcagtgagctgagatcacgccactgtactccagcctgggtgacagagactctgtctcaaaaaaaaaaaagaaagaaggaaagaagaaagagaagaaagaaagaaaggaaggaaggaaggaaagaaggaagggaaagaaagaaagagataaagaagaaaagaaaagctgctgtcttttcttttctgacaattgtcccctcatattgaaatgagagaagttctcttgtcctcctcgcagggcgtgctatgggggtgtggcttccttcttcagtgtccctctgctcaaacctctgggggagaatacagacgggcaggctgtggggctccgaccccacagcagtgtctaggggtgaatgtttgcagcccctgaagccccagtgggcgtgtgctgcatgtgctcttttactttagctgtctgtaggcggcttgtgttaaccagctcagttagaccctctaccttgtcgcaaggacagagggctttctgtatctcgggttcttccttgatgtcctggaagaatcagatcacacgtgggcttggagaatgagtgcgaggttttattgagtggaagtagctctcagcagatgggggaagccagaaggaggatggggtgcaaagggctttccctggagtcgggccgctaagcagcctgggctctcctctgactgccccggccaaactccgtgtcgttctgcttctgccggtcggtggcctgcagcgtgctggtgctcgttggtgcgttcctctcgacgtccagccgcctgtgtgttcctcccctcatgcgctcctctcgacgtccagccgcctgtgtctgcctgttagggtctcgggtttttataggcacaggatggggacatggtggaccagggtggtcttgggaaatgtgacatttgggcacaaaggcaagagtgcctgtcctcacataggtccgtgagggtggagcccttagccagggaccatgcacttccctgcttccatatcatttaaagggagcatgcccttctctacccagcacttttgtatcaataccgtttgtccatttcccttttggattgctggattgtttcttgttgatttgtaagagcgctttatgtattaaggaaattagtcctttgtctgaagcgcacatgatgtgggtgagcccttggctgtgtggggctgaattgagagtccatgagagggaggaggagcctggtgcgtgctgagtgttagttgccgtgtggataaccagggagtgttcctcaggcccctgcgtgaggattccaccataaaacacatccatcaggagctgtccttcaaggtgggaaagggatgtggagaaacaagtggggcgtgaactgcggcccgggaagcttcagccactgtgaggcagaggcaggtggactcactctggttggccagaacctactgtgctcaaaacctctccaggccagacggaggaggatacagggaaacggttgctcagggcgtggagccgaggtggcagacagacctgaggacacagctttggtctgggcgtggagctgaggtggcagacagacctggggacccagctttggttcatttcacaagcagcacagcacctacattattcttaaattgctttttgccagtatttagagatcagagacttcacatgcaaatccagatttctcacttccttacaaaaataagacccagcaacatggacctgcaccctcctagtcaccactggccaccttgggctggaggcagtgtgccctctcatccccctgcccacatggcttttctcatgggagcaaaatatttctcagtgaagagggaataagcaaaagacaagccaagagggccgcatgctccaaggaaaattgggagagtatatttctttctggaaatgcggaccgtttctctctgttcaacatgtgaacaaaatatgtctaggtcagagagatggggcatcgggaaacacgcccagcctagcagggacccacaggtcgagggtcagggaggcccgagtgagaattgctgtggtgtgaggcctgcggccggcagcgtgttgtcaggatggcgcctacggatgtcaggatgtgccgggagccatggcgacagctcccaagaaaaagaggagaagacggtggtagcgtgcacccaccgcatggctgcagtaagcgcacagcatccacctgccccgctgacctcacgccgccctcatgctctccctgtaaatgacggccaggaaggaaaccgatgtagactccacggccaactgctcccaccaaggagatacagacaatccgcccgcatccacgctgcgcctcgtcctaccctgtcctgtctccacctgctcagaagtagcataaggataactaagttttccatttatccaataggcgtttttggcccgtttatttattcattttgccaagccccatgtgggtacctggggacttagagaggggtcaagggccacctcagtcttccaggagttcactgtagagcctgtgtgtgcatgtgcacgtttgtgtgtgtgcatgtgtgtgcctgagtgtgcatgtcacatatgcacacacgtgtgacatgcacacacatccatagactcacatacacgcacatgcactcacatacactcacatgtgatgaatgtatgcatgtgcgtttgtgtgcatgtaagagcattcgtgtgtgtgagtgcattcatgtgtgagtgtgcgtctgtgagtgtgtgtgtgtgcattcatgtgagtgtgcatgtgagtatgcgagtgcattcacacgtgagtgcatgcgtgtgcgagtgcattcgcgtgtgtgagtgcattcgtgtgagtgtgagtgcattcgtgtgtgagtgcatgtgtgtgagtgcattcgtatgagtgtgcatgtgagtgtgagtccatttgtgtgtgagtgcattcgtgtgtgagtgtgcgtgtgtgagtgcgttcgtgtgagtgcatgtgtgtatgtgactgcgtgcgtgtgtgtgagtgcattcgtgtgtgcgtgtttgtgagtgtctgagtgcattcgtgtgtatatgagtgcatttgtgtgagtgtgcatgtgtgtatgtgagtgcgttcgtgtgtgtgtgtatgagtgcattcgtgtgagtgtgcatgtgtgtatgtgactgcgtgcatgtgtgtgtgtgcatgtgtctgaggagtgatcactgagcaggccagcctgtgatggtgacaccccagagcgctctcctagaggtggtgccacgcaaggctggcaaatggtagttagcaaaatacttgacgagtgaatgaacaatgaacaaatgaatgaaaatgaaggttttgggagccagagaaggagacagtgacttgtcctggtggagggcatgggcccagggcaggcaggtaggaactgttgcaaacaggaggaaagtcaggctggacctggaagcagggggaggggttgcctggcagaaagtggcaacaggactgggtgctctggggagggtgctcctgccctgggagaagcatgctggaggttcggaggcagctgggccctgcaggggctgctgccagacttgatgccctctcagggcttggcaggagtcagttcacaacatgcaatgctgtgatggcagccacgtcacctctgcagggcaggcaggagcacatgggcagctggttgggagcacaggccagagggccacccacccagcccatctcagtgagccacaggcctgccgctggctgctacctggaagggtcacaccagcttttaagcaagaagaggaaaccccagccttttaaagtagaattaggatgatttctatagtttctgcccggccagctgctggtccagtcttctgagcccttgcagtgttgagggcagctggggcccggcaagcagggcctttgccatcctctctgcaggcagggtggccctccctcccctcctggttctcagggtggccctgggatctgggcttgtagtgcatccctgccacctgccctggttggggaggaaaggccctgtgaggctgccttggggattaaattttcaggactcagcactcactctgatttctgatttcctcccttctcgaaatagggctgatcaaattaagccttgtcaacaccgtggtctgggtgctgtgtggggagtatgaggagccccttccctcctcaactgcagctgggatattctagggcaggaagcatcatgggacaggagtgtgtggggtccaccagggccaattgtcaccacccccaaactcaggcttctggacccacggagttcacacaggaagacaaatgggaggaacccccgtccctgcagggttggatggcctggcctctgggctcagagtggcggctgcactgggggcctctcggtgctgtctctgagtctgcaccttgggatttacccgtgggagaggcaggtctgagagaagatcccacagccaggcgtgaaggacaggagagaccagaaacaaaggttgggcaggcctgctcctcagccccatggggggctggagcagagggaaggaggacatgtggtttgggggcccagcagcctgaggggaaagggaggtccctgacactcactgggagagagggctgagggtctggcaagttccagggtcttgagctgaggggggcgtggtgagcattgcatcacctctgcggggggctcttctctgggcagatccagggagcctggctgctgcccgcccacatggggtttccctgccccctcaggaggcgcaggggcatgggagcgtcctggaggatgggacatcagggcatgggagcatcaagaggccccaggcctcaccacccttccacccccagcatgggggagggctggggtggtccccggggttgtcctcggtcactcctgctccttgagcaggtcctggtcagacatggactgtgcttggtgccacgactgaaagtggggggtctttgtgcccaagggtcatggtgggtgatggcagcaaggtcctcagctgggccagggccctggtactttcagctccctcttggctgctggaccaggtgcaatcaccaccatgggccattggaagctcgggatgcgggggacagagccagatgctggggtcacgcaggggtgcctgttgcctgggcccagggcttgttccctcatttgcgtaagagaggtcccgtgcccactccaccggctaccatgaagaagaaacaggaggtgtgtgaagtccctggtgcctgggcatctgaggaactcttcctcctaggaaggcagcttggtggcacagtgtggcccaccgtgcagggctgccccaggtcccacaatcagctaggaagagcctgtgcttggctgcagcaccccagcactgctgtgtgcctggactcctgacctagaggggtcaggaaggaggagggagcagaggcaggtgctgagtccctgcacgtggctcatggccgggtaggagagggcctcatttgcacagggtcgggcagcatctgagacctcccgcttgtgttggctgcaagctcttcccaggggaccaggacctcacccctgcagggcccacgcccaccctgcatgaacgcagggctcaacatcaaaggacgtgaaggccacaacaagggaaactgaggttggcaggtaaagaaatgccttggaacttggatttgaagagtgcagagatgggggaggcgcagatgctgctggagtcaggagcgtgggcagtacagagggcatagagcgtggaggggtaggttccagagaccctgaggagtgaggagggagctgcctttgagggagggggagaggcaggttctgctcctggcatggacctggctgcatgcgggccccactccctaggtggacgatgcagctggcagtgcagccggaggtgcacgtgcgggcagaggaggcagcaggccctggaccttctgagtgtgaggtacctgaggccttccggggagcaatgccaggcttccagatgatgtccaaatcaggggctctggagcatgtaccagactggtgacagggattttccgcctgtcatctgctgagccactggccaagcctccggccacatgggtcccgtggcactggctgtcagcaccccacttgccggcccccacctcctctgcgttcagaacacaacccctgggaattctcccttcctttgggacccgtggggatcttcgttttgttctgaagttcacagtgaatattttcaataaaagacctgccggcctctccatcggcccccaccacttggctgccgcgtgctgcggtgcccccgtgacattacccaggccagctccccttccctgggccaactgcccagcagagggaaggcttggagccctgggggctgtggtgagtcctggggaccctccctggcttaagcagatgctaggcaggggcagggcttgctggctcttgtcacccgccccagcctctgaaggccccgagacccccgtgaatccttggaggtgagtgggctgcagaggccgctggagagtggcacggggcaggtgcagaggagcctcggtagttcggcgggtgctggggggacgaaggggaagttgtgtttgggaacctctgtgggggctgtagacaggaggccccagccctggggtgaagagggggaagttgtgtttgggaacctctgtgagggctgtagacaggaagccccagccctgctgcaggacacctcagaggggctcgcacagctgctggtcactcagcatggccctgctggcttgggctcaacctcagcagcctcacacctctgctgggcaccatttcccaaggacacgtatctgggagccggaccagagcctggccccttttctggtcatagaccttaaatactgcagaccttctcctcgccccacactgggaggtgcaggcacagggcagaagagagtggcctggtctgatgcctcaatcgttcaagagagctgtggctgcaaagccaaaccatggtgtctctctcaggccagcacatttggctgtgtctgtgtttgtaagggcacacaggactctcgtggttgcaagagacagagagctaaatgaattgacctgaagaattaggatgtccaggggtgcatcaccttcagccatagctggatttggggacctgaacagtgtcagcagcacacggggctgccctcatctctcgcctctgctgctcctgggggaaggaggtacttagcagtcccagagtcacattttcccagcagagaggaaagcacgggagtcttcctgtgcacaccaacacacagcatcaggttccagtggcctaacaggaccccttgggcactcctggagctggggtgcagtgggattggctccccatgagccatatggggtgcaaataggggagggtggtttactagcagaaaaggtgtaatggccagacagggcaggccaccgtgctgtgcaaccccaggtggctctgtgagggtgtgcaggtgctgggcaggccaggaccttctgtgtccaccactgaggggtgtcctttgtcctctgctgtgcgggggtatgttctgaggactggcccggagaggccttctctcctttagtgcttcctttttctccctgaagcacggctgaggctgagcaggcctgggctggagcgtccatctgtccgcggggcagcccatcccgtgggagtttagagaactgtcaggactgcccctgagattcggcacagcggttcctgatgcgctcctgatggccaggccggccccaggagcccctccccaccctccgatccacctcaggtcataaaaatggcattggatgagctgtgtctgttgaagttgcaaaaattaattcaaagtcagtaataaagttataaagggctgggatgtaataatcctaatgagcatcttttaataaagtacaccagtggggctctgtgctgatggcccccgtggggctgagcctgccttctgcttcccagagcctccaaagagcctgcctgcttccaagcagggctttctgctgtgtcctgattacacttccacataaacatatttcatcttaatgattatctttaggggaatacacagccacagagcgactctctcttggttagtaagaaatggaggggatgaccttgttcccgttgacctcccctgggtggggctcctcatgttggaggagaggctgctggtgctccaggctttggtcctcctgagcctggtggtggcccctgcaggccctggcagtgcttgtgtgcaggaactgggctggcattctggcctggccatttgccaacatcatggccttagtctaattccctgagcctccctctcctcttctgggcagtgtggcagttctggctctgcagggcggtcattaggacttacgttttggggactcctaagcactggaaaaaggatgacttgttcccatccacatggttggcaggttgaggcagtagcacagcacctctgtctgtgtgcaggtgcctcagtgagtgtgccgtctgccctcaggccatcccctacctagtgagtgtgccgtctgccctcaggccatcccctacctagtgagtgtgcctgtctgccctcaggccatcccctagtgagtgtgcccatcccccccttgcgccatcccctagtgagtgtgcccatcccccctcacaccatcccctagcaagtgtgccatctgcccttgcattcagccagcagagtccagcagagtgggaaactgctcacaggggatggggcagctaaggagagggctgggaaagagccctaggcttggaacccaaagcccgcccaacagcaagatgataaaaaggtgcctcgctacattttcttctagcacttccatgacttccttttgatcatctcatccacttggaatctgtttttgcttaaggcatgaggtcaaaatttgaccttttcctccctctaaccagttgtcctaacatcattaaaacaaagaaagaaacaaaagccatttatctccccagcctgctctcttccttctgattttctcctgcagtgagcaaccatttcaggtgatcaaaccgtatcctttccttagtgtacatttttgcaacatgagtgttgctgtcttgcgtctgtgtatccataatttatgtaagtcgctctgaattgtgtctcattctgtttcttaccttttgcacttggcactctgtttttaagatccatccatctatgtagatatcaaacttctaaccttggtagcactttgtgggatgcccccaccacatttgcttctcctctcacccactgatgacccccgtgttgtttccagctcccctcactccacccaagcaatgctgcaaggggcagctccccattgcctccttacagacctgtgcaagtttgcccatctgcaagccagtccatggggccgaacaatggcccatgggccaagggtcagtccaaggagggcactgggctatccgatagacatcctgtatctttaggatatgagccgcatggtgctcttcctcatgatcccctcagtagtgccagactgccaggttgtcccctcctgctccacctccgccgtttcctagcaccgtttgctacctgtatcatttactaattttattcactgtattgctacttgagcaactatttataattacatgcaaatgaatatcaaagacgattaatattaaagcggagagctggcacacgctggcagtgtaaggagagggcggcactgcccccgctggatggaggctcccggaggtgagcagatcagtctccaggtcgtggtctgacttctgcttctccgggaactgacaaggcccctcctggggaagtcgtgagcaaggtctcgaggaagtctgggctcagcacagtcaggcacctggtagggcccaggtggggaccacgcgctggacctgcagcggaaatacggtcagagggagggggctgacctgtacgtcctgcttctaagctcgccacggcctgcctccagctctcggtggggggaaagctggaaacttctgtgaatgttgtgcgtcctcagcagaggaggggagcgcccctcatcggcacatggccaagccaagtactgccaagaacctaggccaggctctcctgggcattttgtccccgggctacagatggcctgatggaggtggggtcttggtgaagacagttcaccccgtgggtcacgctgctcagtatggctcagtcgctctccacatctggtgcagagccatcacctcagggtcacttctcgccaccctccatgggcctcccaggccatgtcttctgtgttgggctcccgttttctctatctgtgttgggcttccgttttctatatctgtgtcttactctttctttgttgccttttttgtttttgatggtgcacacctttcagtagcttcttgagaggagtgcttgtcacataaatcttttgagaactgacatgtctagaaatgtccttattccactttcatacttgatggggaatgtgtctggatgcagaattccagttggacaatcattttccttcagaattctgaaggctttcctccactgttttcctgcatcgaatgctgcttttgagaactctgagtcattctgattccaattctttgtctatgacctctcctgtaacctgattttcccccttcttattctccgggagactttgtagaatgtggctgtcttcatggccagcctgggattcagctttcttgatgtaccaagtctgttaccacttgcccatctgtttccagcctcccacagttcccttgttgtttcttcccctcctgctctgcctatccttggaggcttgtgactttaaattttttttaaatttctttactgaacttttaatgggattctagaaaggagccaaatcagatatctgtgttcaatccgccattttaacctggaaaccccacatattcttggatctgtttttggaagtttttttgttttgttttgtgtttttgagacggagtttcactcttgttgctcaggctggagtgcaatggcgtgatctcagcttaccacagcctccgcctccccggttcaagcgattctcctgcctcagcctcccgagtagctgggattacaggcatgcaccaccatgcccagctaattttgtatttttagtagagatagggtttctccatattggtcaggctggtctcaaactcccaacctcaggtgatccacccgcctcggcctcccaaagtactggaattacaggcgtgagccactgcacccagcctgtttttggaagttttattcagctccattgatctgtttctttcatgacattgacacaactacgttttcattaatattattttataatacactgcattaatttgaaaaaaatatgcctcctcattgtcattctttttcattatttttctgtctggtgtggtcttccggatgaatgttggaatcactttgttgggttttaacaattatttgatggagattatttggcggagaataattttaacaattattttaacaattattcgacggagattatttgacagagaataattttaacaattattcgacggagattatttgacggagaataattttaacaattattttaacaattatttgatggagattatgccaaatttcttgattcatttggaggaggaccaacttccagtccaggattatgtccatgtagcttcatttactgaggtcttcttttgtgtttttggagaccttagactatattatactactttttgtgtagtcgttgaacattcattagtttttgtttgttcttagatacttgggagttttgctgttatagctgataagctcttttttccactctgctttcttgcgggttattcctatgttcaagaagtcttgatctttgcattattttatgtgagatgaggagtatctgttccttgtggatttggttaaactcttctatggaagcatttctttgactgctctttcaatttcttctgaggttattggtttcttcaggttttctacttgagccatgagtggaatgtatattttctatttagtctaggcctattagaatggtgcttttaatttcagatgtttagggtttagggttttattgttatctctgattttgtctcagtaatggtgattgtgggcacggcttttgagttgtgtcctaatgtgtctcagtaatggtgactgtgggcacgatttttgagttgtgtcctaatgtgtctcagtaatggtgactgtgagcacgatttttgagttgtgtcctaatgtgtctcagtaatggtgactgtgggcacggcttttgagttgtgtcctaatgtgtctcagtaatggtgactgtgggcacggcttttgagtttttgagttgtgtcctaatgtggtaaaatgtggaacttctcccgtgtgtgcttgacaaggtcacgtgttctggctgttgggtttgaacgttaggttttcctattaattcaaatagtttctatccctacctaatgctgtatcagacttgtctggaataaatgtattacagtgctcctatcactgtggccttgtctctccttccttgcaccaggttgaagctttaggagcataaagtttcgtatcttttgtatttttttccatgagttgtttgttttatcagtttatctccttaaatgccttggttggcaattacatggtacgtttctttgccccacttgttttaactcctcctggtcatttggacttggttatgccatatgcaagtaatttgtagctggattttgttccatctcatgcttctccaactgccaccacacttttgctcctgttctcggctccccacccccagtgtggcccctccggccctgctgcacctgcctctccttctatcccagttcccaactccccagaggcccccagctcgcctctgctgggccctctgttcccagagcacctctctgccatggctccaggcccctcacagccctgcggttacctgtggggcactggggacactgaggcacaccagaccccatggtctccatcccccagggttctctatctgagagggaaagtcagttaatgcccaggcaaattcacaaatgagacaagacctgcctgcagtggagtgtcacaggaaggaagagcacggggtgctgtcgggagaaatcaggggagggctgatttcaatttgggatgaaataaggaaagttctcccttaggagctgacatttcagcagacacctgaaggaagagagcaatgagggggcggccatcccatggagaggggacagcagtcggccgtgtcactgaacagtgtggtcctcaggttttaagcatccctgccccggcccctgtccctgtcgtcccctagtggcacgcagtgtggctgtgcaggaggcagatgggggcagaacatgctcctgtctttcaagagctctgagtcccatgggaggcagcgggctcccttccttctgggtctttcagggggcctaaatttggccagcacagcggcagcagcaaaaagggcatcgcaggtgaagaggccagcccagaaaaggcataggactgagcttcgcacaggggacagcgaacacccagccacccttagcactgcaaagcccctgcctgacctcagagcccacacctgcccactgcacttgccctcagcccacacctgcccactgcacccgccctcaggcccacacctgcccactgcacccgccctcagggcccacacctgcccactgcacccgccctcagggcccacacctgcccactgcacccgccctcagggcccacacctgcccactgcacccgccctcagggcccacacctgcccactgaacccaccctcagggcccacgcctgcccactgcacctgccctcaggacccacgcctgctcactgcacctgccttcggagcccacacctgcccacaaagcccgtgcctgcccactgcacccgccctcagggcccacacgtgcccactgaacccaccctcagggcccacgcctgcccactgcacctgccttcagagcccacacctgcccacagagcctgtgcctgcccactgcacctgcccacagagcccacacctgcccactgtacccaccctcagagcccgcaccatcccacgatgctcccgaggttgcagactcagtcccaggttttctcttctctagtctaatcatacttgtttctacaattctcattctcgcaaatcacccctcagtgctggtgaagtacagaagggctccgggcatgtggacaacgttggactcagaggcctgggcgcgtgcccactcctcctctctggtggtgtggcttgtccaagtcatgtaattttcctgctccttggtttgtttccctgatgctgaaataggacgatatgctgatggtgacacgcctccaccttggcgaggggattggatggctgctgggggtatggagctgccactgtgaagggctgtgcacacacccctgcctggagactcggggtgtgcctaggatgctggcagttgcagcccttgcccacgtgccctgtgcactgtggcactgtggatgagcccgtggctactgtgacccacccgttcccctgatggaattccctggacagaactgctgcctcccctcattccatcctctccctgtttattgattgactcttcgatagagtctttttgttccattctagagactctaaaacaggatggctctggagtgcttcccacagtgtcattatttggccacgatgtgagcaaagagatctccagctgccatccaaaaggggccctgagcacagggaatgccaggaactcgaaagctctgtgttacctatttaaaagatgggatcctgccacagacacctcccttcagggtagctgcagcccacctgggtatgacttctggggcttggtcaatcagcacccccagggggcccagtgccttcttgtggggaaggctgcacacagaggaaaggaaggccaagggcagtgtcatcctcctgcctctgcaggagatgggtgcgctgatcactcatccaggcggggtgagtgccgagggatacagcagaggctgtgtgagctcccagtcaccacagctcagcagggctgggctacacagggagctcccaggggaggaggggagagcagcaaatagccctcttctgccttggagggaccaagtggaacaggggctgttagaccaggtaggcaaccagtgcaggtgggcaggcccaaggccaaggttgacttcaaagggatcactaggaagacgactcaggaccacgccaggcccactggccagagctccctatagcaaggctctatttggggaacaggtctgcaagggccagcatgtggtcagagtctcttcatggcctgggttaagcccaatgtgggaaaaactgaggtggcactcgtgattgacagggtcagggtcaatcttattgtggggaaaactgaggtggcactcgtgattgacaagctggggcttcagcctgactgccgggtcttgttgggacagaggaggacaggaggggggctgggccagagctcctgttgccccaggtctgagggcattgcagatccccctgctcttagggcttctccccttgtcctgtccagcctgagcaccactgaggcttccaggggccagacgcagggcgtggctgtcacctgccaggtggcccaggcccctgtcttcctctcctcacccactttgcctttgggccttgggccgtctctctaggcactggtcctgggtggagggatgctctagaacataatttccaaatttcaccccaaaattatcacgattaaaataatgatggcaacaataataattccatttcaggtgaaattcagattctaaatctttagaaacctttgctgtttttaatgggcttgcaacacacagtttagttaaaaactctgcctgctcggcagaagcagcctcaagacgtgccccagcccagctctgtcccgatgcggcacccatgccctcctacggggaatgtctggaggggtccctgcatggggactctggggttagggccaggaggacatactgtgataccttctggtgccagaatgacattgacagtggcaggcaggtggcctggtgagccaagccctgtgtgttttgtctccaggtgtggcccctcaattcacagacccgggctacccctggggtggccccatctcttaattcctcaagagaagctggatgttctagatttttaaaacatgaaatctcccagttttcaaatactatcaaccagatggcaccacgtgacctcaacgagtgcctctgtggtctggttttgccgagggcaccgcccgtgtgtgacccctagtttgacaagggcagagggtaacgcccggcctgttccccagggaggaagagttttcctatggaaattgccatcactctccttcccaaggtgattctgaaggtgagctgtctctgttcgttggaaatgcaaagaaataaatgtacaaaaatagagtggcgattcctcaacccccctgtcaggcttgagttgctggcgcttcctctgggaacggcatggatggccctgagtcatccaggcagctaagtggactgctcggctccccacagccctgcccgcaggcctgccggccccacccctgtccctggagtggccctggaaagtccttgctgtgtacatgcatgtgtgtgtgcctgtgtgtgtacatgtgtgtgcatgtgtgtgcttgtgtgtgtgtacatgtgtgtgcatgtgtgtgtgtgtgcatgtgtgtgtgcgccgaggggacacagaactgtggagctgggggtggcacaaggacccccgaaggtactggaaccccagcagctgctcagccctggccccacttactcctcttctctttcccagccctcaccctccgcctcgcacctccactgtctgtcttggtcttgcccacagccgggctgcaggtttgtgcctgaaacttcatgttcagtctgtcttgtctgagccaggctgcagggtgcaaggagagagcttctggccgagagtcggccatgctgggatgccatgggtctccccatctgtaaaacggaaatggccatgtccaccgagtggcctgctgtcagcactgggtgaggaagcgtgtgccgggatgagggcctggtaccaggctgcctcactgtccgagtggccgtgccgcctgcaggggccttgttctgcctccagggcctgtcctgggccaccctcacagggagggagtgcctgtccctgcctggaagaggcagcaggagagaggcgttgggggtgaaaagtgttgttctggaagactctttgtagagaggtggtgcagcagggacgctggtctccctcagctgcaggggcctcggggcctggccaccgccctgtgggtcagtgatgtcacgatgacctgcagccctgggtctgtcccgggccaggagtctctgaggacctgcctggggaatgccatggagaccctggggctgggacctggcttagacacagagaccagtgcaagggaaagggggcttccaggacactggggcttggggggcggtgggcagtgtggtctggggctgccatcgatgctgcaggtcagcctggccagccttgctgtggccttcagacgggcagtggagggctgggaactgaagcctggtccagggtggtctccaggcccgcaggacacagaacacagcagagacagcactgcacagaaggcagggacgatatccggggcagactccccaggatggcagccccaagtggccaggggcacaccctgggggcaggaggtcagtgcctgcccagggccgactgcagcggagctgccacagaggggttcatcttggtctctgcacaattcaatcaggccagaggcggtaccgttcacctggggagggggcccgggacctggcccagagatgtggggcctcgcttcagtggaggacttagcagaaagttctgggaggggcccaaggagacactggggaacatgcacagcccaggatgggcctcggtttccccagtcataacagctggcgatgacacctgggacaccagtcctttggcacctggcagcccttcgggggagaagaggtggaagggctctacccactccagcgtcgggcagtgcgggcaagggtggctctgcccactccagcgtcaggcagtgcgggctgaggttcccgacctctccatggctgaatgccagccctgggctccataaggcagacggtgatgctgggctgggtctctcacagtctcagcaggtctgatccatcgtgtggaggccactgtggcccctgctgtggctggggttgccaccaggggctggggaacgagcggtcctggaagtcacagaggtgcctgtctgggccctgctgtgtctgagacagcttggcaagtctctgccatcttcctctgcacctcgctttcctctgtaaaatggaataataccctcggttcagggtgctatgagttttaaatgagaggatggccaagctggcgcctggtaggtttgtgtccgggtgggtttgccctgccgctgaagacggtgtcctctccttgcaggggcctccctggacagcctggacagcctcagccgcgccctgggcatcctagaggagcacgccaacagctcgaggcggagggcacgcaggcatgctgcagacgatgactacaacatcgaggtcctgctgggcgtggatgactctgtggtgcagttccacgggaaggagcacgtacagaagtacctgctgacactcatgaacattgtgagtggggtggctgagggggcagggtggggcggggagggtcaaccaggggctgggcaggccagagaggcccagctgggccaggtcccctgaggctctgccgatttccttgttagccggaggtgagtgacacagtctcagggaggcttgctgggtccccaggtgagacaagttgaccatccctgacctcagttctctcgtctgcacatcgtgggtgatggtaacttggtgaggctcttcacaggctaaggcgggtttgtgcaaactccagtcgtttgaatgacaatgtcattcaatgtcccgtcatttgaaaaatatgttttcttgatgtttgccacttttaaaactaaaatcatttaaaaaggcaaccttattttacctgaaaagctaatataatagtaagacataaagtgacgttattcagccccagctggatagccctgccttcttctcgctccaaacagaagccccttttctgtttaaagtagagattcacgtgcattagagcgagggccagacaccaacccagggcccctccttaaagctcgcagtgggaggaattggggagggaattcctttctccctgtgagtctgggctattgaaaggggtgtctatgtgccaccttcgtcttctgggcacctgcccatggtctgcctaacactaagagattaaagaaccacctccccctcattccatacccccaacaacctaagcaggaggtgccaggatgctgaaccgtgtgtgggtggaggctgtgcagacctttcctctctctgcctcatgtggtcagagccactgtggggatgaggggcgtccagtcttcaaaatgcaggctcccaggggagcagactggcttggctgagtcctgcagggaaaagaagggggtgagaaggaggaccagggcacggcctggaatgtgagatgctgccagtggggccctaggggcaggggggtatttgtgggaggaagccggggcttagggagggctggaggtggtgtggaagccgggcaggtgggaagttctagaaccccgtgctgcgtgtccacacctgtggatgaatgaggtcctctggggccgggctagaggcaggcagcagggtgtgcaggtctgctcaggatctgctgcccagctctgcttttcggaccaggggtgagcccctccaggagccaagctgacacatgggtcagagtccccagggccctggtgaaaagatacctcaggggcaggaggggatgtgagtgagctgaacactggacagagacaccaccttcatgctcactttcctcttgaccggtcttgggtgagtcagctagccctctggagcccagccttatccgtacagggggccgaagtccgctgcatcggcagaattcgttttatttgggagagcgttgtcacacttaccctcatcttatttttgaaacgtacctttaatgcaataatcataataacggccgggtgcggtggctcacgcctgtaatcccagcactttgggaggccgaggtgggcggatcacgaggtcaggagatcgagaccacggtgaaaccccgtctctactaaaaatacaaaaaattagccgggcgtggtggcgggcgcctgtagtcccagctactcaggaggctgaggcaggagaatggcgtgaacctgggaggcggagcttgcagtgagctgagatcgcaccactgcactctagcctcagtgacagagcgagactccgtctcaaaaataataataataataataataataataacaataaaaccataatggctacattatcgagcccctactatgtgactgtgccgggcccatgctgggcacttgccatgctaaattatcttgggaagtcctcatgctaggtctgtgagactggcaggtataaaatcttggctgccttcacaatatgagttcttcccctagcattatgtcgccttccaacccagcggggaaaggactgggcttggaattacagtccgatggcgactccaggcctcgccttttccaggcgcgtcgttgggaacgctgctcccgtcctctgagccttagttttctcatctgtaaaatgggccagtgttttcatcgtgggggttgatgtgattacatgagataatgtcagtgaatgtgcttttcagtctctcagtagggtgaacacgttttcagtttccacataaaatgtggttttgttatcatgacagtggcactgtttagtgacagtccaggaggggtcacttctgatagcccaccaagggcgctgaccaaatgtggggcccgtggtgagtccttcatgaggctggcagaggcagatcaacctttctcctggtgcccagggtctctctgtcacaacagctggttggaggatgtctagaacgttctctcacttttgccgtccaactttattcaaaccctagtgatccagccgtaccccctattttgaataatgggaaggttcgtttctagaaaagcatgagaaatttaaaaattcttaaattgagatgagttttatcacaacagagaaaccgttttaggagacaagtctcagaagttgagaaagtatttgggccgtgtctgttgtcccctgttgcacagaagtgagcactgattcattcagcaaacgtgttgacagtgtgcttgtcatgggcacagtgggggtgtcctgcagaggcggcggggcgtggcagagagtcccggggcgtgggagaccggcggcggagggtcagcggggggtctctgcctctgatctgagccccagctcccactgcaagagcgcagcgtgggcgagggagataaggcgcggccgtgcctggagcatggcattgccctgacgatgaatgccctgcgtcctcactgagagcctctgcatgcccggagagtcctgaggacagatctaagctatgtcggaccctttggtggtcttggggaggaggggcattgagcaagtgggagcttctgagaaagggtgaccttccagagccctgctgtgcgacagagcttcccgcggtgctggggagatgctcgtctcgccctttctggggcagtagccaccggggctctggagcacttgaagtgtggctggtgtccttgaagaactgaatttttaatttaacttcttatttgttccaagagaattttaatttaaaaaattttaattgcggtgaaatatacagaacataagtcaccgtcttcaccatttttaagcgtgcgattcggtggcgtaagcacattcatgtggctgggccaccatcgccaccaccgtccacagaactcttcatcttgtaaaattgaaactgtgcccattgagtttcagccctttcctcccctccccccgactcctggcacccaccactccactttctgtttctgagaatttgactactctgggtacctcgcataagtggatcaaacaataattgtccttttgtgtctggcttatttcacttagcatgacatcctcggggccatccacattgcagcatgtgtaagaatgtccttccttttcagggaggaccagtatcccgtgtgtgggtggatcggccacattttgtttatccagccatccatgggcactccggtggccccctcatgggctactgtgaatagtgctgccgtgaacgtgggtgttccagactctgttttccgttctcttgactatatgcccataagtagaattgcgggacacagggtaattctttctttaattttttgaggagtttccacgctgtttcccacagtggctgtgccattttgccccccaccaacagtgtacagggattctagtctctccaaattgtcaccaactcttgtcttttttttcttttttacggtagccaccccgaagagtactttgtttggattaattttcacctggatggaagccgcagtgtggctggcagctgctgtgctgaacagggcagggttgggcctgtgcacagaggatctgcctaccgtgccctgtctctgaacttgggtgctatgggggcctcgaaccacaaccccaagtggccctctaaggcctggccagtggcttgtcacactcctcttgtaagtcccagctggtcacagggctccccgtggctggagcgaaagcaaaagcatggaaggacagacgtggcagcagccggctgggactgggctcccagtgaggtgtttgtctggagctgtagagcaggtggggctgggcaacggcacatccagagcccggggtctgggggccagccctgggcaatgagctgcccactgaactggatgcagagaatggtggcacagcctgtgccctgggaaaggccgtcgagccctgggaggaggagctggtgggggccctgatggtggggacccagggaatgcaggctctgaggaggaggtgaggtggtggcaggctgagtgcaggcacagctccaccctggcagccctgcactgcctcagtttccctcatcatttggggtgacttctgcctgcagagctccctttgggatctctttgtggcagagcctgggctgggatatggggtccaggggtggcacaggcagttcagcctcatcgatcacccctgtgctcccctccccagtctcccttgtagctggtgtggagctgcatggccagttttgcctagtggcctgtgtgaaaggaagtgacctgggtcacctgtggaccaaggctggtaagagcttggagtcccctccatctctgtctcccctgccacggaaaccttggaagccatgtgtcccagtaggtacagctgcaacataggctcgggccctcccgacccaccccgcgccatggtgtgagtaaggaaacacggtgtgcggtgtattgtgttcagctgctgagatggggtggattctcggcatagccatcctcctctgtctggtgcccctggctgccgttcatacgggggccggtgtttatggggcgtctattatatgtcaggcaaggggtgcagctgtgagcatgacaggacgtaaccctgctaccttgcattctgggaagggaggcacagacgatactgaagtgaaaaacaaacaggatcatttcaaataatgacaaatgcaatgaaagaaataaaatagttaggagatggagaaggaagaagggtaggggaaggcaggccactttctacagctcaggggctggtgcactggagatatcacgggagcagaggctcacgacaacggaaggatgtgggaagaggtaggatagggatcgcctgttccaggtttgggggagggggcaggcggcgccaaggccctgaggcaggaatggggccggctggaagaatggaggcagcctggcctgtcaagcagggggcacaggtaggggaagtcggggccggcaaggccggccgccgcagtcttccagaggtggaggggagccgcctgtggctccgggagcagtggaaatcactggaggggctgcttcctgtctatgttaaagacaagacgtgatattcccttttctatgggaaagatgaagctgcccttttcatctcagacttgccagaagggaagcggcttggaaatggagcacttcatgaggccacctgggcacagaaaggggctctttggtttaggcaaccacccacctgcccactccagcagcccctgctgggtccagttttcttatcttcctccttacatctagaaaagcatgttttttggtttattgaaatagtccatatttaacacagatgatttattttatttatttatttattgtgagacagagtctcactctgtcgcccaggctggagtacagtggtgtgatcttggctcactgcaacctcttcctcccgagttcaaacgattctcctgcctcagcctcctgagtagctgggattacaggcatgcaccaccacggccgtctaatttttttttttttttttttttgtatttttagtaaagacagtggtttcaccatgttggccaggctggtcttgaactcctgacctcaggtgaccacccaccttggccttccaaagtgctgggattacaggcgtgagccaccgtgccgggacattttttttgctatgtaaaattagcataaattcctgtaggtatgtgaatgtcttctcccagcagttaattgtctactacgttgttttaatgattgcataacatcgcaccatatgactgtcacacactttttacctaacttattatttatatgacatattcacatagcaaaacttatttctccattagaggtcagacatgccactaactgtatcacgttcatagagttgaatctatcgctcgtgcttacttatttccttaagctgagttgctgaaagcgaagtctctggccaacagatatgcccattttttaagctttctacactggaatgttctctgttatggtttcatctattcccgcttcattgagcaaatgactgtctccccacctcctcacaccactgagtccttttgagcagtggtaatttaattacaacggagataagtttttttgttgtaagttgttatttccttgatgttaatgagcctgcatttaaaaatatacgtgtatttgtaaacagagattattttatttttttgcttggcctattcatgcccttgattctgctgggatttgggggtgttttattcatctgaagagtctgtgtacttaagtagataaactttttgtctgtcacatgtgtgggaaatatttcccccagtcctgttgttgaccttttgttttattccgcctgggatagtttttgatgtcctacatttttgtgtgtgtgaccacagggaaagatcctgcagtctttcccttcccaggggaaaagcttctcccttgggtgatgtgtttgatgcctcctgccctccccagaagttaatcttctgagtttctgccctacttggcagctgtacttcccaagctccagttcctcaccaaccgctgactgttcttgggtttagccatagcagccctccacctgaatttctcccaaagtaagaggaaagataggcttagtgcagtggctcacacctgtaatcctaggactttgggaggccaaggcgggcggatcacttgaggtcaagagttcgagacgagcctggccaacatgacaaaacctcatctctactaaaaatacaaaaataagccgagtgtggtggcacgtgcctgtaatcccagctactcgggaggctgaggcaggagaatggcttgaacctgggaggcggaggttgcggtgagctgaggtgacgccactgcactccagtctgggcgacagagtgagattctctctcaaaaaaaaaaaaaaaaaaaaaaggaaagaaaggtgtggcggggagatagagaattcaaaggagccaatgtattacatgcaatgcattcttatttcccctcaatatctggctgctgcaaaactcgtcaggatattaccagtggggaacactggcctaaaggcagagccagtagtaactcccaggccccaacgcacaatgaaaatgtgggatcgcttgttcaaagagcagaggaaggtgccatacaaagggactattaagccacttcctttcttccttagtctctgtctctctgtctctcaactcgctgttctttttatttgctttttaatattgttctaagtgaacaaaaattggaaccttgaattattagcatgaatttcttattcatctttaaattgtgcgatggctattttaaatgcaaatattagagcatttagcttctatgtggggtcactgaaattaaacaaatgtgtattttgtggctgatccctgatgggtgcctcaggctgaccagaagtttatgacaggcacagccagactcagggaggctgggaggaagaagagaggatttcacagagtggaatcctgccgaggggaggctcctcaggtacggggtcctagcagagtgagtgcacccccagcaggaagggcacacccactggggtctgagagcttcctgccacccctggaagaacacattggctgtgccctggccagggcgtctggggaagtagagccaggcacgcccccttcctactggtgcactgctccagcccagagcgtatggccacggccaatcccatctctatgcaggtgtcactcacgggaggctcacctctgccgaaacacgggctctggccagccatccaccagacatgcccctttcctgccagccgtgggcgggatggccaccaccacgcctgccctgagatgccgtggggaatacatgcctgatcctgcccctgctgggggcagctgaaagcctgtcctggggagatgggaccatgctgcattgccccaggagccttcacttacaaaacacacatgcaagggtgagatgacgaagaacttcaagacagagctgcagagggtcaagccccaaggtcggggccttctgaggataggccctggtcatctatgaagtcagcctgtccctagggcgagcccagaaacctgagccctgcgctcagaccccatagcctgagggaacacctgctgccctgcatgtgccccctggatgccacctcagactcccgttctctgtggcctttccccagcctctgcttgggcatgtccacacacctctgaggcccaggcgaagccagccgtgctaagagggcactgggtgtgtgctgagcctgtggcaggcagggggcgggcccttgtccacagaggctctctgcagtgagttttgtttttttttttttttccttgagatagagtcttgctctgtcgcccgggctggagtgcaatggcatgatctcggctcactgcaaccgccacctctcaggttcaagcaattctcctgcctcagcctcccaagtacctgggactactggcacgtgccgccatgcctggctaatttttatatttttagtagagacggggtttcaccatgttggccaggctggtctagaactcttgacctcaggtgatccacccgcctcagcctcccaaagtgctgggatcacaggcatgagccactgctcccggcctacactggagtttgagcacacgcagctgtagccctcctggctgctggcaaccctgggatgagtctggtctcctgaggctcagcggcccttagcctggtcagagatgctgaggccccttggggatgcccacattcccccgtctaagggcagaggggtctcccttccaagcactgtgaggctaggaggatggagtgagagccgtgggcagatgtgtggcccatccagctttgctggccccccagccccgtcactggcagagtgacttctattccctctgccttcattctgctcctgctcctcccagctttctactctggctcagcctgcagcctccaccttgcgttgctgcctcccctgggcccagccgggaggataaggggctctcctctgcccaggcccgccccccgcccccgagggcattgggagaccactgtcatgtttgacctttcctgcttgggaaacatactccctgaagtactgggtgctgccaggctgggacacaggtgacattgctgaacatgcctgatactgaccctggggctttggtatttctcacattttcaaaaacttgctctgccagcgcctgggctagtctctgctcacaaaccagatgctgtggccatgtgtgtgggcctgggcacccctaaagagtgggcttgggcctgacaggcgaggctgccatgctaggaggcagctcagatgtgtgtggcacctcaagtttcgtccccaggtacagacagggactcttctgcaggctcaggtaaatgggaggcagggatgaatgccttggaagatcagagccgttgtggaagtaatatgtttatatatgcatttttttcttttttgagacagggtctcactcagtcacccaggctggagcgtagtgctgcaatcatagctcactgcagcctcaaacttcagcctcccaagcagctgggactacaggcacacaccaccatgcctgactcattttttaaagatttgttttagagacaggttcatgctatgctgcatggtggactcaatcacctgggcttaagtgatcctgctgtctcagcttcctgagtagctgggatcacaggcacgagccaccacgcctggctacagatacatttttaaaagtaaaatctatctgtgccaagacttcaagaaatataaagcttgggcccaaggctgaagcttcctttgtggcttcaagcatttcactaaagcgctaatttcaatcctactcttcccgagaagcctaaggcctcaatgtgttgcttaaatatcaggatctacaaagaccttgaactgtctttgtgagcccctggtcccaccgcactccttgtagacaggaggcagaccattgcagtgggtgatacccagcctgcagcaaggccagcgctcaacctattgctaccaggaacacgtactctcaggcctgccagaggccaccagacagatgtaaggcatctccccctgaagtggccccttttttggatggtaagcattttaaaacatcagttttacattaaagtaaatttggacgtattacttgcatgaaagcaaaattcacgtgaatttgtcaaggtaaactggagattctaaagctgtgttggcaaactctggccccagggccacctggcccttcacctgtttttgtaaataaagttttattggaacacagccacgcctattgatttatgaattgcctgtggccatttttgtgctacaacagtgggttgggtagttgcaacagaaaccatatggcccacaaagctgagaacattcactatgaggtgctaaaggaatttttgctaccaggctgtgcagaaatgtacttgcttagtgcctgccttgagctgtgatggccccaggcctccaaagtgagcatgtgcctttcactacatcagtgcacgtgggtgtacgtattagggaagtactgagcacagtgggctgctcagaccccagcccacccccacactagccttatcagctcaaaggaccggtgaggctacttcggggattctttttaaaggatagaatgaactgctcttaaccgctgtagaacggcagagcaggaggagcaggtttccgggcatgcagaatagtctctcccagctgtgttaactgcttatgttctgggagaatgcctgagcccccaaagcatctcttctgctgagggcagacacgctcctaggcctatggagaacgtggaatccaaggatcttctgcgccttcagtcgcggctataacctttgacccctcccagcacgagaacattctctgtacagtatgttctacgaccgttttttttgaatgaatgatttctctctatgccaggattcagatatttttcctcttttcatttctaatttaatccagaaattggcctggacttaccagagccttgccagggtttgcaaacaatccgaaggcatatgggctcaatttctcaccaactttcacgagtgctgagaccgcatggtggcggtggggaaggcagtggtcggacaggagtgttttcagctggtcgtggtggaaatctcgtaaactggccgcagagatgcaaaccagccaggcggaaggcgtcgccccaagtcatagttcacgagtcgctggctctggttcctgggaaagagaagaacatctctgaaactggacacgaaacacgggtcccttaagtggggggaggcaagcggggttcagggtctgctagtggtgctgtggccctgggggtgttgctggcactgtttctgttcctcacgcttgtcccgctggccttacagcctggccctgtgtgccaccaggagacacagccatgagggccagtggtgtgtgcgaggctgcacgcaaggctcagaagagggcagtgccctcacgtgctcacagtagccaggcccgaggggcccaggtggctgaaggctgttgggagtggtggggactcgggcgaccggagaggccacgcccccctgcagagctcctcgtggttccactcgcttgtgtttctgtaggaataagcagaccactgctgccagctcgctcttccatgagaagctggaaatctactttttttgggaaatctaattatttttcaatgtgggccacagattgaaattaagaagccacactgcacaggtgaagcagaacacggctgcaggacaagtctggtgtgtgggtggcctgagtgttctttccagcctagaaggaaggaggcgactgcctgtcctgctgcgccctgtgctggtcagtgccaactcccggggctgttgggagcaccactcgagttgaacaccaggaaagtgctcagtagagcacgggtgtgggaggagcatgctgggattgggagctgtcctcagtcatgttcggcactccctggactcctggcctccgcatccctgcactgggggagctcagagcacaggagtatggggagcgggatcaggacacgtgattacaccttggttcatcagggaagggtgcctggggcggctggtcagggaaggctcctcggacaagggccaccgcagttgcctctaatgaggactcctggtggtggcacagcgcgcgcaaaggcctggccgcatcgtgaatcgcagtgcgcagattgggccctgctggagcttgtggggcttggagagcgggagcgaggttgatttgtggtctacaaagatagactcctctctcttaggaggtttggggcttatgctttctatccttggaaacacccctccccacctgaggaggggaactcacatttgctggttttgcacgtgctggccctgtgcaaggaggcacacctgtgacctcactaccttgccccagtggccctgtgaggttcccttgcctgcatcaggtcactgagactgagagagacatggccagagcacggcagatggagtcacatacctgtgggaaggtggcccctgtgctggtcctcccctactgtctggcctgaagatcgagagctcccaaatcccctagcatgctccgcgggttctcatctcaggcctcactgacctccccacagcatttggagtcccctggccacacccgcctctccccgcaggccatccgctctgcctcttgctttgccttggcttctgcatagatctactgtgtcctcctgttctgaggcccacccgcctgcccactcactcccttagtgcacccggatagagcagccctaggtgctggggatgtcgtggtgagcacgggatccagaccgcagggagcacatgttccagcagggctggggaggccgacagaccagtgatggtgagcaggtggggaacactcgaacaggggtcttgtgggtggatctcacctctgcttcctcctgaaatgtgcagcaccctccccaccagtggacatctccccacctcctccctcctccctcctccgcagacctcctgatagctgatgtggaagcctcccagcatcctgtccttggcctcccgcggggaactgatggttgtcagaatgggagttagagtccctgtggacgaggagggccagccatccacacacccggatgacagcttgaggcagcctcggagcttgtcttgtgcaggctccagcaaggaggtgacagctgaaccacaagaacagaggcgatgatgtgccacgccgggctgtcgggctgacctggcgtgggctctcactccctgaggcccctcccaggctgcccctggagctgagttgcagtcaagcaatcctgggtcttcctccccagtccaggggtctccttggtggtgtgtctcagcagggttagggactcccacaaaggtgactttgtatcggacccagagagggtctgcccacctgatttttcactgagtacctggaaaaggcctggcacgtagtaggtgctcagtaaatctcttttgaatgaataagtgactaaatgaattcccataaagcgactgtgatctcagagactcccataaaaatgaactctatctgtgggtgtggaactcctcgtggctgggtgtccttatgccttcgcttctatgacagaggctgtgtctccatcgtccatgctgacgtctgaatggccaggtcccgggatacagtttctagttgcagcaggtttgccaaattgctcctcagagcctctgtactgactcccatgcccacttatgtgagcctctcaatctctctgtgcctcggcttcctcactggcacagcggggataacactcactcgcagggtgtgggaagggaaagatatcgcacgcggggaagtactcggcgtaggcggagaagatcagagccgaccagcgaggcgagcagttgttcactcggcccatgatgtctgggaagagccccagccagctcccgtcctggacaagcttttttctcatgggggccacctgcttgccttggcacagcgaggacagggccttggcagccaaaggagacggtcagctgtctccacctggtagtggagatagtcacagtggggtgatccttgagctggttttggtcacagagttggtgtctcccaagtggaaagtgggagggcatcattccacacagaggagccccttgtgcaaaagaggtgccagccctcggccaccctgggagcccgctggggtgggagaaggcgcgtgcggctgagcttggccttggtcctgaagcctggggaaacacgggagtactgagcacccaggttgcatcagcaagaatgcagaacagtccctgcctagtggagacggacagacagctaacaaacgaaggcgactggagatcacgatggtgccaggaagttaccaggatgggacagcacccgaggcagcatagggtgccccgtgggaatgttcacagagtgaggaaacttcagagcaagggaaacttccctgcagccagacaggaggaaggaaacctggctgcagcctgcaagacctcccacccgcgcctggcagggagcctggcctgggggctgcccatgctggcccttctgatcctgagcagaagtgatcacggacccttgtgcttccaataattcggcccctcttcctttggttctgggtttcctgtgtagcggtgggcaggatttcatctatctttccatctgccagagtctggcaagggagctaagccacataaacagactctggtggtgcagggggattgtgacctgctgcacagaagggcaaagccgtttcccgccaagcccaagaggcgctggaacatctgctctgggtgttggaaagcaccctgcatgactgcgctttcagggagggatacgctggcagcagacgacccttgccgtgagcttgtaatgcaggacccttcttgcagccttcaccttactcttgccctgcgctctgagtgccttgggggcccctgcccaggtcgaggggcacagtgcaaggtgatggcctgcagccctctgtcatgccttctcagtctctgaggggttcatacctgctctgccagggcctctcccttcttcctcatcatgcatggatgcctggggagtagggaggctggcctgagtcctcctcagctttgctctgaggtggtcgggtctgacgcctgggccacttaggcatgctggacccctgcccagtccaagccctatgccttgatgggtgtccactctacagcctctgccagccagtgccagctacccacgccctggccctcaccagcaggagctgctgcatcccacacacccccttctggagcgaggggcatccatgtgctgcctgaggcccattcattaacatgagatccctctccattctaaccacctgcttggccaccatgtgggttggcctccaccctcagcagagggtctcatctcagtgggaagtggagcccagaaccccggggactatctgcatctcaccctaaggcgggggcagcggtagggatagggctccggctccaagcctggtgtgggctcagcagcccgccccccaccccggcagctgcttgctgccccctcccccacaccgttcctgtcccctgatgccacagctctctcctcccatagcggcattttccttccctctttccttaggtcacactggtgacagagcagcggcagaatatgatgtgtgggggaataaaaatgcattgttctcaaattacatggtggtgctcaaacggacccaggtgaccgagctcagtcacgggatgggccgggccacacagcctctgagacgggcgtgtggggggatgccagggccgggggtggcacgagccctggccacttagggcccctctttgaaaggaaactcctcactgagccccccagggctctgtggccagggacagccgacaagctcagcagagttccagggaggcagggccgtcctgcagccactgctagcaagaatcagaatccctgacttttctcggcctttccctgtcagtggctcgcagtggccgagaggcccctgggggacactgggctctggcctgaggcctcggccgtgtccttctgcgtcctgcagcctcagcagcactggtccttccccgttctgcagcatttccctttctgatgaggcatccggtcagcgggtgggaaggtcagtccctaagtggtggcatggctgttgtttccccaaaggcgacgcagccagcggggagagctccagggctgggtcacactcgcggacgtgcctgggcacagcagcccctccagctctggaaaacacaggggcatgtgcaagctgttcactcagacctctcccaatggtgatggccaggaggagagccagggtgggtgtaagggcgaagcccaggtggaccattctgtgcatggggtcccagggaaacagcttgggctgttggaccctcctgtaatttgatgacagtttcattcagcctgtactaggtgctggggatttcacttttgtcacgcatgtccgtgtgaagagaccaccaccaggctttgtgtgagcaataaagcttttgaatcacctaggtgttgtttttacctaaatcagtctggcctggtgtatgacaacataaactcaaggatagagcccaaaaactcgccaaccaagcaaataattatgctgaacccccttgggcactctctaattggatgtcctgggtcctcccaattcttagtcctttaatacctgtttttctccttttattcggacgctgtgtcttccgtttagtttctcaattcataccaaactgcatccaggccatcaccaatcattctatacgacaaatgctccttctaacaaccccataatatcacctgttaccccaaaatcttccttcagcttaatctctcccactctaggtttccatgctgcccctaatcctgctcgaagcagccctgagaagcatcacccattatctctccatatcacccccaaaaattttcaccaccccaacacttcaccactatttcattttgtttttcttattaatataagaagacaggaatgtcaggcctctgagcccaagctaagccatcatatcccctgtgacctgcacatatacatccagatggcctgaaacaactgaagatccacaaaagaagtgaaaatagatagttcctgccttaactgatggcattccaccattgtgatctgttcctgccccaccctagctgatcaatcaattgaatttgtgaacaatacaccctctccgcccttggggtaatgtactttgtgatattgccacccgcccccgccggacccgcccttgtgaatctactttgtatgatacaccctccccacccttgagaagatactttgtaatattctctccccccaacttaagaagatacttagtaatattcttccccacccccatccttaagaagatactttgtaatattgtccccccctaccttaagaagatattttgtaatattcttccgcccttgagaatgtactttgtaaaatccgtccccagcccacaaaaaattgctcctggccgggcgcggtggctcacgcctgtaatcccagcactttgggaggccgaggcgggcagatcatgaagtcaggagatcaagaccatcctggctaacattgtgaaaccctgcctctactaaaaaaaaaaaaaaaaaaaaaaaaaaaaaccaggcgcactggcgggcgcctgtagccccagctactcgggaggctgaggcaagagaatggcatgaacctgggaggtggagctggcagtgagctgagatcatgccactgcactccaacctgggcaacagagagagactccgtctcaaaaaaaaaaaaaaattgctcctaactccaccgtctatcccaaacctataccaacgaatggtagtcccaccaccctttgctgactctctttttggactcagcccacctgcacccaggtgattaaaaagctttattgctcacacaaagcctgtttggtgatctcttcacatggacgcacgtgataattttcattgttgcttcaacctgaaacaaccctgagacacagggactattattatctccattttatagataaagaaactgaggcccagacaggttaagtaactggccccaagtcacgcagcaggattgtggcagagcccatgctggcacccatgaaatctgacctcagagtgggaatatcccccccacactctgctaaccccccaaattcaggagagggggaggggcagcctcttgccgtcgttagtacaaacccgggaaggtttgtaatgcgacctgtcttctcaacgtgcctgctggagtgccacactgaggggtgcagcacatctcttgagaccctgctgggctctgtgcattgatgagctggcctggaagtggaggagccccgtccccaccctgaggcatctgcagaggtatcagcagagtgtggacaggcacaggagacgtcgcctgaggagtgagggggtggccttgggcagagtgttcctgcgctgggtattgaaggaggggactctgaccacctcactttttgatgtatgaactgagcctagtaattctgatcctggccatttccgtttcatggtagtttgatattttgagcaagagtcacgtttcttctagcattccctctgaagcatctgctgaggagccgagggtgaagaagatctgcaatgggaacgttgattctcatgataagcccaggctctggcagccccgtttaggcaccatgcaatgcctaaactcttcctccacggaggccagcagacctctgtcccctgctcctggctgcactctcttctctgcctccatcctggtggtccaagcctggcctccgaaggggcacagagagaacagccttctcctcacttatttcagggggtcccagagaagccacagagcagcaggcccccctcccccaggcctctgacagacttttcaggcctggcttgctcctggacatggttttgccaggtgggccacaggctgcctctggtggcccaaagctcagctgagcgaaggacatgggaactttcctgaaggttggggtggctgctgttccagggcccctgcctgtctcctctgtggctggcgggccagtaggcctccccagtagggagcctgcaccggttcccccctttctgcacccctcccccaccttggcagaggacaaagtcacctctgcccagcagccgcaggccacctcccagggctcaccatcccctgggtggaactctgccaccagtgaggcaaactttacattgccatgcagagccgctccttcctcattgtctattccagaacagaaacttggctgcatctttgcataagcaaaaggcgcattacaatgtgtttccccaaacaagagagcccttggcctctctccgcacagagatggctgcggctttgaacatttccccccaaggtttaaagattccaggatcaatttctcagacagtactcaaggacattgtccctgggcttcccctccccctgcaacctgggaaaggagagctgcttctccccagcacacgcaggccttgggtagggtggatgcggaggaggcccccagggctgctggggggaggggaggggaggcccttagctgggggcctcccccatgagaggggtcacaggcctacgctgggtcatacattttgcccatttcctgttattccatatcttcaaagtgattcactccattcattcagcaaatgtttactgagcacctactatgggctagacactgctgggagcagttgcacggcaagtccaaagttcctgaggtggagacaggctgcctgtgcaaggagcagccgggctagccgctggagcacagggagcagggccagggcagcccgagaagactcagcagggccagaccctcctggcctggaggtcacgccaggaactgcggtctcatgccttggggtaggaagggtttaagcaaggaggtcactgcctctttcctttgagatatattttttaggatgagtcttttttttcaaatgctcctgagatatctaaagaattgaggggctgcacagggagagtgaggattccaggcctgaaccaaagcacaggcagcaggagagggcagccggctctggggaaggctggctgggctgtcaggagcaagggtgccatgtggggaggtatctgaagtgacgcatggagaagccagccagggccagcgtggagagggctccgaatgccaggcgaggggctgggccctgcttccgaaggcactggagagccgttgagggttttagacagtggaaggggaaggtgagatctattccgcttggtgatcgtagtgaagaatggtgtgtgtgggtgggggggtggggaggacacgagggggaccgttggggagccctaccgcctgtctcctgtctggcagagaaagtgggtggggccgggggaggagggggatgtgcaggaggcaggcatgtggaggtcgccttctgtcttcagttgctctttttgccacatcagtcgactctctgctctgcagaaatgttgccgctgtgtccttactgaggacgccagtgttttgtcgggaattacactgattactcccagtggttcccatgcccaggtgggccctgcaggcctctggccagggctgggcaggaaattttggcaattttgcagcctcctgaaaagcaggtagagccctgggatggtagagggggcaggacggggctcactcctcaggcccacggaggacaaggacactgtggagcacccctgcctctcacatgccccacaaaccctgcctgccccccatgtctgttcctgatgtatcatattaacctacggggactgagaggctggacagcagaaggagcccggccccggactgtgggttggactttgccatagcacacgcaggggcaggagaaccacccaggccagtggtcagtggtctctgggccacagtgccccatggggttcctgactgctgggaggggctgctgagacctggcctgggagggggccaagttgagggctccggagcaggatcccaagcccagcagccacccagaggagccaggaggccatcgcaagccccaccacggccttgctcaggcctgcctcccagagagtgggcatgcctggggaactatgtgctgtgctggtgtggaagggaggaagggacagaggtttcctggggagaggatcagggagagcgcaccacagttgaaggctaccagggagggagggctgagggggccttggctgcggcctggcctccttctccctggctacctgctgggagcatttgcaggcatgccctctctagctcctcagcagccagggagccccagttaatctccgaaccatctgaggcttccagaggccagggtcagggcacccagcgcaggaggtgggagctggctgctggcggacagcccacagtggagctccccagccaggggcccacgcctagcagcctgacaccccagggctcagctgcctcgaccccacctccaagcagaatgtgaggctgacggtctatcccagggagttccatgcccagcgacggggcttttggagtggttggtcacctcctgtcccaaatcagggagcaggattagatctgctcaatgttcagaaggacacaagattccttcttgagatgagagctgccaccttcggccccaggggtagggctaggagagtgggaagatcttgcgtcctgaggggcagggcctggccaggagccaggagagggccagccccgcatctcctccctccgccctgtgggagctgccggaatgcccttccagagccccagcctctccctgctcaggcggggcagatgacccctattccaatccacatcatccctcacatccgtcccttctctgcactcatccccaaagctgaaccccacattcccacatcttgaccccttccatctactttccgtaaggcacctggagtaagcttcttaaatgccccgccatcatccttcctccatgtcctcccactgctcttagagaggatttggaatccttctcctgacttcgtggtctggcctcagtgctcccctcccacctcctctgctggggcatcccttccacatcccctctgtgcttggaaggtgcctcgctgcttccaaccctgggaggtttgcatgggctgcctcctctgccaggagcgccatccctgctttgctgagctaccctgttctgtttctcaggtctcatgacatgccacgtccttccaggccccagtgggcagattcccactaatatatcctctggttccctgcctttccctcgaggccggtgatcctggagctggtctcgtagcatctgagtgtccctctccgcctcctggcaggagggctggctctgatctactcagagccacaattcatggtgaggcagtggttctgctgggtctgctgggtgccagcctcagcccagtggggaaggagagaccaggtcaggctcgcccaggccattctgggtcccagggtgtggtgggctgcacaagaggccagggtcagtttagtttgagaagtcccattgagagcctgtgaggggcccgtggctgtgctgagggtctgtgtggacggtgaggtcaacatttacacgcttaggctcaaacgtggggaaaaatgcaactttctttcattcttttttttttttttttttttttagacagagtcttgctctgtctcccaggctggagtgcaatgacgcgatctcggctcactgcaacctccgcctcctgggttcaagtgattctcctgcctcagcctcctgagcagctgggattacaagcgctcgccaccatgcctggctaattttgtatttttagtagagagagggtttcaccgtgttggccaggctggtcttgaacttctgacttcaggtgatccaccgccttggcctcccaaagtgctgggattgcaggcgtgagccactgcgcctggccagggctttctttcgttcctatatctggtgctgccctcatctcgggcactcagccccaggatagaaggaaggctgcagtctggcctgtgggaggtggctcagtctcttccccataaagcctttgtctcattccgcttgggctggtataacaaaatgccatagacccaggggtttaaatcacaggaattcatttcccacagttctgaagactgggaatttcaagatcatgttgccagctgggtcattccccagtgaggattctcttcctggtttgcagacagccgccttcttgctgggtcctcccacggcagagagagaggatgcaggctctctggtgtctgttcctataggacactaaccctatcatgagggtcccacccccatgaactcatctacccctaattacctcccaaaagccccatttgcaggcagaggcctggtggggggcagtagggatgagtcccctctgcagtagccttgcaagcaggcctgccctcctctcctgtaggccagtgcccccctgggcttgccctgaagcctggtggtgccccctagagccaggtaaacctgcaagccagtccccaactatcttgcccatgtgtctctggggtgcaggggaccctggcatctgctacacacagctgggagctgggccaccctctcaggcctgagcaggctgggccaccagttgggccctggaagccactcctactgctaggaacctgtcccctctcaggtcccaggcagcagccaggatcaagctcttttgcatttccttccttctcagatgtcaggactgttctgtatgacctgtgaggttggggttgaggatgaggagaagcctggcccctcatccctggcctttctcctctctcctattctgctcccttcagctgcagtgggaccttccctcggtcagactccatgagccaagctggccaagctttgtcgtgatagagaaagcaatactgtggacaattacagaaaccccttctctcttaagaaaaactggcttttaaggctactgtgccagcgtggactaaacaatctagtctgaccctcaaagctgggcaaggacttctgtggtttaggggtgcataccctacccccaggacctcacagggagctgcagggcactatggtttaccagcaatgaaaaaccgtttcattgtttgcacaagcaccattccattgcacctgcatgacggtttcatccccacaacagctttgtgatggggggactgcaatcctcattttacagaggaaacggagggcgatgaccaaatggcaaggcttcctggggacctgggtgccctcctcggagctccatcttgtcagccacaggggcgagatgggtcactgggggtctagaggataaccctcagcgcctacaggggttgctgacccaccctccccagacgcctacagcccggagccacggtgaccagccacgctcccgtgggtctgatgagttgtcccttgcctataggaaagagaggtgggagttgtggggagcccatttacaatcagatgtagatttgctgggcagcagttgccaagaggagctgcgtttgggctggatggtaccctcagcagggtccacatgtcatgaactctgccccacgatcggtgccatctttgttcccagcaccgatgccagcgggcctcgggatccttgtcttgcacgccctgtatgcctgtccacccatccatcatgatgtcattctccttgtgaaccctcgggtttcctgaggtgccttcccactgttttgaggtagcaatcactgttgctcagatgcaggctctacagattggagtgcagggagtgtgtgctggcctgacgtggcagcaggctccgggaagtatgtcttggccatgtccggagctgtcagcagcccctgggctcggtctgcacacagccagtccctgtttctccacttcttgatggtgccaatggcttcagcctttcagcgggtatccctgagtgcctgccaggtgctgcttagcctggctctgggcgtgcaagcagggaggatgcaggtggctgcccagcccacaggggcacacagagggctccagaaataacacaccttgtgcttgatgaggggcggctcaggcctgcggggggccttccagggggaagtgactgctgagctggcctcgaggaggagtggggtttggttaaccaacaaaggaggtgacaggaagggggctgcgctagggagggccctgggtgtgtgcggtgggaagctggagggtgggggctcagtgcgaaggaagcccctgacagcctcgagcccgggataacctgacctatgtttctggagggtcttgctggctgtgttctgtagaaggggagttcacccccctgtttttgtgccacgggtccctttgatatctgctgaagcccattggcacctgctcagaataatggttttaaatgtgaagaatgaaacacgtgtaagaatatgattgtgataaatacagagacggcgactgcaggagctccagccatcaaaacagaacagggagagcacattggggatgcagtaatatgagctttttattaacacgttaaaacattatacctggtggtgggcctagaaccgcccccatttccaagtagcgatgcaggtaggtaatccccacacccaccagctatagcttggagtgacttctgccagggccggtcccagccctgcctgtgccgcgggggtccatcacccacgttcactgttgaagggaaggttgtgtttcagctggaggctacagcaagcgtagggctgctttccctgcccacgttccatgttcaggccccaggtgaggaaaccctgggctggtgggtggggttgctcaggaaggggctacagtgatcccagcaggtggtggtggcagcctggagaggcagagggcagggggcaatgagggaggggtcacaaggtggctcctagttgatggtgacgcctgggtggaaagcatgggaagaagaaggagcaggtgggggtcatcccattggcagagccagagccagtcctagggcctgtggttcccgctgatgcctccctgtttctttcaggtcaatgaaatctaccatgacgagtccttgggtgcccacatcaacgtggtcctggtgcggatcatcctcctgagctatggaaaggtgagtgcactgtggccagccgggcctgcctccaccccctcggagtgaggggcctgggagtgaggcatgggcctccttggagagtgtgtgcgtttgccagaaccaccctgcctctccctggctcccctgaggttcctataagaaacaagatccctgctccctttcaccccttgttttaaaatgtggccattactattgttcactgaaaagagtctgttactcccagatcccaagaggaagagacataccaggccacgggggccacacagggaggcaccaggggtggtcaggaggcagagggaattgggtaaacagcagcctgagtccatgttgtttctgcaggaaggaccgatggggacagggtgagctggcttaaggttggccagtttgaataattccagtgggctctggggagtggagcggtcctgagttagttttctgggtaatgagggcagggggatagtggctcagagtgtgaagtctgataaaggaggtggctggggacatgggcgctggattggttggtttgtatctgaaaaatgtgctcatggatgagttgtttcctgtctctaaagattggttaccacttagcggggcagtccctccagagtcagcaaggctcggatgtcaaagcatcagaaacacgtggttaacacgaccctcccttggacttctgcccccgtattaaatctgtggcctcctctcctctggcctcggctgctgtcccagctgggctctcttgcccgtcccacttcctcttgcagccaaacctgggacgtcctttcctggcggtgtgcatgggtgtgtagccgccagggacagtgacctgggatggcaacacgggatgctgtgcagacagaggaagagaggagccccacggtacggcccgtgtagactgcaaagtgcctgtaccagccgtgtgggaagcactttgtatggatgaatgcccttaatctacagggcagatggaggggtgcacactgtgactctgcccatttcacagataagaacaccgaggcttaatgtgacttagtgacatgcccaggtaagcagccagggccatccagcacccgaggagtcaggcttcttacccagacagcagaattcgagcctgtggtctggctgtgcatagaaaatcaaatcataataggatcaaatacatcagataattatataaaagttgaactctgttcaaagagaatctcagtctcaaaaaataaaatcaaactgcatacaacttataaggcacacgatgtaaaaatgatgacgaaggactccggtggcagaagggatcccaggaatactaagtagatttggggccacttccctacacccaccaagcacctcattccacagtgaccgaaggcacccacagggcggatgccagttgcaggccttcgtgtaccccaagagaacacaaaacatcccaaaacaaatccttggaacaaaggggaaattggcaaaaacctaactatgagagtctctaatacacttttaaaagcctttcacagattagatgctaataaggcatagaatttttgaatgacacaatgagtaaagctaaattagtagttatatcactgtttcccttgccctacagaaaaaaagaaagatgaaccttcttttcgaggaatcatagaacacttaaaaattacagaagtgttttgggtcataaagaaaatattgtgaattttatacagctaaaacgattttgtccatgttcgctgatgaaatgcctaaaagtaggggtgggggcagcagaatttataaacctaaaaaaatccaattcatttgaaaacattaaaaaaaaaaaaaacctactaggggccaggcatggtcgctcacacctgtaatcctagcactttgggaggccaaggtgggtagatcacttgaggtcaggagtttgagaccagcctagctaacgtggtgaaaccctgtctctaccaaaaaaatacaaaaattagccgggtgtggtggcatgtgcctgtagtcccaactacttgggaggctgaggtgggcgaattgcttgaacccgggaggcagaggttgcagtgagctgagatcacaccactgcgctccagcctgggtaacagagcaaggaaagagaatattaggactgcagtacagactatttggaacactaataaaaacaagagcactactgtcaaatcttttggaatgtggttaaagctgtattcagaggcaaattcacagatgttttccaaaagcttcttccttgggtgatatgttcgacacacattagccctgccttcaactcagtacatttgaatgaatttcaacagcaacaaaaccaaaaacttaaggaaagcaaaaataaggaaatagttcagaaaaagcagaaatcaataaattagaaaatggaagaaacacatagaatcaatgaagaagagagctttggaaaaagcaaccctctgacctatttaatctagaaaaaaagagagaaggcacaaactaaaagatcagaaagagtatatgtaatgtgactacaaaaagatacttctcctggcagaaaggaaagcatgcagggccatctgcccactaggaagctgttgggaggctctctgcagccggccacttcggaggtccagggatgatcagtggaggagggatgtgcagggcatcctctgccagtgaatgctggctaggagggcagagagaggctcgctgagccctctatcccaggtttgtggcagggggctttggacagatgcagagcctgggggtgggccccagcccagcaatccggttccagctctccattcacaggcggggaggtggggggggatctttggactatcccatgtggctggctgcctgcctccagtggagttccctgttccggccttccccaagccgggtctttccagcctgtcccttcctggccaggatcctctggtgttttaggaattctcaagcctttggcatgagagatggacagagttatatcctcttttggaagtttccaaaaatgggaaactcctggtcctggggctagaaaggggagaaaagattatcccattgattggtctgggtgccaggtggcggcttgcattttcccccaggttgctcctacattgtttaaaaagaagaattttgtaattgactagggttaattgcttaccagtgctggcaaagctttggatcttatttggcctgaaaagtgtctgctctttcccagtcttgagtacttgatggaataaagcctcctttattaattactccttagcaggctctatgctaaattatcccgaccctaagccttttctttttctttttctttttttttccttaactgcctcaggtaggtagaaggagtatgtgatcacagtcagaacatttgcagaagagagtcaaaccctgaaggtgagaatttgaggatctctatgccagggacacggagatcctggggaaattgaggatttcctgggatgtgaatatttcaaagctgactccaaaaaatggagaatatgccataagtcccataaccatggagggaactcaagttcttcaccttttccaaagttttgccagtgcattcatactcatttgcaagcatttatcaggcaagactaatacaataccctgtaaactcatgtattctgaaatctacccaatgtgtctttcgtagtcaatgggacccttatacccaaagatgccaaaggtagcccgtcaggacaaagtacagacctgtctcacttctaaaaatagaagtaaaaatcccaaggcattaagagtttaattgaataatgtataaagagaaacttctaccgtgatcatctagggcttatcctaggaatgtggagattgtttaatatcaggaaatctattcatacagttcatcacatcagtttccaaatgacaaaactcatcctctaacaaatactgtttgaagggcttctgtgtgggaagtgctgtgctgggaatattcactggcatagtctctgtcctcaggggaccgcttccagaaggcagatctagacaaggaaacaattgtaccagggctcagggctggatggaggagacgcgggtcaggcagtctttccttacaaggtcaggaaaagcaacgggaggaagtgaccgttccacccacacctgaagatggtccagtgaagtcaccagcatagagatgctctgagttcataggctgggaggggagggagggcagctgaacccagagggacgagcacagggacaggaacagcagacccaatgccaaagacgtcggaaggagccgatcgcaaggagcagagcagacctgcgtctcccgccaaggggtttggcttgcccatgagggcagctttaagcagtgacacgatcccatgtgcatttctaagaagatcactggctcctgtgtgcagaaggggcaggtgggagcagtggcttaggagacagtcactgccatcaaatgggggatgctggcagctggactgggaccaggcctgggtccagggatacagacaggaggacagaggaggccacttcgagaggatgtggcactaggtgggtgaaggcggagagactctcagctgggtagatgatggtatcaacccctgagattggggagcacaggagggaagctgaagaggtcagctgagatgtgcagttagaggtacctggtgccatcccagcggaggaggccaagaagatgtggatgtgggtctggagccctgcggggtctggagctgggggtagcagaagcaactgcaggcatgaggagcttgctgcctagggggagcctgggagagaggcctcagggctccagtgttgaagcctctggcagggcaagggcgtgacggccccgtagcccctcacagggcactcctccttttccagatccccagaaaactagtaacagagggcaacaggacaaccaagattgtatttaaaggcggaaaaagaagcacatttccctaaaagtgttctgcacagcgaattcttaggatatgagtagatgttacagaggactatagaggggtcccaaggtcaaagaagtctggaaaatgctggtcaaacaaaggaaaatgggcattcctgggggtgaaatttcccggagactttcctgtggagctgtgcatggtgtacctccgagagtccgagcagtacaggtggtctctgaaaactttctccacggaagcttcttgctcagcagatccgcagcctgctgaacctgctctggggagcactgccctggagatagtcttggaaacaaacaaacaaaaaagacccataaactagttactgtggttctgaaaatcctagatacttgtatgtgacatgaaactagtattggaaaagagcagagacaaattctcattgtttgctgttaatcatgtgtcgggaaaacctaaaagaatccacggtacaacttgtagagttaggagaggagtctggtgatgtggccaaatatcagaccattgtttaaaaaatcagtagcttctgtgtgaaccaaaaacaacagccttggtagtggggaaaacagggagagaaaatttccattatggtagtaaccaaaaatgtagaatacctggaatagtcctgacaagacaatggacccattggaaggaaattgtacctgattaatgataggaagaaagtgatcacaaatgaagacacaaatgctgtcctcatgggaagctgggtataatcgagaggttggcctttcccagattcatagttggaaatgttatgaagtgattctaagcaccatctaggaacacgaacggtcaagaatggctgagacagctgcggaacccaagcaaggaagagacatcctccaaaggaacatgaacggtcaagcatggctgagacagctgcggaacccaagcaaggaagagacttcctccaaagcaacatggacggtcaagaatggctgagacagctgcggaacccaagcaaggaagagacttcctccaaaggaacatgaacagtcaagaatggctgagacagctgcggaacccaagcaaggaagagacttcctccaaaggaacatgaacggtcaagaatggctgagacagctgcggaacccaagcaaggaagagacttcctccaaaggaacatgaacggtcaagaatggctgagacagctgcggagcccaagcaaggaagagacttcctccaaaggaacatgaatggtcaagaatggctgagacagctgcggaacccaagcaaggaagagacttcctccaaaggaacatgaacggtcaagaatggccgagacagctgtgggacccaagcaagtaagagacttcctccaaacatcttgtaaagtgaagataattaaaatagtgccatatgtgcataaactttcatagacagttcagttgaataaaatagttgaaaatacccctcttacaaataacctaccgtgataaacacagaatgcttattgtgttataaataaatatataacataaatttaataaataggaaattaaattatcatatgacaaatataagccaatacaacattcaactatttaaatcacacaaatcaagaagaaaatattggttgtcaagagctttctaagcataaatccaattgaaggaattgtaaaggggaatatggatatatttggataagtataataccaaacttctgtcaaaaaacacaatgaaaaggcaaatgacaagcaggaaaaacatttgcaatgtgataaatatatcttaatatataaaacctcctctaaatcataaggaaacaaaattgtcaatggaaggaaacaaagaaaaaaatccaagtggctaagagaaagcccatatggaaaaatatctaactctactgttaaagaaataaataatacaccatttataaagcatcaaccctgttaagatgaagagggatttatggctgggtgaatgaagcaggcacactttgagtatgagtacagatattctaaggaaatgtagcaatatttatcactgcccttaaaaatgttctttttttctttctttttttttttttttttgagatggagtcttgctctgttgcccaggctggagtgcagtggcgcgacctcagctcactgcaacctctgccacctgggttcaagtgattctcctgcctcagcctcccaagtagctgggattacaggcacctgccaccacacccagctaattttttgtatttttagtagagatggggtttcaccaggttggccaggctggtcttgaactcctgacctcaggtgatccgcctcggcctcccaaagtgctggggttatggggcgcgagccaccgcatttggcctttaaaatgttcttgatgtttgcccccagacattcatttctgtgaccccagacattcatttctacaactctgttccaaagcagtgatcccagctgtgggccaagttttaggaacaagacaagggtcatggcattatctctcatgtgaacaacagcaaacaacctatattgtccaataatagtggtctagttaagtaatgataaacctatgtggtagagtattaggctgccacaaaattgcattttcgaaacatgtttaatggcattgggaaatggttacagtctaaagctgtttgttgtttgaaaagcaggatctcagttttccgtatgatctcaatttggtgtacaaatatatttaccaaaaagactggaaggaacacatcaaatgtgaacaggatttctctgtgggcagtaggctaattaattttcattttcttctttgtactttactgaattttttaaattcaatatgatgagcatggtttttattattattattattattattattattattattaagagatggggtctagctctgttgcccagactagagtggagtggtgtgatcataactcactgcagcctccatctcttgggctcaagggatcctctcatctcggcctcccaagtagcttggactacaggcacgcaccaccacactcgactaatttttttttctttttttttttgtagagacagggtctcactctgttgcccaggctggtcttgaactcccaggctcaaatgattctcctgcctctgcctcccatagcactgggattacaggtgtgagcagctgagcctggaccagcatgtttcttttataaacaaaacactgcattttaaatttgtgaaatttaaattttttaaatgattttttaaaaaatcatttaaaaatggtaggatccaaatgatgccgtttgactgaattcagcactctggagaaaggtctccggtggcatgccacagggctctgtcacgctcagtcctttatttctgatttcaatgaagacatcaaagagaattcatgctttcccttggcacgtcatctctgcagtgggctggggaggagtaatgaggtttctgtgttccaccctatgggcgctagctcacgcttcctgtggctggggcagggggtccacctgcagcgggtccacctgaaggaaatgggaaatcttggagtgaggacgcaggctgccataggtacgtggtctcccctgcatgagaagcccacgcccctgggttagcaggcaccaccctcctggccagggcctccttggcccctgcccctcatgcgccttgcctgcagaagttctgctttgctgggacccccacccctcatgcacctgcagaagctctgcttcactggggccatgctggggccccacttccacttttggcagagttgggaatggggcagtgggcaggggaccggttgtcaggtgcagcctgctcttcccagggacaacatggggacatgtgcaggccctgggggtgctgagatccatagccagcaaaccagggcagctcatgcctgtggtgggcaccgggcaacttctgcgacccaggtacaaagagaacagagaggacataggtgaactgaggctggccttgcttccgcctcctgctgggaaggggcttgagaactgatggtggtgagggattggaagacagaaccggaagctggacgcacgcttccagagctaactccagatggaaccagcttacccccggccccgagggctcagtggacccgcagctgaggaggcaggggagaggcagtgctgggttgtgaggggtgtgggacccaggacaccccagtgcctgttcccaggcccctcagcctagcttggaggacaacacacagccggtccctctgtcagaccccgggaattcagggatgattggcctcctggaatgttctggaacattccagcattctgggcctttttttctgctcctaactcatgcctgcccagagtggggctcagcaaagctcaccccatactctgcccacctttttctgcctggccctaccccgccttcctcctagaagcctcccagatcaagcacaggaggcagtgatgggggtaggggacgccagtgcccatggggtccgctccatcccggggatctcctgagttgatcagctgagtgtagactgccagaagagccgggcctgcccgctgctgtgcccttctctggggggttctgggctgtgagaggggaagtgagccgaggctatgagtcctcgttgctttaggttggacctactgcaaaagtgcaggaaatagtagagcagaggaggtggcactgctaggggctgggctgaaggcttggggtagagggcacagcggctaggaaaatgggttctggtcatgggccctggctgacttagcgaatgtgctgtgggccacagggcttgggagcagcgtctgtgggaccggaggagccatctgccatccccaggtggccaggggagaggccatcctgggagcagcagtacacagtgcacctcaatgccaaagacctggctgttttctttttcctatttcaaacccatcacagaccaatacttccgtaccatacgttataaatgaattactgggaaaagcaaatgtgacaaaaaccgaggtatccaaaaactctaggtctggatttttattattaaattctgtggacataaactcaacccgtccaattgctataaaagtttctagtttctgtacttatctcactgtggactggaacagtttgtgtccaccaggcacagacttcactttgcatagcactgggggaggccctgttttcaggtctctgaggtgtctgatgaacgtgggaggagatgtatccttgtgcccccaaagcatccggccagcccagagcctctggcttcccgagcagctgctgtttaatcccagggaggtgcatgaacgaggaggggagaggagccctgtgtccaggcagtagcagcagacaagacagcgacagagtggtgagcaccggcaaggaatacagcagggtggcaggcaataggggaccatggatggagcagccaggatggggacttcccagccaagatctgggggcaaaaggcctagctcctgtgtccaagggaacagaccccttttgctcacagagaagcacagccagggattctcgatggggctctggggacaaagtttggcacatggtggggatgaattctgatgagctgctcttcaaggaaccacaggcttcccgtcaaggaatgaggcccccgtctctagaagaattttagcatggcaaaaccaaggcgatggcagtcaggagggggctgagctgtcccccccacggtggggacagactctgggggatgtgagaccatgacccagacttgggcagaaagtggcccagatactcggttcctgttattcatcccaaattgtgacagaaatagaccagctccccacctgccgctcccccattgcctgtcccccaggcctcaccaggctccagtggggataaaattggtagcacttgtttgagtgacatgtttgtcttctagcttatgagaagcctctgagttatctcaagtttttcctaaaacaacatttttctccatttcttaaaaaaaagcagaagaaaagagatgatcttattttatacaatataccaccagccagggagcagagcatcggcaacacttgaggttgcatagcaactggcttttcaattgattttttgagaaggtaccaaagctactcaactgttctcattttaaatatttcctaggatgatgaaaatcaaagcaaatggaaatcagagacttggggagcatcagagaaggacataaagtgtcttgttataaaaaaccaggtcaagacaaagtgtggaatgcttgctggaatttttcagcattggaggtgaaaggtctgagaaattctgcatgtgagtctcttagtggaaagcacgagaagagaggtgctgggggtgggggcttggtgtgcccacccacccacctatagggtagaggatttagagtggcccagccatggtgcaggaaggccaggaagtgaaggtctggggaggatatatcaagggccctggggatctgggacaggggatgaggtgggaaacacaccccatgcctcaccccagggacagccccctgtcctcctgagcatctgggtcccaacccccaacctgataggggtgcaaggcatgatggcccacccacatcatcctccatccacctcctcacccagacctacctgggtccagagaactaggaggcactaaggctggacactgcccttgggaggtgccttagtctgtttgggctgcaataacagaaataccttagactgagtaatttataaccaatggaattgtgttactcactgttctgggggctgggaagtccaagagcaggacgccagcagaactgatgtgtcgtaaggacccattcctcctagagggcaccttctagctgtgccctcgcatgatggaagggtgaacaggctccctcaggcttcttttgtaagggtgctaatctcatttatggagactccaccctcatgacctaatgacctctcaaagaccacacttcctaataccataacattggttctcagctttcaacctttcaaatgtgggggacacaacattcagattctagcaggaggcccctcttctgcctccccacaggcctgcactggctcatgcctgggaaggctcaagttgagaatcctgttctggcagcttggctctctctgggaatagcttcccaggctttggggaagatggctggaaacaaaatgctggaacgatatgggagttctggcagagaaatgaggtgcacgcctcctgccccagctctcgtggttctctgtcgtgatgagatttgatctgtaagccctgcctggaacaagagacctccagccttgggggagcccactttgcactcagctggggggcacggtagaacatgtgctcacagagcagggatggtgggaccttgtccctgccattcattctggctttgtccatactcgtgggacctttggtgagcaatttaacatcatggggccttagtttcccccataagaggaggtctgtgaaaccccagcacacaacaggaatgacgacaatcataaaggcgttcgtgcaagtgactgtttgtagagcttcttctgggacaggcaccgtctgaagccctttatgtgactttatgccctcacccccatagcaaccctgtggagtagacgctgtgatcatccccatttgacagtgaggaccctggctccagggggcgagcggcctgcccggggccacacgctggtggagccactctgctctgggaggaggggctggactctgtgatcccggctggtcaggagcaccagcttcaggctccttgtcctggtcccctgagggtcagttgctcccaaccaagagtgactttgccacccctccccccacccgggggacatttggcagtgtctggagagacttttggttgtcacgactagggggagggttccactgggttctggcaaggagtgcccaggggtgtgctcaacatcctgccatgaacagggtgcccgcctcacccaacaggaattatctggccccaaatatctggagtgctgaggttgagaaatgtggtctgctcaccagaacccaacctccctgctgtcctatcctgcacctgtttaggaggctggtctgaggcaggagggcccctctgggatggggacggttgagaagctttgctgaagccgcatccccttgggggcatgagccagccccagcgggtaggccagtccccagggactggtgttatactccatcagtatcaacagcacggcagagacaaggacaagggacatttgtgggcgctgactgcaccctgcctgaactgtcatgggcggaagccccccagctccaagctcggagctgcagttgtgcccattttgcaggtggggacaagtaaggtaacttgcccaagaacagagcagatgagatatttcggccgggcctagagctgcccaggtgacctcacctgccacctgcagtggacttggtgagcctcggtcgcgtggcggcctgcggggctggctgagtgcgccttgcccagcaggcagagcctcctggcggggcgggcgcggttccagcggaggcggcctccaggctgctgatccccatcccggtttcctcccacgtctccttgactgaaggagggaagagcatagataattcagctccttccagagcaaacaatggaaatgtcggagagcaacgattggaacagaactttttgctcaggtcataattgatgtatttagggtgaggcccagaggctgtcttggggccgctggggccccgggagcccgggtgcggccgcggagtctgggcgccgggtgcgtccccggcccgggccgctgttctcgcggcagcagcgccacctggtggccgctcgggcccggcccttcctctgcccgccccgcgcggggggcagcaccccgacctctttccggctgtgggactcaggcgagtcctttcagttgtctgagacgcagttcgtcatccggaaggtaggaaaatgaagtggaagcgaggtgtcgtgtgccaagcctgagcctagcggggcgctccttgcggacggtgacttcctgctggggtcagcatctgccggggcggccctttgggctcacttccccaggcctcccgagaacgtccccgcagccggcgcctccctccctgcccagcctggctcctgagggtgctcgtgttcattccttcatcactgagcgcccagcagccggggtcctctggccgcgttcgctgcctcatcctggcatggagagcagaagccgggattgctccgtgaagggaggagtggggctactgagggcaggcgtgggccagggctggggcacagactcgggcccagcaaccacccggccctcaaggagcttaggctttagtgactcagaggccagcgacagcaacaggcacatccccagtaggtgccccatctggcaggtgaccgatcgcacgcaggaggagggacccggcgggcagctcagagccagggtcccgcggccaggatggggctgggacttggagctggacgcagcctactcgtccacccaaggcccacgggccccctaagctcctggctgttccctgaggcccgtggggttacccagacccctgcaggctgggcctgaggttcaggggcccgcagtgtttcctcacccttgccctggccaagcctcctgacagccctggggagcattcagcaaagtgaccttctgacccaaggtgagggccatcaagctcttgcctccctaaggccctcagatctgccctctccacctcatggtgggatccctgggtctttcaggcatgtcctcagaccctttccagcccgggccaggggagccaaacaggctgaacccggaggaaacaccatccttcttgggaccaggctcccggtgctgctgtgggagggccccaggggcctggacgagtgtctgcctcctgcatctgggcagctctgtgaaccagcatagcaaggagggtctccatgtggacataggtgggcactcatgatggccaaggaggaccctgcactctggaagagccagcctggtccagggccccagagcactcgggcagtggagcccagttgggagcccatgtctgcagtggtcgatgtcacctccaaacaggggtggcagagccctccatgaggggtgacgactgtcctggggcccctgtagaggatccgatcagcctcttggaagctcatctgttcccgtgctctgagctagggtcagcccactcaggactcctcctgcatcctgggctggatgggcccctggacttcatccacagccctactgcaggcttctcccgcctggctcttctggggccctaggctggacctgggagttctgggagctgctgccgctgtgaagagtctgccctcagaggccctgcctcactcaggaggtggaccctgcagctaccatgcagccccagggcctcgaaatgtccatccccggtcatacagcaccatctaccgccccctgctctggaggctgggtgcccgcggctgcccctgggagggactggctgccctgtaaagtccctggctggtcctgcagccaccccctttgcagagcccagggtgctacggctcactcctggtccccccctcagcacagctaggaacaggtggagtcacacagacagactttcctagaggagccgtgcagagccgagcaggcagctggaagtcaggtgcattcaggactgggagggacgtagatgaccagggcgagctggtgaaagactcctcagtggaaacaagcagtgcagcctccctcacttctggaggagatccatatatgagaaatgtgtcttcttctcgctcaggggaagcacagttcccaggcttgatacatagcaagggcacaggatggtgggggctggggtgccccaggcagcagggacccatctggcctcctgcatgcaggccaggtggcagaggagcaaaggaggtcgcatcccagcaggtggtcccgctggagcccaagtgacccacaggggagttcactgcatgtcaggacagtatccttggctggaggtctcagcggagagacctgagcttggctcttcccttgggttccgactgcctccagtagcgagggccttgccctgtccacggccagcccagacttccctcctgggccgcagacctgtccagctgccccgatgtctctgcctggacatcagtttctttctgtgaggagtccttagaggcatgcagaacccaaggctgcctgtagctctcatggagtgggaggagtgggtggaggaaagggggctctggggtgcatgagcctgagtttgcggatggttgttttgggtgctgccaccaggcaaacccacttcagccagttttcagtcctttcgaacctgtgctccatgggcctaacatgggtcccagctacggcttgggactgatcacccacaagggctgcacccccagaagtgggagagctcccaaagcaaaacagcccagctcttcccaacgagcaagctggccaggaaagacattgccgtgaccatgtttcctgcactgcggaccccacgctcttcctctggcacttgccgtccccttcccgcgccgcctcttctgccttgctaccaatccccaaagccagacactggtgccgtctctgcctcattgctcccgccctgcagccctgatgcctctcagctcctgccaccaggtcctgaccctcctgacgtggcaccagccacacctgcatgcatctcagtgccacactgtccccttctatccccactccttcctcactgacccaaagggctgttttaagaatgcacacagaccttgccctggcctctgggcacaaggtcaatgtctgggcctcatgggtaccccatagcccttgaatgctccagacccagcaaggacaagatctctgcccctgggctcctctgtgcccgtcagagataggctgggaccttggagatgttgggacgttggcagagagagagaggaagcacaagcagctctgtggcttgtcagttaagctcccagtggcaggttgagtcctggggtgcccggacactgaggtaaccctctcctctacttcttggggtaccccctgctgggacccaggctcccagggtctagcacactctcatgtctcctgaagtcctgcctcccagggctcccctggccccagtgcagcttcccctccctgtgcccatgcaccccagccctcccctctgccccctcctcagggagtctcctcagaaccccaaagccagaagggggtcatagacccctttagctctggaccctgcagcacaacctccttggggttggagaacgaaagtggcaggctgccttcttggactgggccgagaacaaagcgaggcaagaacaaaaacacaaatcaatatttcaataaattgtcttgccgcagcagcaagatcactttggctgctaagacgggctgggaacccaggctgaaccacagaagccagcatctgggaggagagaggtgatcggccagagtggatccagtctgcaggacgtggagaaggggctgcccactgcagggctcttattccagggttctggaataaagtggtgacggggaggatgcgttgttttgtctgcataactgatttcaatttgagccagtgtttactattaggtaggtgtctgtagaatccagatttcacgattgacctgagaaatctgatccagcagctctgggcctctgttcctgccagcactgggcggatgttgctcccttcagctgtgcctgggcacctgggtttgccacagtcctcgccactccttatcaccgacccccactctattctaatagggaaatattcctctgtaccctttctccttcaaaactgggaaaacacaagatggacttacttttcgtgcaaccagcctgcctcattgacttgtcacctgccttgctcctgtaggcgcttgggtttctagcatcctcccggtactccccacaagcccacacactaggatagcggacctccctgcacacccccagcctgcctcagcctggctcctcccgcagctctgtcctacacactagcctcattcctgcctctggtcctgatattggggcatgtctttctggctggactcttgactcctcctcaaagacttggccagggcccttctcccactgagaagcatataaactgcccccagaacatatcagctgcccccagatcagacgccatctttcatgggccagcgagtgtcctgactggggtccctgtggtcccccaaaggaggaagcacgtggctcagattctcttcgctgcaagtgacaagagcacaactcagaattggctttcacaaggagaggaacttcttcaggcataaatgacacccgtcagtggcaggcagccttcgtgatggccgccagtgacccagtctcttaatgtccatgccctgcggtaggcgggactgagattctatcaaaagcagactgtggcttctgtaggggaggtgccttctcttgttgtctcttgggtccctcgagcaggggcgaccgtgtggggtaaagctgacatgggtgacggccccaggaggggcccatacggtatggtgtgcaacagctcagctggggcccgccgtgaccacctgaatgagcctgggagctgacccgcctccggtacagccttcagatgagactgcagccccagtcttagctcgacagtggtctcatcctcctttaatccttggtggggggtctcctgtagtgcaggggggctccagccgctgcaggccccccacctcacaccttgcctactccttggcccgctttggttgtatgttcaccctgatccttcatggtggccaggaaggcgtggtgctgggattggccaggcctgcctgcccctgaagcctggggtctgactcagattaaaggaggggaagtttcacgaaagggaaacaagggcaggcagaagtcaccgcaacccaccagggcatcggaagggaccgtcccactacatggggcttaggaccctgagggcaggtgagttcatcttggacaggactcccttgacactgatgctgggagacgtgccctggaggaagcaaggcccctttccctggagcccagcaaggctaccgagctgtgctgggtgtcctggatggagacactcacactgcagcaggggccctgccaccaccctagcaaaagcgcttattagtgacctttgtgctgaccctctgatttggatttggactggcaatttttaaaaaatgtatgttaaaaagtcattcttgtttggtttttgattttgctcttactgttatttttaattggcatgtaataattgtacatatttctggggtagggtgtgatatttagacacgtgtatgcaatgtgtaatgattacatcagggtaattagcatatctgtcacctcaaacattatcatttctttgtgttgggaacattcaaagtccactcttctagctatttgaaaatgcacaatacattcttacggattccaggcgctttccggcactatagggcactaacgcttattcccccatcttgccgcacttttggatatgttaaccagccttggcaatccccagcccgctgccccccactctccaggaactactctctatttctgtgacatcaactgttttagcttccacgtatgagtgagagcgtgcagtatttgtctttctgagcctggcttatttcatttagcataaggtcccccaggctcatccatatctgggctgccaatcttaagttcagcgagtacaaccaaccacaaggcccacgctctagcaccgaatcacatccaccccgagtttcccttccttcttgtgccatcccaagctcaccccctagctggagacagtgagaagggacattctttcgcccgattcctccttcagaactgtgacctctcaaggctacccagaggcggatactacctggcagggactcgagatgagctgcaggggtcaggcttggatgtgatgcagatacccactcccttcctcctgtatcaattatagtaggtgaggttatgctacagaaacaaacacactttgcatcccagtggcttaaaacgaccaagatttcctgctcacgctgtatgttcaatgtgggttggcggaggattcgggtctcatcgtcactcaggtcctaggtgacagagcagccactgtctttatgttgccagatctcgtgccagaaaggagagctctctgaagggtctcaatgggaaattagatgctccaaccgaaaagagacatgccccacttttgctcacagctcattggccagagctagtcacatgctcttcctggtcatgatgggaacaggaagtgcacctccccttgccctcctccagcttcctctggtctgtccacttctatgccaatgtcccacaagtcttagtcacaggacatcacactctgatttatgacttatttcatcgggactcatggaaaccttgttagaatgagttatcttatctcccaggagcaggaaataaagtctttacaattaactctgtgcttgggacttgggaattggtctgccatcttgtcagtcattgactgggacccctgggaacgacttgtcttacctagccttgaattgtgctcccttcttctggaactaactggcttgctaacaataccctttgttgtttgttttgttttgttttgagacggagtctcactctgtcgcctaggctggagtgcagtggcgtgatctcagctcactgcaacctccacctcccgggttcaagcgattctccttcctcagcctcccaggttgctgggattacgccaccaagccagactaagttttgcatttttaatagagacagggtttcaccatgttggccaggctggtctcaaactcctgacctcaggtgatccacctgcctcagcctcccaaagtgctgggattacaggtgtgagccaccgcgcacggccaactttttgttatttatagacacaaagagaaatacgtggctctactttgtggatacatttatgcaagagaaaaaacacctgcatacgtagcttccaaggaatgcacatctctattttatggccagataaatccttaaaggggaaaagaacatgcccaggactcagaggggctctcggttctcttggagggaactacttcggtgtttggagtctatggtgagaacagaaaccaaaatgcctgctgtgaggattgtggaggaaaaaaggaagggtgccgctcacagaagccttgcttttgaaatgatattgtgtatgtcttatttaaggaggaagtttagggcagtgagttgaatctagattttggtttcagccttcttgggatccgatctcaattctcctacttcctagtttcatgacctgggcaagcttcttaacttctctgagtctcagtttcctgtccaagacaggcttcttagtcctgaagtctaaatgggagtgcctgctgatgtcatggtgcagagagagtgtgcaagacgagcggtcccgaggccaccctagctgtcaggtgtgcgtcatgatacaaaatggaatgggatggttcccgggggcttcccatgcatagttcctgtgggaatcatctgtgtatgcccttgttcttgatatggctgtttttctattaggttgatgccaaagtctttgccattacttttcatggcaatactgcgattacttttgcacccaccaaatatgtcagttgctgtttcttttcctccattgtgttggtttctgcaagtaccttcacacggggggaacgtataaggtgatctgcttcctctggccttgcacaccacactggaatttccgcctcccctgccacggaccctcccaaaactgtgagctctttggggtgaggtccacatgacatttgccttctgtggaggccttgcacggaacaggtgcctcatagaacaaacacagggacttctggaaatggggtagacggtgggactatgcgaggccttagatgacgtagagcttggcttctgcatctcacctgaaaactgcggtgactttgtgtggaaactcacgcaggtgagtgtgactggggaaacttttcttccctgtcaaagactggagcccagtgggagcaggtcctgagagtgaccgggcagggcctttgtaccacctggaacagattcccagtggatggggtctgtcaacactacagcctgctcggccccccactgggccaccaggcgccaacctctctcttccatttctctccatccccctgcagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggtgagcctcacccatgcagggccacagaggcgtgaagctggaaatgagcccctggccatgcaaggggccccgggagccttggcccagcccagggaagagtgtcagggcagggaaggccgtggccaccttagctgggtgagggtgtggggcagtgcactgatggacaaatacatcattagaagagaatccagtgtcctgaattggacctatgtgtatagggacgctaatgtgtcacaaaagtgacatttcagagaagaggaggaaaacagcctaacaaatggtgtggggccaatttggaaagaaaggaggcctgtcacctccactcactctatagacagagagcatctcacatggattttaggtctaaataagaaacgcaaaataatgaaagaagataacgtaggtggatggctccatgttcttggagtaagagatgttttctttaaaaagagacaaaaggccgggcgcggtggttcacacctgtaatcccagcactttgggagtcggaggcaggtagatcacgaggtcaggagatcgagaccatcttggctaacatggtgaaaccccgtctctaataaaaatacaaaaaaattagcagggcatggtggcgggcgcctgtagtcccagctacccgggaggctgaggcaggagaatggtgtgaacccgggaggcggagtttgcaatgagtcgagatcgcaccactttgctccagcctgggagacagtgcgagactctgtctcaaaaaaaaaagagacaaaaaaaaccaaacaaaccatgaactcaatggaaaaaactgataaatagtagcacatttcaaaagtttgtgcattaaaggcacgctaatccactgggggaaatatttataaaaaaggatttatatctgaagtatgtgaagaacgcctacaaatcataataaggataataaagacaatccagtcagataatgggcaggagactcttatcaggctcttgacaaaatatgaatgagcaataaacatatgaaaaggcactcaacctcactagacattggaaaaatgcaattaaaacaatgaggctgggcatggtggtggatgcctgtagtcccagccactcgggaacctgaggtgggaggattgtttgagcccaggaagtgagctatgatcacaccactgcactccagcctgggtgacagagcgaggccttgtcttacaaaaaaaaaaaaaaaggaaaatttaaaaacacaatgaaatatcaagacgcacctaatagcatagctaggttaaaaagactgaaactaccatgtctgggtgaggagtggatagctcccctcaaacacagcgcagccaggtgttgccctgaccatgtgatgagagtgctgttggctgttttgtcttggggagggcactaatggggagcagagctatcccctaggaggggaaaccgacacagcttttatattaagtgacctgatccctcatttaaaaatgtgaaattggctgggtgtggtggctcactcctgtaatcccagcactttgggaggccaaggcgggcggatcacttgaggtcaggagttcgtgaccagcctggccaacatctctactaaaaacacaaaaattagccagtgtagtggcaggtgcctgtaatcccagctactcaggaggctgaggcaggaaaatcactagaaccccggaggcagaggttgcagtgagccgagattgtgccactgcactccagcctgggcaacagagcaagactctgtctcaaaaaaaaaaaaaaaaaaaagaaaaaatgaaaggacagccaagggttaccagatattttaaaaaaaccaaaacacaagaaatccttacagcatgaaaaagatggaccaagatgtaaaacaaaacaaaaagtttgaaaactggctctaagagaaaatagagataatttagagacaagaaaagcatgtttttaaaagtagtattcccagaatgtttgagaaaatacatccataaaccctaagagttttctatgaaaaattagagaacaacaaaccatttgtataaaattatggataggatgggggaagtaaaaaattcgaaaggtagacggggcgcggtggctcacgcctgtaatcccagcactgtgggaggccgaggcgggcaggtcacgaggtcaggagatggagaccatcctggctaacatggtgaaatcccgtctctagtaaaaatacaaaaattagctgagcatggtggcgggtgcctgtagtcccagctactcaggaggctgaggcagtagaatggactgaacccaggaggcggaggttgcagtgagccgagatcacaccactgcactccagcctggacggcagagtgagactccatctcaaaaaaaaaaaaaaaaaatcgaaagctgaaataaaaagtcaaggccatctcccaatgggagcaaaagacaaaaagattaacatgagagaaaagttaggagacagaccctccatcgaggaggcacactctatctaataagattccggagagagaaaacagccacaaagtaaaataagagggaagaaaacaaagaaaaacataaagatgcgctttcagatctcgcaggctcctgtaatgctgagtaggatgaatggaaagcctcccacggaggcagatgcatctgcaagcctggcatacaaagggcaaagaggagatggcaacgttccactcaggcacacagactccacgctcgtctcaaaatctgcagagcaaaaaatgcagattttcctgtttattacaacgggaaaagacaagggttagatcacgatgcttctatttttaggcgcgtacaccgccagctcacccggggtcccagtggccctccttcccttctctgtggaacgcgtggcctcagggtctctcagtggggcatggcaggagtgagggcaggttggggttctgaaagtcagggctccatgcttggcaggcctctaggaagactcccaggggtacaagcagagacctcgtgtggcacccatagccctgtaggcacttccctatctttccaagccgcctccctctgctgagacaggagctggggaagtgaataggtctcattatccatcttcctcagtttgacgtggggtctctgcgtcatgaacttctgccaccctccccctggccctgggctgtcgtaggccactggcctcatcttctacggcggctctgacctcccagtccgcaccagccagccccctgctgggatattctgcagggtagtgtggcccatcggctgaacagctttgcagccttctgcggcattatggaaacaggtctagctagggtctcaaggaccccagagaaacacggggagacccaagaaacgccccccagaggaggtgggcttggagggtgtgataccaggcagacgaggggcaggatgcctctagcagagagaggtgtggaagcaggtgctgctcaggggccactcagtgaggcaggcagggggcagaggcaggtggcgtgaaagagaacggcaggcaggaaagtcaggtgtcagacaagccatagcaggtgacatctgactaagcagagggccccagctgcagtgtggctgttacaggcagaacggccacggggcttgtgtggtgacgggctgggggcctgctgtcagccagatgtcacaggctatgagctgtctgctgtggtgtcttctgagctgtgccagccgggggcagttgcctgtggtagagagggcattggggccttgaggagaagcagcgcctgggagttaggccaggcctcaccttcccggccaggctatggcagcatctggagccgcctcttgtctcctcccaggctatgctcctgtcaccggcatgtgccatccggtccgcagctgcaccctgaaccatgaggacggcttctcctcagcgtttgtggtggcccatgagactggccacgtgtaagtggcctggggaagggtggggcacagaggggccaccctaggatccccagccctggctgcccacttctcctctgtgccttaagagggacacgccctgtgtcaaagccacttggggtgtggtctcctgtcttcccagcgctgggcagtgctggcccgaggcccacttttgctgaaggaaccaattgaaggaggaagggcttgcctgcagactgagcaggcgctctgggccagctagagctggggaccttgccccattatcacatccaagcccccaggcagggtgggctctaccccatgttatagaggaggctcggaggtttggagggtggctcgccctgggttagaaacctggaggcagggaagccacggtcccccccaggtgtgcatgcccctcctggggacaggatacctgggggactgcccgctggacactgtctccccagagtgcctcggctttcaaattgcagcaggtagatggtcggtgccacccggctcagagtgggccaaggtcaggaggcccgttggggaaagatggggcaccctcctatcatcggggtggggtgggactggcagacccgtgtgccagtgggattcagccagctgcctcggccctcgcaggctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcagtgagtactgcccatgtgccccgtgggcgacccctcagtccctggggtcagctctgggagggtgcaagtccccatgcaccagagccagagccctccgacctcaggtcctctaagcttgtgtgcgggggaggagagagggcacacctgtgagagaagcctggtgtctggaggagaacccattgtcaggggtctgtccttgaatggcaagtgggcacggcggctaccctggggtccgctcaagccaggtcctggtgtcttacaccaaggacaagagatgcagcagggaaactgaggcagcacagccaggggccgggatgtgcaggtagggctgccatggcagctccagcaggggcctcagctgcctccagggctgtggatggtcagccgcgctgaaggctgctcgcggcaccgtgtgtcccccacagctcctatgactgcctgctggatgaccccttcgcccacgactggccggcgctgccccagctcccgggactgcactactccatgaacgagcaatgccgctttgacttcggcctgggctacatgatgtgcacggcggtgagtgtgcagccctgcagccgggaccctcccaggtctggggggaggcgtgctggtgtaggggcagctcccgggacagtgtgaggaccggcccagtgtggggagggcagagcggccctccagagtggcagcctgtccctctgcacccaccactccccaccccctaggcaccctgagcccacctggcaggcccagacgtggtcctaggcaggaagcacacgggggacaggactgtgaccagggtgtcagccaggggcagtgagagcctgcagaggtcaggagggctcccaaggaagaagggaggcctgcaggctaagcggaaggagagggcattcaggaagggagggccacggacgcagaggccacggacgcagaggcctggaggagagcgcggcaggcacaggagcactcgctgctctccagggccaagtgccagggctgagccgtcagaggaaccggccatcggcatggaggccacactgtgggagcttcagtgtctatgagcgtcttaatgctcgcctctgctgcatgaaggaaagaagcaaagtagtcccattttacagatgaggaaacagagacccggagaggctaggtaacctgcctgagcccacaaagcgagcaagtggtagagtcgagtaccaacgcaggagggccacctccttccaagactccctaaggagcacagtggactcgattctcatggcgatgggggctctggaaaggcttgagtaggggaggctcagggccacgtctgagtttcagctgatccctcagggacgtcctgcaggaagtgctatcaggacaggaagcagaaaggccagggaacaggactgtgaagtccaggggaggccgaggctgcagagagggcaggcctgtgggggtgggggtagggcttcgccagggtttaggagggaaatccacggcaaagggtcagcaggtgcccacctagcctcaggctggcacttagggcccagctgcccgccaggctccctgaggtgtgcagcctccaaagactggaggcagagaggcccagccgcgtccagggatgctgcagcctccacaccgtatgggcaaggtcttcaccaccccagaatcacaacacccaccagcctcacgggcccatcatgggccagtcccactggggcatctcaggttccagaacccgggggtgggtggcatccctgggaggtccctgaggtgggagggacctggcaagctatggtgctgtcttccagttccggacctttgacccctgcaagcagctgtggtgcagccatcctgacaacccctacttttgcaagaccaagaaggggccccccttggacgggactatgtgtgcacctggcaaggtgaggcagcatcaagggctcttggagggcagcagggcagaggacaggaatcttaggtgcccgggtcaccagggacaggccctgaagtgggggtgggggccctctcaggggacctctgctgccctctcctttcccccttctaattacccctcacacgctgtacgccggagctgcctccaccctgtgcttctgatgctggagcacacctggcatctgagagttcctcatggtgcttcatgccccccactcaggaatccccctttaaggagcaatttctggggtcctggcagccttcggtcacccctgggcactgtgggtcacctcacctggaggccagcattggagtcctcgggcccagcatgaggcttaacctttccatccccaggacctcagtgtttgtcccttgttgggcacactgtccttcgaggtcccttgatggctgccccaggcccacttcccaccctctggtgactcttgaaagaaggacttcttccctgttgtcctcccagaactccagacctgattctcatttgttcagatgaaatcacacacccactcctcagccagttacttgctagggggctggcatatgcagatgagctaagcctggatccccacccaggaaggctcagccccactgagaccaccttggccctgcagtgggggcagggagtagggagtggacaccggtgcacatcccagccaggcctaggacgcccccaaactgtatggacctgtggctccttgatggaagtctttggctcgggactgggccagctgcctaattttagtctctggcggagcttctgaaagaaacaaattcccaggcccatccttgaagacttttgtttggggtaggatccaataattgtttttggtgttcttttttaaactatggtaaaaattctcacaaaattcactatctgaaccactttacacagttcaggccgggcgcggtggctcatgcctgttatcccagcactttgggaggccaaggtaggtggatcgcctgaggtcagaagttcaagacaagtctggttaacatggcaaaatcccgtctctactaaaaatacaaaaattagctgggcgcggtggtgggtgcctgtaatcccagctactccggaggctgaggcatgaaaatcgtttgagcccaggaggcggaggttgcggtgagccaagatcgcgtcgctgctctccagtctggatcacacagcaagaccctgtctcaaaaaataaaaataaaagtgaagtgcaccattcggtggcatttagtacatttgcaatattgggcaaccatcgccactacccggtcccagagcttttcatccctgcaaaaaggaagcgccatttatcagtcacctctcccctccctcctcgccccatcccctggctagcaccaacctgctttctgtctctatagagttgcctattccggaatttcatataaatggaatcatatatatgtggccttttgtgtctgactcacttcattcagcagaatgtttccaagggccatcctgtgtggcatctatccacattccatttctctcgatcgctgaataacctcccgtcgtgtgggtgtgccacatttggtgtatccgtttctccacggagggacatttggttggtttccaccttttggccgtcgtgagtcacgccgctgtgaacatttgtgtataaggttttgttcgaagacctgggaattggtgtttttaagatgtgcccagacttaatgaagggttagaagtccgaagtgagttgttggtaagttgctgggggcccagtgaggccagaaccacccagctattccccttcccacaggccctcagcagaaggagcggggcagaacatctgccgtggccccagggggagcttcggaaaagctgagttggagaacaaggccagctaagcatggctccccgcccgccgcacccaccccaggcagggaggaggcagagggaatgggaggcaggccctgcacaggcatgctggttcagggagcaggagcaggagcaggagctggtggggcccccatatgtgtgtgtgtggctggcctgcaccccagctgattgccccctgcttttcctgcaaggtagaagtggggcagagggaggtctggtaaggacagtgagcagatgcaaccgaagtgtccccacctcacagagaccacccacctggccgcagcccttcactcattttggtggtaggatcctctgcatttagcccagtaagtgaaattgccttttatgtattaaagatagttgtgctgactgaggggcagagctggggctctgctcagcctcccctggttcccgaggagcacaggctggaaccgacctagatcaggattcggtgtggggatgttgggggaacgtggaagacgggctcctcccgggctgctgtcagaatccctgaatgtgggtctgtatgtttccctgtcctgtgcatcactgttctctcacgctgtgattttacatctggaaagcaatcatcttctctcccaccctttcccgcaaggaccctgagtggtcatgcccagcttccatttccaggttaggcaccgtcttgcccagttgggacaggaggaccactgcgtggctccttccatcctcctggctcctggttcctgcggccaccagtgacttagagtctgccccggccgcagccttccacggtgccaggacagctcacactccatcttcctcagcttcggctgctctaacagaaataccgcagactgggtggcttacacaacagagccttgttcttcgcagtcctggaggctgggaagcccaaggtcagggtgccagcaaggttggcttctgggaggaccctcttcctggcttgccatcttcctgtggtctcctcacatggcagggagagagggcatctctctcaggtctcttctcatgaggacatcagtcccactcatgagggccatcacctaacgcttcccgaaggcccccacactgggggttagggcttcaccatatgaatttgaggggacacacgcactcaggccacagcactgccttacctgggcccctcctcgcctgcaaccccacctgcgccactggctgaggggaacgccagccagcatttctctgggttgttcccctcccctccatgctcgagtgaggggagctttgggggcaagagatgaggtaatggtgcccaggaaagagatggctaggaccccccaggggccgggagccaggcctgcctggccccagccagttcctgttggcccagcctgatgggaggagcccttgaccacctgcccacagtacccccctccgtctgggagggagaatccagagtggcggcctctgcagtccccacgtggctcagactgccacaaaggcaggtctgggagggttttagcaaggcatgagaatgaggggcctttgctaggaaggaaggggagatgtgggcacaggtgggcgctaggtggggcttgcccgagcgaggaggaccaggaaggaagcacgggaggggagcagctcaggcatggacacaggaggacggctccccagcaatgacctcagacacagagacctggtggcaggaattccagggcgcactttcagggccagcaccgtggggagagtgaggcactgcacagggatgcgacctcagcagagggctcggccagcgccacgtgcagctctggagcctttcagagttggcccaattgaagcaacgtttgaaccgcaaccctgaccagtcactggctatggctgtctgcaggaaaggggactgttcctgggggctgttcctggagaagaactcagctgtgagccatgagcagcccacatgctccacagcttgaggaataaacgacttggtcctgaagagggatctgggtggcacagcacagggtctgctgtgccaggcgtgtgttgaggagatggaggcgtgcacaggggcagggagggaagggagtgcggtctgttcagagccgccagcgctgcagtgctgctgtgctgggggaaggtgaccctgaggcgtaagtagaggccagtcgtaccgagtctttgatgccagccacagggcttgtcctgctgcgagtggggagccatggaggggctttgggagggaagcagaagtcgatttaccatgaagctcatgatgcttacgctttggggtcccttgctcacaggagccccttccgagaccctgggagaggccaagccatgtgtttacatggtcacatttttgtaaattttgcaaaaataagatattttaaccatacttgattaacagcacttctcttttcattcctgcttctcattgatacaattctcctcccgtgggtgccactgatacacttcccctcctgtgggtgccattagaatggccttgggcattttgctgctttggctacagagaaaatggattgagggcatttgttttggcttattgccatgattctgtctcttacaagtagagttaaatgattgtgtctgtccaggtgtaatagtagcttccagaaatactcgccacaccgctgtgccaactcatctagggtcattgcagaatacaggctgtgtgctggccatttccctcagatctttgcagaaaaaggtgcctcagcggtaccggaggttgtcactacttctatatgggcagtattttgtttgatttttaggtttgttttatagatggagtactttaaacacagatccaacatggatatttctttagaaaggccaagtgtaacaagatggtctgcttgttcaaaagctggcttaggccaggtgtgatggctcacacctgtaatcccgacactttgggaggccgaggtgggcggattacttgagatcaggagttcgagaccagcctggccaacatggtgaaaccccatctctactaaaaatacaaaaattagccaggcatggtggcgcatgcctatagtcctagctactggggaggctgaggcaggagaatcacttgaacccgggaggtggagcttgcagtgagtcaagatcatgccactgcactccagcctggacgacagagtgagactccatctcaaaacgataaataaataaaacataaataaataaaagttagcctagcctcacaacatatggatgacaataaatgaagggctctaaaaaatttcaaagacagaagagaaaccgcaatgaaagcgagatgcagaaatgttggttacgtctgaaggcgctgttttcacttccgttttgaaagtggcttgggaatgtttccataaaataaggaagaaatgacagactgtgatttggatatatgtatcaaatataccttttatcattttctaatttatttattagaaaggaaagaaaattcagataaaaattaatgggatatgaaactaaagtagtagaaaatgagcaaggaaataaaaaaaataataactctgacttcaaaaagctcattgtcaccaaaaaagaaaggttttatatcaaaccaaaagcagttgctcattaggaggaagagacacatatcaaagaagttaacaggccttggagcgtttgacagtctcattaacgaagaggagtgaatctgatgaacacataggaaaatggttcagacatctttctgatttgccatgaaatgttgacaacatcaaagacgccagggagctgcgaacgctgccactgcagtcagggcgtccacggcaactgctactgagcgttgctcatccaaagagtgtcttaaagtcaagctcccacagagaaaacttgaaatgccctgaaaaccacatcaaggacggaaaccagagagcacctcctccaaatgtcatcatcctaaatgttcagatggcgtcacccataacttctttaaagtactgatcattttttaaaaagaaagaatttccctcaatatgccagggccaagtgctggccaactccatctgctgcctgtttggttggtattggtttttttccctaacagctttaataaggtgagatctatatttaaattcactttttaaagtgtacaggccgggtgcagtggctcatgcctgtaatcccagcagtttgggaggctgaggcaggaggatcacctgaggtcaggagtttgagaccagcctggccaacatggtgaaaccctgtctctgctaaaaatacaaaaaaattagctgggccttgtggtgggcacctataatcccaactactcaggaggctgaagcaggagaatcacttgaacccgggaagcagaggttgcggtgagccgagatctcgccacttcgctccagccgggacaacaagagcgaaacttcgtctcaaaaataaataaataagtaaaagagagtgtacaattcagtgattttcagtgtattcatagagttttacagccatcacaacaaacaagcgctggaacatttttgtcactctgaaaagttccaaaccctttagtagtcacctcaatccatcctactctcgcccaactccagatagccactcgtagccactcatcctcttgctgtctttatcgattttccaattctggacatttcatatcaatggaatcatacaacatgggacattttgcgcctggcgtctttcacttggcataatgttcacagggctcatccctgttgtagtgtgcagcagccctgcattccttcctgttgctgaatactaatccactgtgtgggtattcatcatttattagttgatggacatttgggttgtttccacctttcggtaatgatgggaaataccgcacaaacattcgtgtacaaagtattgcgtgcatgggtcgtttttcttggatgtacacctagaaatggaatcattggattttatggtaactccatgtttgacattttgaggaactgccagtttcccaaagcagcctgttttacattccaactggcaatgatgcttcagatttctccatatcctccccaaaacttgttattttatttgttataccaatcctagtgcatgtgaagtgatatatctcattggggttttgatttgtatttccctagtgacctatgatgaccgtcttttcatgtgcttaatggcaatttgtatatattttttgtataaatgtctatttagatcctttgcttattttttcatggagttatttatatttttattattgaatcctaagagttttttatttattctggatacaagtctgttatcacactcaccagtgtaagtggtctgcaaatatttcctcccattctgtgggttgtcttttcactttcgtgatggcatcattgaggtgcaaaagtgtttaattttgatgaagtctaatttatctatttttacttttatcacctgtgcttttggtgttgtatttgagaaaccattacttaggtcaagaagatttactcctatgttttattctcagagtttcagctcttacattgacatctgtgatccatttttgagttaatttttgtgtaagtgtgaggaagatgtccaacgtcattcttttgcatgtgaatatccagttgtctcagaaccattcgttgaagagactattccttttccattgaattgtcaaagtttaacttatcaaatgtaaaggtttagttctaggcttttgttctattccgtcggtatatttgtctgtccttatgccagggatacactgtcttgattactgtagtttaatagtaagcttcgaaatggtgaagtgtcttcccactttgctcttttttcaatattattttggctattctacatcctgtgactttccatatgaattttaggagcagcttctcaactttgcaaaattctagtctgcattttgataggaattatgttgaacctgtagatcagtgtgaaagtatttccattttaacactgatcaatgaacattgagatgtctttccatttacttagaacttgaacttctttcaatgatgtattgtaatttttagtggacacgttttgcattccttttgttcaatttattactaaggttctttttttctttttggtgctattgtaaatggagttattttcttaatttcatttttaaatcatttattactagtttatagaaatgcagttgatttttttgtatattggtcttgtttcctgaaacctcagttaatttgtttgttagctttaagttttgtaggggattctttgggattttctatacagaagatcattttgtctgaaaataaagataatatactgttttaactgccattttgaaagtggttccagaatgttttgataaaataagggagaaatgacagactctgattggaatatatgtgtaaaaagtaccttcttttattattttcaaatatatttgttaaaggaaagaaaattcagataaaaattaatggaatatggaactaaagtaataaaaaatgggcgatgaaatcaagaaaaatgactgacttcaaaaagctccttgtcacacacacacacaaatctattccgttgcttttcgtgtgcttaatggctatttgtcctcacgtcagcagggacgaaagggcaaaaagggacctcgctagctccctctggcgcttttataaggcccccaatcccatccaggatgacctcatggcctaaggatctccttaaggccccacctcttaaaactgtctatgttcaagttcactgattgcatctgctgccagctcaaatctaccactgagccagctaattagtttatcttttaagtttttgtaccattcaactccagaatttctatttagttcttcttttttttttttttttttcgagacagagtctctgttacccagcctggagcgcagtggcgcgatctcagctcactgcaacctccacctcccgggttcaagagattctcctgtctcagcctccgagtagctgggaatcacaggttgtaccaccatgcctggctaatttttgtatttttaatagagacagggtttcaccatgttggccaggctggtccagaactcctgacctcaggtgatctgcccccctcggcctcccaaagtgctgggactacaggtgtgagccattgcactcagcctctattcagttctttttataatttctatctctttactgagattctccatttggtgacacgtcattcctgtactctcctttagttctttagacatgatttccttttgttctttaaacacattacttatagctgctttgaaatctttgtctgctgagtcagacatctgggcctcctcagtggtagtttctgtcacctgcttcatttcctgcgtatgggtcacactttcctgtttcttttcatggctcagaaagtttccttgaaaactggaaactttagataatacattgaagaaactggataatgatcccctgggccttgctgctactgtttgcttgttgattttagtgccctggtcctgctgtttcaatgaagcttatgtcccctgcagtgtgcagccactgatattgctccccagaggtcacagccttggtcatatgcagtcaccctgactgcacccctgcccctaatgccctggggtagtggcattagccaggctctttgactatctctttcccagatctttccattaagcttctggtcattctgcctgtattgctatcacacccaactgttagccttcactaactgctagctgctactaacagctagtgcgattgattgctgtattgtttttgacagtgtcctggggtatatagcttgctctacaatatgacctaattaaattctagacctttcacaggggcagggtgttgccagtatctgaggtgtattgagaccttcaggagggctcttagctgtctttgtccctggttctgtctgtttaacttctacaggttgagcatccttaatctgaaaatctgaaatccgaaacacttctggttccaaacgcttctggttccgagcatttcagataagggacactcaacctgtagctggtttaacattttgtttgttgctattaggaccattggcctcctcttaattgctcactgctaagacccttgttgtttttgacagtgcccttagacatgaacatcctccacgctctgtttcagatcaaagtcagtccccttagggagagctgtgaagccttctgttctgactctccctctgggcaggcccctgcaccactgagccagagctaaaggagcagggtcagtggcctgcttctcccagagtgacattcctggcctacagactgctcactagatgggaatggtagccactagtcttctgggcttgcccctttcaacatggaacctctaccctataagcaatctggggaggggctatcaggtccaccattcttggcctggtgtacctggagcagagcttgtgccctatgagtggggcctgggtgggggaagggggccccaggcctcttggccatcccaccagagagagactctgcaacagagttgagagggatgacaccagtggcctgggtttctcagtatgaaactgtagcctcagaccgggagcttggagtagaggcagccccgtcttcttggcagtaaagcttctgtcacactgagctagggcaggaatgggggagggctgtggctccaatgccatagacttttgcttttcttaccaagatttaatagattttcttgagaaaaaaaaaaagcttcttcatttgttgtttagaccttaggacaatttccagagactttaaatggctgctttttaaaaactaattttcgtcagttactggggagagggttcaccaacctccttacacttccattcaaagtttctgtttgctgcctgtttttgtaaataaagtttacaaaataaagttccaataaggaacacagccatgtccattcatttataggttgtctatagctgctttcaagctctgatggcagaattgattaattgcaacagagattatatagcctgcaaagtctacaatagttactctctggcccttttacagaaagaatttgctgaggaatggtttgctgagaagagtttgccaaggaatggctgcgttctctttctgttctctttgtggaaacagtgctacaaaattaggtcatacaaagaagggttaaagagtatgcagtcggccgggcgcggtggctcacgcctgtaatcctagcactttggaaggctgaggcaggtggatcacctgaggtcaggagttcgagaccagcctggccaacatggcaaaaccctgtgtctactaaaaataaaaaaaaaaaaaatgcaaaaattagctgggggtggtggtggacacctgtaatcccagctactcgggaggctgaggcaagagaatcgcttgaacccaggaggcggaggttgcagtgagccaagatcgtcactgcactccaacctggggggacagagtgagactctgtctcaaaaaaaaaaaaaaaaaaagagcatgcagtcggaactgaaggaaaagttctgtcagtcaatgtattagaagtccttgttctctgttttttggttgtttggtcattgtcagttttaaaacgtttttgtgtgatgtattttctcatttcaagtcaataacccattttgcacctaatttaattctttaattttgcaatcttcttcttaaagtgggtcccctaaactgtagacgcttcctccccctagaggaatgagagcactgtgatcagattaagatgtggaatcatttttcctacatgccagcattggactttattcctggtttttaccatgtcagcatattacttgtcccttttttccatagtatttcctctaaattgccttttttgcttaaataaaccttgtatgtcttgcagtcactggcctgataggccagtggtatctttataaatgggctgtgtgtgggcacccaggaggcatctatcctggcggcgtcatgtggtgcagcttccagctgaggggacacagagctgctagaaggcaggagggtgggtcagcaagcgggaggcagggcaggccagcccctcactgtgcctcttattgcctctggccaatgaggcctgtcttctgggggctctgagcatctaggggcgaggagggtgagctccccctgtgccccagagtggggccaggacgtgtcccagacactgcaggctgcagagcgcaggactgtccccacggcccggtgtgagggtgagtggagggactggcttcctgtctttcagcattgttttaaaggacactgcatctggctgacacctgacatcctcaaacgggacggcagctggggcgcttggagtccgtttggctcctgctcacgtacctgtggcacgggcgtgaagttcaggacccgccagtgtgacaacccacagtgagttggccccatgtccccctggccttgctgagtggcagctgagggtccaggagaccctctccagccagccctgtcctggagggccctgtggctgcacaccagttctggagaggtgcagggcaggctgccccgcctgcctcaccctacctgggagggggtgacggctcaggggacgcttagctctgcctcttaccccttcccctggccggggcccacagcccacctgcctgcagcccactctagacagatttactctgtctctcctggccacgggcatggaggagaggagggaggaccgagctggggaaatgggggtaagcgggggtggtctctcagcccccccgatgctagcacctgggcagctgtttgcagccaggtgagggcagggtcgggatttgtcatcagtgtctggctgcccaggggagggacaacctgtagagccggcccatgccagctgcatccccatgctcagctatacctcagccccacccgccacgcaggccccatgccctgtgctgtcctcctgccccttctcattcctcccacctcacccccacacaccccgtaaatatctcccgggcccgtgctccctcctcagcccgcagccactttctcatccacaccctcctctccctcctccactgcctgtctcctcctgcctgaacgctcaccctggcctcacccagggagtgtcccgggggggctggcatggagggagaaccctccacaaacatcagcgttacccccgtctcccacctgcgcagcgggctcttacgccgcaggccctgcagctgcttagacacacagagcttcggtctttcctttttggcctgtctggtattttaaagattttgatttgcctgaaaatattgacaatctgtaatttcacattagaaaaacaaacaaaacagatttccagcctccaaattgggcatcacagatgcacagccgggcccagttaccagctggcgggcagggctccgggtgcgtcccggctgctgcgctccggcctctgcggccgctcctgggtcctgttcactcgggctgctctccttgctctggccaggcccgagctggaccctgcggagccagagaggacccgcagtcacggctccgcggagggatcccgcagtgggacagcctccctcagcagcacgtgtgaacacgctcgtgcatggagccctctcctacccctgctgtcctcctgccccaggctccaggctgccctcccggccagaagcagacagggagccccgtggcccctcctcaagcacccctggggcttttacgccagactcggaaagagattgctgggcatttagaacctcaagaggcagtgtgtgggttggtgctgttcccagtgaagcgaagacgttgcagaaacgcagcccgccttctccacagggagaaaacccagcggccgtgatgcgtctgctttgtgccaagacacttgctgagaactgcagcaccgggactctggggcctcagcatgcctctttctgtgctaggctcggtgcccagggccagctgcagaggagactcactcagctcctgccgtgctggggttttcgccctgtggggaacacagaacctaaacacccaatcacagcttcctgttcatctccaagcccaggcatcagtgctggggaggaggtggcaccagggctgtgagcagatgctgcctccccacaggaaccccaggagggaggatgtggccatcctgtcctgtcctttcaagagcttcactctgaggcctgacaggctggacaactgcccaggtcttacagctaggacatggcagggcaaggtccctttgctcagcagagctgccccccggacacctgagacttagggatcccccctaaaaagatctcacaagggcacccgggtgctgcctctttccaatggcacggagcggcaaggcctttgctttctcctccagcccggccaacgggggccgcacctgctcgggccttgcctacgacttccagctctgcagccgccaggactgccccgactccctggctgacttccgcgaggagcagtgccgccagtgggacctgtacttcgagcacggcgacgcccagcaccactggctgccccacgagcaccgggatggtgagcccttctgggaggcatcagtgggggctcagcaggcaggccctagggtgggcagggtgggggcttgtgcctctgatcctgcatggggcaaggctgccgcgaccctgggctggcaggagagcccaccctggctggtgtggctgccctggcccactcctgggtggggcattaaagttcctagcagggctgcaatcccagagcaccagaacaccccagagtagctgaggacatggaagaggtggccgggctgcgggctcggcaggggccgggctcctgcagttcaccgtgggtggacgaggcttgagctgtgtggtcagctcagggctgaggccagggctgaccctgccaaggaatctggtgacctctgaccttctctattagtcgggactctcagttgcgagtgtcagaaagttgactccaaccggtttcagcactagaaggcatttattggctcagggacctgaggagtctggtggccttgggcatggcagtgcttgtgtggcagctggggaccctcctgggacggactgtaaacacagtccttgtttctcctccatggctgttgccctagcccagcagctgctgcctcatgtgggccagtgcagggttggaggtgacacagcagatggggtccccctctggcggaggccacagtctgggggcccagcgttttagttgcctcagataaaggctgagaagggaaggttccagggacctgagtctgaatcgaggcaggctggcctcattctggatttcagagattgactgaaaaggattatttactttttttttttttgagacggagtctcactctgttgcccaggctggagtgcagtggcgtgatctctgctcactgcaacctctgcctcccaggttcaagctattctcctgcctcagcctcctgagtagctgggacttcaggcgcacgccaccacacccggctaaatttttgcattttttgtagagacagggtttcaccatgttagccaggatggtctccatctcctgacgtcatgatccgcctgcctcggcctcccaaagtgctgggattacaggcatgagccactgctcctggcctttttttttttttttttgagatggagtcttgctccgtcacccaggctggagtgcagtgtgcagtggcgcagtcttggctcactgcaagctcggcctcctgggttcaagcgattctcctgcctcagcctcccaagtatctgggattacaggcgctcaccaccacacccagctaatttttgtatttttagtagagacgggtttcaccatgttggccaggctggtctggaactcctgacctcaagtgatccacctgcctctgcctcccaaagcgctgggattacaggtgtgagccatcttgcctggcctgaaaagggttctttagatagcaacccagcaaacagacatttgcagcctcggaggtctccaagcggggcctcggggatgtgagagccgggctgcaccaacagcctggctggcttggttgggaaaagctcttccaaagtccacaaccaccagggtcaaaggcttaggagacacagagacaggaagggggctgctgtcacccacccctttccctctctgtctgccctggagggtgggccacgtggggacccttgtggaaatttctcctgcttggtgcctcctttgcacacacatggggaagccatcagggctccttgcagacccccagctgcttcccttccagccaaggagagatgccacctgtactgcgagtccagggagaccggggaggtggtgtccatgaagcgcatggtgcatgacgggacgcgctgctcctacaaggacgccttcagcctctgtgtgcgcggggactgcagggtgagtacacagaggccggcacggggggctaccgtgtcaagtctcagcttcctgggtactgacctcccccttttcggggtattggcaagatgcatgaggtgaagcatacgaagtgtcagaaacaatgcccggaccagggcaggctcttggcaaatgtctgtttacccctcccctgtgctgggagcctgagacttgagtatgcctaggactcacctggagagtttggactccacctcagacgtcctgattccacaggtcacggtggtggcggcctgggagcatgaatttttaggagcatcccaggtgatttccaatgcacgtgacctacaggggacccttgtgaagcaggccccatccttgcaccctgcagggcactgggcagcttcttgctggatctgggtggccactgtgagggtcactggtttggtgctttgtagaaatgccctcctctgttttcttttattatgatgcctttggcttcaatctttggctgtcaggaaaaacaatctcgtgtcacctcgccatgtgacggtgacatgaacatagacttgtccctgccaggctcccccgaaaacaaccggaagtctctgcttagggcttgtgtagacaggactgatggcaggagtcgtggaggctgactctggcttgaccttcctgagaaacagccgcatcggcaggaaggcacctctaggggagtgggcgcagggacagcggctgggggctggagccgggagctggagctggagtcgggagctgggggctggagccgggagctgggagctggagccgggagctgggggctggagccgggagctgggggatggagccgggagctggagctggagccgggagctggagctggagctggagccgggagggtgctcgagggctgctctgcatttgctcctgtgacttcggcagggccgggaggctgggctatacagctggctcagagatggcgacaccaaatacgccaaaacaagaacaggtggtgtctgctctgtacccttgggattttaatttatggaggtgacccagtgaggacgtggggaggccaatgtcactgagagggctcctgaggaaggcagggcagtggaagggggacagctcaggaatggccagtttgaatcattccagtgggctctggagtttagggtggtccccagtagcctggtacccaaccctgggatgagttagggtgcaagaatcttggtttggtatgtgagtcctggataaaggaggtgcttggggtatagactgaagactggctggcttgcatgtgaaaggtgtgtccccaacccagtgctttgctgtcccttagaactggatacccctgggaggtgtagtctctccccagacaggaagatttttaagatgtcaaaatatcaagacataggacgttttgaaaaacaaaaacataattaatacaggcagcaagcatgggaaacagttgtagtacaagtagcttcagatggcagctgtgatcatggttgtaaacctaacggggagggaagatcactaatgcactgtctccgtgggtgtggctatcacgtcactcctgacatgggtattaaagaaggataggggctgggcgtggtggctcacgcctgtaatcccagcactttgggaggccgaggcgggcagattatttgaggtctggggttcaagactagcctgaccaacatggtgaaaccccgtctctactaaaaatacaaaaaaaaaaaaaattagctgggactacaggcagcgactcgggaggctgaggcaggagactcacttgaacctgggaggcggaggctgcagtgagccaagatcgcgccactgactccagcttaggcgacagagcgagactgtctcaaaaaaaaaaaaagaataggttaaatattttattaatgttgattttgacaggtaatagcaggttgctcaattttgcataattagaaaacataaatattcatgcagaacctaatactgggtcaaaaaataatatccaactggattctgtctgttaaagaatatcaaaacttggccgggcgcggtggctcaggactgtaatcccagcactttgggaggccaaggcaggtggatcacctgaggtcaggagttcaagaccagtctggccaacatggtgaaaccccgttgtactaaaaatacaaaaaaaattagccaggcatggtggtgggcacctgtaatcccagctactcgggaggctgaggcagaagaattgcttgaacccaggaggcagaggttgcagtgagctgagattgcaccattgtactccagcctgggcgacagagcaagattccgtctcaaaaaaaaatgtaaaaataaacagcatctcctgcttgccaaacataaatgttcatcaagccagggacggtgcctgcctgggcctcgatgagtcccctgcccaagaccagccgcgtgcacaggggcccagacggaaactgccaggtcgagacactgctgtaggtggcaggcaaggtccgtttaactgatgactagacgcactctgattttggagataataaaagatgaggccaggcaaggtggttcacgcctgtaatcccaatgctttgggaggccaaggcaggaggatcgcttgaggccaggtgttcgagactgggggcaacatagtatgaccctgactctactagcaggacgtctcaagtgctcactgcctcctcccccaacagaaggtgggctgtgacggtgtgatcggctccagcaagcaggaagacaagtgtggcgtgtgcggaggggacaacagccactgcaaagtggtcaagggcacgttcacacggtcacccaagaagcatggtgagtgggtccctgctctccaccctggagcctggatgcctgcagcaggctcatgcccggacagctgagggcctgactcatcctggggctgtccgggcttatgactgttctggggagggggagaggtctgtgacactgagggggagggagaatcctaagtcggggacagccccagctgggtgccagggtgggtggggaagaggagagtgggggccggggtcacaggggttagagtggagaatgccagtatatgaggatgcccgggttgggccttaaagactagcctggaggcagcagctttcctggtggcccctctcaggtgggtcctcaaagccagagaaataccagggtcctgggagagcctccggaggagctgccttcaagagcgaggcccctccttgcatggtgcgaatttgagcggcgccttcccttctcagttttctgtgtctttccacatcaaaaaaaggttacatcaagatgtttgagatccctgcaggagccagacacctgctcattcaggaggtagacgccaccagccaccatctgggtgagtctcagagccggacaacttgacgtcctcaggacctggctcctctgggatcaatgggcagagtgccaggggtcaggggtcaggggcccgggttgtgcagccatgacctgagccagggcagcccctccccaacctgtccctctgctcagcccacctgggccctttcccagggtcctccccttgtggagaggccagggtttgggatcagagggctccgcttggcagcagctatgaaaggacatatatgcaaaacatgtgtccctcagtctacaggatgactccctgtcccctgttctcacagtcggggcgggaaggccccctgccctcgggaaggcaggcagggtctgcaggcagcagggtcctgggcagccctcccatcccctcagcaaggccagctgtcaggtgggtgcacacagtgcacttacattttcaattcgtttaattttaaattcaagagattccagctaaaatagggatcctggtatctcctgaaaatatggatgttctcacacctctcggtgcccctttccacgaagcagcgctgcctgggagaccacgccctcccaggccacgcgggaggctctcaggacctgtccaccctccctctgaaggtgcctgggccctaccttctgggaattcatgggccaaggtcagaagtgataccagggactgctggggcccctggataagtcccttccccaatctgagccccacattcatccccatccccaggaggctggacaggattggggctcccacgctgccgtggaccagcacccacgctgcctgacaaacataccatgcccttttattttatctcccttttgttttattttattttgtttttatttagagacaggatctcactctcttgatactcatttttctttcttactttttttttttttttttttttttttgagtctcgctctgtcgcccaggctggagtgcagtggcctgatcttggctcactgcaacctccgccttctgggttcaagtgattctcctgcctcagcctcccaagtagctgggattacaggcgtgtgccaccatgcccagctaattttttgtattttttactagagacggggtttcaccgtgttagccaggatggtctccatttcctgacctcgtgatccgcctgcctcggcctcccaaaatgctgggattacagctgtgagccactgcacctcgcctcttaagaggaaactttcgactgctaccctaaatataaaaacctgtaccacttgcctgaagcaggtgaacagaaaagtcagtttctgaacaaaaagacatttctgtcccaacgctgcttcctgccaccgcctctggggctgaggtcgctctctgtggaaagggagcaagggccagagagaaggcagggacgtgtggcaccaagcagaggctttgtttgtgagtggacagaattacaggggacgtgacagggaatgattttctcactagtgccctgtctgcggccccactcacatcacccagctgccccgcagcagccaccccccacactgcagagagcatggggcttcctggctagccaggtcctctgctcctagatgacctgagtgtcacccaatcaggccaggcctcttctggggctgtggggagctgctggggcctcggctgggccatggtccctgatggggtgggggttctgctgtttcagccagacatatactcaccccatggcaggaagccctactccagcagggtcatgtgctcgcctgtccagcagatgccctgcaccgcgtacagacccctcccagccatcctgccccgggtggcctctaagcgcccactgagtgctcccaatagggtatgggtaggtggccttgacggctactgagtggcttccaaggggagccggcacctccagggctggtgggggcagaggatgcgagtggagggtaatctggtcccgagggagcagtgatgggcaagcagggctcccagagccatctgggctgtcgtggcacagaggaaactggccgggggcagccagagagacaaggggtccagctagctgcccccactccccgaccagcccaaaccagtgggcctgggtcctgctcttgggtgaccacaacgggggacttggtcttgccattctcagccgtcaagaacctggagacaggcaagttcatcttaaatgaagagaatgacgtggatgccagttccaaaaccttcattgccatgggcgtggagtgggagtacagagacgaggacggccgggagacgctgcagaccatgggccccctccacggcaccatcaccgttctggtgagtccaagcagggctgggcccagggaagggtgcgggtggccactgggggagggatgggggtgcctgggacgctgagcctcctgacccttcaggtgacactctgcgtggcccctttggcctgcctttggcaccaaggggctccgacttggtcagagccaggaagggacatgcatccacgagccggggctctggaccccacatgacccctaggtgaccttgggcacactctccctttgagggtttcggtttcaccatctgaatgacattcacagctgccatcagcatgctcgttcgagtgtgctgttacattggaatcggtgacactctgggaggtgacgctcagggtctgggaagctagatgcccagacccaggttgagctggactgtgtctctaagcaggatgggaccccagatctcctggttgtaggaaagtaccacgggggctggattttcaaatcactttctttttacctggttttgaggaggtcagatcactttttaaaatgtaatttaactgcatagggatatattttatttgtcaaaaaaggtacatatcacaaataaggctcccatgctctggagcccctccctaaggtgggcatgctggcattgggattaatccaccagcccccagcgctccacacgtgggtgcacctgtaagcaggtgcagcagtgagccaggtatgccccgtgtaccccctggcaccctgcctgcctcgcctgcagtgacttctggccccctggacgtgcctttggtgacctgcctgcatcagtgtgtgagcagctggtcctcggcactcacggtttctgtatttgcaaattcacctgctcactaaaattgattcgtgagccccaaacggacacgcacagagtggtgaagtgtgagtcgcctgccacacgtgttcccagcggaggtgggagcaactcagcacgctgtctgcttgtttctgctctcatcccacaaacaggggttctttctgcagtctgttgagtgtcacatacatcacattttgtgctattttgggggcgatttcgctgttgaaaatcaccctgagcctgttgctgaagtgctgtccagtgttcctaagcccaggaagcagtggtgtcttaagaagaaaatacatgtgttgaataagcttcgttcaggcatgggctgcagtgcgattgactgtgagttcagtgttaatgaatcacagtaaaaattaaataaagtgtctttaaacagactcacacataggccaggcgcagtggctcatgcctgtaatcccagtactttgggaggccgaggcgggtggatcacttgaggtcaggagttcaagaccagcctggccaacatggggaagccctgtctctactaaaaatacaaaaattagccaggcgtggtggcgggcgcctgtaatcccagctactcaggaggctgaggcaggagaatcgcttgaacctgggaggcggaggttgcagtgagccgagatcgtgccactacactccagcctgggctacaagagcgaaactccatctcaaaaacaaacaaaaacaaacaaaaaaataaacagactcacacataaaacaaggttatatattgatcgggtaacaaaaatgttgagacagaggctcacaggaacctcaccctgtgccccctggggtaatggctccctattcaagaatttggtgctcggggcgacttcatggaatgtaactgccatgaatgatgagactcctctggagtcggcctcggctgccgttcctaagctggctggggaggaagcatggagggcaggtcaggcacatcaaggctcttgggctggcacaggtcatcccggtgggagacacccgggtctcactgacgtacaaatacatgatccatgaggactcactgaatgtcgacgacaacaacgtcctggaagaggactctgtggtctacgagtgggccctgaagaagtggtctccgtgctccaagccctgtggcggaggtgagggggtctcgaagctggggacctgggtgacatgagggtgaccacgagaaggtagggagcatccctggggtggggccagcgtgagcaggggccgaggagccacagcagggacctttgcctgggtgggcaagggcttagcggcaatggaggggccggtgggtgggcaggaaggggggtgctggggcattgggtcaaatgtggccaaagggtgtgtggggcatggaccctgtatttgtgggcctgcttcagtgtgggggtgacaggctggcctagcaagaggttgatgtgtggacacctcagaaggatcatgccgtggcattggcaggatcgcataggcaagactctggcagtgcagatgacacctccagaggcttctctctccgttcactgggaaaagcctcccagatgtttctgggacagggctgagcacagaggggtcctacccactctggaccccagagagtctgcagttgatgggacataggacccagaggcagacaggaagcgctgatctgttctgcgtgctcctgggggctgggcgataccaggcaagtgaccaggacagtcctccctcgatgccatgctgggcccacacctggaggacaaggagctcaccaagaggtggggtcactccctggcccaggcagatggaagggtcctcttccagggcccctgggcacccccggccccacaccgggcctggatttcatcagcgcatccacccctggtgattcctgaaatctcctgggcctgtgtgctcttcccatcttcctggccattccccggtcctggcacccaccttcctctggactggcccttgtgtgtccactctcaccccaaagtaaccgtttgagggaacacatcagacaatgtctctctcttcctggtgtcatagtcttcaacagcttcctctgctcttaggataaaaaacaaaattctcctcatggcctccagggttggggcaacttgttggcctctcccagtatatctccaccctgtgcctcgcccccaggtcctggccacgccggccttaagggcttttcctggatacacaccatgtcccaccttggggcctctgcgcaggcttctcctcgcctgagcccctccaccgccctgccaccacgtcagcctccccagcctctgcttcctgggatgcctccaggcacccagaggaggtcaggctttatctccatgctttctttggtcttacccagcaggccagggtttcgaagcctgggcatcactgacattttgggctctgtcactcgccgccatgggggctgtcctgtgcacggtggggtgtcaagcagcatccttggcctttgctcaccagatgccagtagcaccccttcccccagttgtgacaaccaaacatgtcccagacgtggccaaatgtcccctgctggagaaaatcacccgggttgagcacggctgctctgggcctgtgggaggaagcatgcgggctgcgggcccagtgcttgcccggctcctggcttgcaccaggcctgctgggcatgtgaggtcaaggtagaagcggtgcctagcagtagcaaggaaatagggcctccactctgacccaggagcccagtgagggagaggcagcctaggggagaaaatggcctctcctgccctctcgcccctccacccgggacacaccaaggcctccccccagccagccgcaggctcggtgccctgcccacccttattgtcatcacaagggtgagcaggaaaacgaggccagcactgctggtgcagcccacccctccttgcaccctcgggcagggcatgctgccccaccgacccccgtcgagctctctgccttcagggtcccagttcaccaagtatggctgccgccggaggctggaccacaagatggtacaccgtggcttctgtgccgccctctcgaagcccaaagccatccgcagagcgtgcaacccacaggaatgctcccagccagtgtgagtgcccccagctcgggctcccactagaggagacaggccaggggccaccaggggctcccgtgcttggaggtgtggggcctgggcctggcatcatccgaggcatttgaccaagtctctctcaccacatttcatggaatctaagatgctgcagggcagaaggcgcaccccagcttcaaacccgccaaactgaacagcatcttagagatgacaagaaacagggatgcccagatggggaaatgggggttcagaggcgcagggctcgcctcctggccctgtaccatggggtagatgtttcttaagcagtggctttgacgttcaggccctggggctgggcccagctgcgtttctgggtccagggacctcagtggggaagacagttgggaaatgggcaggtgggggccacataggacagcgtgctgagggaatccacactgctcttgagctctgccgagaaggatttgtgacgtcagcagaaggtgaggccaggtagcagggcccagaccctaaggaggctgggaaacctcttcaggctagggacctccagagccaccagctccaccagggcctcccagtggtgacatgcatgggactcatggtcagtaggacctggggcagctgagcctcagtttcccctctgtgcaagcctggacagccagcatcttagtgagaataagagaaggtgcaccggggaggggtgcaggctgccctctgtgctcgctgtctacctgggctgcagggagcggcgctggagctcagccaggcaggttctccaggtgctgcggaagcctgactgtgccccgctctgccctggcaggtgggtcacaggcgaatgggagccatgtagccagacctgtgggcggacaggcatgcaggtgcgctccgtgcgctgcattcagccgctacacgacaacaccacccgctccgtgcacgccaagcactgcaatgacgcccggcccgagagccgccgggcctgcagccgcgagctctgccctggtcgttggcgagccgggccctggtcccaggtacgcaatcccccgatcccgtgtcctcagctccaaaactgagggtggacaggcatgcaggtgcgctccgtgcgctgcattcagccgctacacaacaccaccacccgctccgtgcatgccaagcactgcaatgacgcccggcctgagagccgccgggcctgcagcagcgagctctgccctgatcattggcgagccgggccctggtcccaggtaagcaatcccctgatcccgtgtcctcagctcccaaactgagcttgggtgggactgaggtgaccagagcattcccctttcggcccgtgggcctggatgtagctcctgtcctgagccacatcctgtgggtttcacggcgccagtggctgccacgtggtcagtgctgtactaagaaaccagtggaatgtgtgtcttcactgcacaggcagaggcttctgcatgatacggggtctggaatcccaggaaactgagggtagcccgggctccgaggcccagtaggatgttcggggctccaggatcctaggggacgcctgggtctcatgcagaggtgggaggggacaaactcgcaggaggggagaagagcagggcgtgcttaggcttgtgctgggaggaagaatgaggatggactgaagggcttcaggggtggtcctaggggcagggcctgagagccagctgaggccaggacagagctgacgtgagctctgacagcccggtcacatgcagggcccacgctggcagagctggaggagcgtgtgtcaggggctccccaagaccaccctcaggctcagtaatccactagaaggactcacagactcagaagcgggactcgcagttgcaggggcttacggtgaaaggatacagagtagaatcgggaaaaagaaaagtcacaggcaaggaggttgggaggaatccaggcgcaggctcccggtgtcccctcccagtggggtcacggaaatgccctgaattctccctgcacccatgtgtggcaatgcatgtgaaatgctgccaagcaggggagcccaccagagcctgggcgtccagggttttcaatggggtcagctacataggtgtgacctcagactgtagaggaaaagcaggtgttccccatccatcactgttggtatgaactacccagaccaactggtactggtgactcaaggcctcaggcaggcaaaaacactcttaataggtggagccttccatgagcttggttcccaggagctgcacaagggccagtcttgaaaacaggcgttggccgggcacagtggcttacgccagtgatcccagcactttgggaggcccaggcgggtggatcgcctgaactcaggtgttagagaccagcctgggcggcatggcaaaacaccgtctttacaaaaaaattaaaaaaaattagccagatgtggtggcgtgtgcctgtactccctgctcctcgggaggctaaggtgggaggattgcttgagcctgggaggtggaggttgcagtgtgctgatatcgtgccactgtactccagcctgggccacacagcgagatcctgtctcgaaaccaacaacaaaagaaacaaaacaaaacaaaacaaaaacacagacctttgttgggaatgtgcaggctttgagcaatccaggtctgctgagtcagccttttcctgtgcacctggtgaggcctggagaattttccttgggcaaggctgggcgtgactgctccttctggcacctccctggtcagtgtggtggagcagtggtggtgctgggggctggaggagccagtgagggcactagtggtggaccctcatgcccaggattgtggggagcctactggcgcctcctaggctgggtcagagctttcccagtgccccacctcaacccctgcccagggcacagcaggttctcctgggccttggacctcctccagccagagaagtgaggctgtcactgagagtccagcagcgccaggcctatgccagtctgtatatgggcactgtctcacagcagctcagagagacaggcatgtgggtcccttctttagagccccaggagattggggctgcccccgagggtggggcaaggcaacctgaaaccccactctccccactgtcccacacctcctcctgagcgcatgggtcatgtgcctggggactgtgggctcctccagctctgccagtgcgggccctgtgtgggaggtgaaccctgcctggcgactctccccctgcagtgctcagtaacctgtggcaacggcacccaggagcggccagtgctctgccgcaccgcggacgacagcttcggcatctgccaggaggagcgtcctgagacagcgaggacctgcaggcttggcccctgtccccgtaagccacctgcagcccctgcccctgctcccagcatgcagcagcccagggcgggggtgtcagaggcttggttcaggcaaatctggctcttcccggagagtagctggactcaacatctgtgagcatggagaagcggggcactgcaggccaggtctgggacctttgcctggcaggaaatggagggagctgtgtggagctgactcgcccctccctgctttcagggcactgcagactcacggtgacagcaggactcggccagctagggaatgctggtggctatggtgtagggggtgcctgtgtgaatagggggacgcctgtgcgagtagagagtgtgctctgtgacctttgaggagaaccagaatacctaccacgcacagatgcctgtccaaacgctatacatgtgtcacctctaaggtctccacacagttcaagactggaccgtgcctgccacagttcccttctatagaggagggagctctggggggtctaggcacctgcccccagctggggagggtgtatccaggatctctcattcccctggcactctctgtccaagctttctgggagctcagagctcgagtcagcaggtggaacccggggcgcgggcagggtgcaggggcagaggagccggcccagaaaaggaggcggcagggcctgcatgccagggcagcgagagggacgggatagctgagacccagctgagaccccggctgctgtcaggaggggcaggaggtgggcgtggacttggcagcggaggaccctttgtccgcccggggaggcgagggccttgaatgacgcttccccaggaccccgggagacccggagcctctctgcctggggtgggggccccagcctggtgccctgcggccgcagcccctctctcctccctctaggaaacatctcagatccctccaagaagagctacgtagttcagtggctgtcccgcccggaccccgactcgcccatccggaagatctcgtcaagtaaccgacccgtttataactctgcctctgccctccagtgcatgccctgcgccctgtggagcttgccttgggcccccctcctctctgtctatggaaagctcccctgactctgcgggcgcgctctggggtgaccgttttctcccgggcctctgagctcggcgtccgctccgggccgcgctgcctgctggcgggggctcgggcctctgctggggccgaacctggttggtgatggcttgtaaaggggcaaagatctgtcgtggttgcaggaggggccggtggccaaagggcgaccctccgggccgagcccgtcccggcccgggggggttcgcggtctcgcggcgtcgtgcggggaccccaccccgagtttccggcactgccaggtgcttcccggctgccaccgccgtcgctgctgccgccgaccctttgctgagcgtgtccttctgactcgtggaactatggcccgcttccgcccggccttcgcgcagctcacagccccgcgcggccctgtcctgcgggggtccggtcgcggaggcggcggaggggcgcggggacactccccacctccactgtccgcccgtcggccccggtggccttttctcgcctcgcgcacagctcccccgccgcagggctgagagagagagtggccgtctggtgcgcgcgtgcctcgcccacgcgtgtgaaccactacagaattacctcaatttttattgcttttttgcttagaaaaactatgtagaagatgccttaaagttgaaaggtaacgggattggctgccaactccagcttcagagggggaacgtgggccagtagaaggcagggaaggtgtaggggagccggtgcgttcatccaccttttgccaaggttgaggtttccaagtgcagacggcttctctccttgggctgagcggtgcgcaccgtccgtctccgcggactggagtctgccctgatgccccactggccagtcggcgctgactgttgcatggagcccccgagggtgctccacagcgcggccttacacccagggggcgaccccctgggccctgagccgcgatccatgtagcactcctccccgcccctccaccccagccaccgcctctgttcacaccgcacccctgccgggcggccggcccctactcccgcggctctgaccgccgttctgtaaataactggtgtgcacctgcgtactaatctcacgactgttaacttccaactttgacgaggccatgcgagcgacacgcgcgactggggaaggtgcaatactgtcctgggcatatgcactttggtttatcagggatattttattagtgttttgtatgtatttaatgacgtattctataggttccattgtcgttgcttttctggttttttttatgagacgttagcgtgtgccaaagtgactgtgaaaatgacctttcattcttactaatgatggaaagacctcctgtcatgcatcccacaaataaactcaataaaagttccatgaaactgggtgcgtgggtttggcaagctgatggctccttctctttttgggggcccagacactgaggagttgcggggcctcactcagtagcattaactaccccggtttctaatttgaatgactttactgccccactccccactgcccaacatagatatttagggcccctccccctgaaaggtgtatctcccctccccaggtattttccaaaatctgatagcaaaccgtgcagacaccccaccgtgactccgggttttgaatcatgtcatatgagcacctcgcaagaatatctaggttctatatggaggtctcctcgtcaggaaaagggcccgagatgggtttctcctcatctttggagcagagcctgtggagtgggaatgtggggtcagtagcccagacattgctagtccaggtcacctgccgtgagccaccagcaggtcactaccctggctccaggcacagttctcggccttgggctactcgtccaggaagggagaggtgcccatccggctcaggtggggggctgggccagccccgggaaagcctgggtcgggagaggggcagggcagtggtggctctctgggcaactggcctgcccatgtcttccaaggtcttcccaggcagccacagggcctgtgttctctcacattgctgaaaatggccagaaagagggtctgggttcaagagggacctcctgacctggggcctgggctgtgtcctgcccatggaagtctcactcctcccttttctgtaccactgaggagtcccaccagggagagggaagaaagcgtggaaggccatgagaaagaacagtggggagcagcccagtgtcatggggacaggccttgggcatagggccgggcccgggggctagcctggggagggagcaaccatggtagcgatggctgagttcagcctgcccagagctcagatcattgatcatcaaaagcaatcgcagcttaaaggagacaagaagcatcagggaaaattgggtcagacagtgcttccctccactcagtctctcttcccagagatgggtcaggagcaattcccgctaagaggctcctaggccagagctagagacgccgcctacagcccaggtgccaaggagggcacatctggaggggggtgcctcttgcttttttaaccagctgcatgaccttttgaatgttggcatgggtgtctgagcctaccactcctttactgagaaatgagaatgaggtattctccatccagcattttccaaagcatgggaaatggaaggtgattcggtggtgcataaacatagctggggctgcactgcactgagcggtcccttcctagttccctttatgctttatggtgacctcaggaagaaagcctcacttgctaccagctttagcctgtctcacatttgctcatttcccttcagctcagagcttggcaggcaggagtctctctctagaatttgatgagttaaagtgtgactttgaaattgactttaaaaggactttaaactttttttttgtattcctattttagggttacctttgttcactgcagtagctttccatgagtggtaatagtataaggtcttctaaaacaaattttaagtgtaaaaaggagttaatttaaaggatatgactaagcaaataataatgcaggtgctgttcaggtgtagccaagatcgtgggagtagcctacagtgacttaagtttatgaaaactgtgtttactctcaatggttgattgtcattcactggaagacaataggtctcactacttgattgctactggaaatggccgaagaccaaatattgtaaaaccacagtgttcatcttggcggagaggcatcgccagtcattacctcaggtgcatcactcttctctgtggtccgtgatgatacttaaaaatgtacaaacctggggcatctttaagatcagttggtcatgatgactttgaaatttttctaggctattttgaaattttcctaggctatttgcatagtcaatctcttggccaggattttatttcaattttgtatttactcattgacgtatttttatttttttaaactaagagcaatgccgcccactgtggggagaaaatcagacatagaagtccagtatgtagaccaggtggaagggggaccccacctggggctgccacccctcactcaatgggcatttatggagcactttctcgtgcatggctctgacctaggcgtgcacttgacccacgatcagtcaaccttttctgtaaagggccaggtagtcaatattttgggcattggagcccacatggtctctgtcacaggactcagctctgcctttatagtgggaaagcagccacagataagaaatgcatgggccgggcacagtggcttacacctgtaatcccagcactttgggaggctgaggtggatggatcacaaggtcaggagttcaagaccagcctgaccaacatagcgaaaccccgtctctactaaaaatacaaaaattagccgggcatggtggcacgcacctgtagtcccagctactcgggaggctcttgaacccaggaggcggaggttgcagtgagccaagatcacgccactgcactccagcctgggcgacagagcaagacttcatctcaaaaaaaaaaaaaaaaatgcatgggcatgggcctgatccaataaaactttatttacaaaaccaggtggagggagggacttggcacactagccgtagatggcccaccactgtaccaggctgatgtgattcctgcttttcagggatcccagcctggtgggggagacagtgagggagtggagatgtggataaatgtgtaacaccagccttatctgtgtgaaggaaaaactatgggcaacaggagagggggcagtgtgcagccagggtgtccctcccagcaccatcaggcccaggctccctcctttgtcaaagcctatggggtagggagaagggaggccaccatcagctcttatccagaaccccctgtgtttccctgagggtagggctcagtggtttcacaaaccaggctgctggagaggatggggtggggcagggatgggagctctgtgtctcctccacccaccttcaaacagtactatcatcagcagtccgagtctatctgtttcatatattgggcacctgtgtaagatttttatctgagaaaagccttctgccagtttcaaaatcctgacagccacatctcaggatcttccgatttgatttctggcatctcccctgggtaccaggccctcccccttcctccttggcactgtgagcatggttcttgggctcagtgtcagggagatccccacttctcctgatggccgatgggttttaactcccttttcatggtggaccctgcagccagtcatgtgttctccttattttggccacgtagaagctcagggccgaagtcgggcaccctctgatgcatgggcctccctgcattcttcttgcctggaaattgccattttcagattcaaaatttccctgttttgaacttcctcagttattcacattgatctttttcataccttatcttttttatgcctttatgcattatttggttcactgttctaggctctggggctctgccctgtggagctttcaggataatgaaaaagtctggcactagtcattcatctgacaattagatgcgagcttggctgggaaggcacagctgctgagaccgtgtgctgcagagaccttacctgctcaaggaggtcaggcgatgcctgcctgaggaagatgtgctccaactgcccctgaaggaggaagggtggtagctggaggcaggagagaggcattgcatgtgcaaaggccctgtggccaaaaggagttccatgcagagcaaggagtctaaggccagagggaggttggaaaggggaaagggacaggtcagggacttcaagtggcggggggtggggggggggtgccgtggtcacatcttcagtgagaaaacagcattctgactgaagcaggatagctggatgacatgggtgaagaatggacacagacccctcccatagtgcagccaagaggcagctcagccagggtggaggtgggagacggggaggaacaagggcatatctgagagtgtctaggacggggcacccaggtgtttggcttgtgtgcctgaaacaccatgcaccgagacagggtgggcagcagaggccctaagctcacgctgcaggggttgggtctcgggcttttgggacccacaggcccttggtggatttggcttgtagcaagtctgaagcttcaggggtttggagctggtggtctgtcaccagcttctaagggaaaattacaggctggagcagtggccattaagaagcaggacatcagaaccactggccctcgatggaaggaagggggtcttgtctgttttggacagcttcaggtgtagattgtgtcatatgttggtgtatgggataactgtcagatgtggctcccatccaatgcctgagcctttctccctccctttctccctccctttcctcctccctttcttccttttgtccctccctccctttccttttttcctttctttccttccttcagttcctccttcctttcaccctctccctccttccttcctttcaatagtagatgagttcaactaaggagagtgagggaaaaggagggcacgtcgggggtttgtgtgggaaaggtctgaagtcatcactgtggagagtagagagcagctgagcagagaccacaacaggcggtgttgggctcacggaggtcagtgattcggaatttatactggatcaagtatctcctgtaacatgacttattctttcttcttgagtgaattttttaaaatcatcttaatttttgtgttgtggaatgaggggatggggagagggaaggggtgaaaacttgggaaggagacagagagtaaagagagtgtgagcgcaagaagagttgatgggttgaatgaacatagccgcagacagaggtcgagatgggccagggagaagatggctgggtggaaagtgagagataatggtggcttctgtggagagtcggggctctccatgtaagctggaccacagatgaccagtttcttgggtggaaaggaaagagaaagatgtgcagggtggaacgattaatctatgtgagggcagcacgtttctttgggaaatggctggatgcgcaaggtggcggtgctatagggggatggagcagaggctggaaatgaggttgttgggtaagttgaggcaagtataagaaagcccatgcaggtttgggtgatgtttaactttcctttaggtgctgttcagttaaaagatcgtccggggcatctgggtcagaatgggagcaacatcagggagttgtggagcatggtggggccacagcggccctgggatttgctatattgggtcttaggaattggctcttttaggtttaattttgttatagttactacttagagattattgtagagtcaagccttgccacagaatttcactggggttaccactgggatgtcaaatgtgaagatgtgataaagtcctattctttaagatgagtttggaatcactctgtaagaacaaacgggcctcatttctttctcaaactttaagagatactgaaacatccaggttcaactggggcctgcttggaagagggaagccttgctcacagcttgtgtgtcagcacttccaggcaggggtccctggacactgcctgcactggggatgctttgacactgaacccacacagactttctgcctgggctcacttgcctctgtgctgtctctgggctcttccatatgcctcctccagcaagctgcaccctgtgggggaacaaagtcccccttatcttgtcctttggttatttgtcccacttttctttttcagagggccactgccaaggcgacaagtcaatattctgtaggatggaagtcttgtcccgctattgctccatcccaggctacaacaagctgtgctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcctccagcaccaatgccacagaggatcacccagaaaccaatgccgtagatgaaccctacaaaatccatggcctggaagatgaagtccagccacccaacctaatccctcgacgaccgagcccctatgaaaagaccagaaaccaaagaatccaagagctcattgatgagatgcggaagaaagagatgctcggaaagttctaataaaatggaaagatagcatccctagcatttttttcttgcttatagagatattccatgggatagcaaatcctgtgtcatggagatgaagtcaaaattcctgattccaaaaggttttgagaaaacaaagagggggaatgacgtaagaaagataggcatgagcatgtggtaactaggttagcacgtgtgcttcccagcccaggagcgaccaaatactgtggtggcgtcaggtgtgcagtggagaggaatatagaggctgtatggcctccctcagtgagggcagggcaagagggatcactctgagagaacaaaaataggccccaagttgctaagcagtgattgggaaccttcctttccttggcggagatgcatgacattccctaccgatccccagacacagcctgtgggactcttaggagaaatggtgatttactgaataactgacccgttgccgagatgagtacaatgaagtggaggtgatgaactcaaatcgtcttccagggccaggcggctgaccggggtgagcgtagtggcccgctggggaccatggccgccctgacagccacacccacctggagctgacttggttctggctgttgctgccactgtgaaatctgtatctctctccatctctgctctactatccccggccttgccagacagtgttctttttcggaagaagtctagatttttgcatgaaaaaaactcaatctttaaaggtcgactcagaacattttaaggaggcctccacttggtctgatgcagtcttgctaattaagaactaaaggccttctgaccttcttggtgctcatgctgtacggcatctgaatgtctcgaccgagtctgagccgtgcagctgtcctccacctgcgaaagtaatgagaatcctatcacgggacataaggataggtctaaacagggtccatgccaagaaaacagtggggtgctctcccaggcctctcccctgtccactaaccctggccttgccggctgccttccaggctctgggggaagagctcctgcattcttccctggccaccttggctccagggctccccagagagcctcttccctccccaagtacctgagaaagatgagagaggcacgtgctctgctgggaaggtccagtgagcggttcaagggcctggaatctccctacggccaagtctaagggttctgggattctgggctttgtgggctttgcttgcttgctgggaatgggctttccctgtcccgccctgccccacctcgcctctgtctctcagaagctccagaacccagcagtgacctgcaaaatgtggcctctgatgggggcttagggtgggagatggggagagcctacattgtcttttgctccttgaaaactttaatagctcctattttccagagaatggtgctttgtgagcaacatgcgagtaagagagaaataggaggaagggggagtaggggcggatgggagaagagtggctcatttttacctctcactgccttgacattttgtgaacgtgaagcttaaactttctgggcttacaagacccaggggcacgtcagctccttagatgggctcagcctgacacataattcttaaacctttcctgtttaagaaacttctagaggctgtgtactctcaccaatcctcttcgagaatttgttcatgtgtatttccccattatatggatgaggctcaggataacagcatagtggctaccttctactgagttttgaggtgctaataagtatgtttgtctgaggctgcacatgtgggtggctctgtgtgtatgatccaagggacaaaatgacgatgtaggaaccagcaagaacggaatctgggctgatgcttcagtctccacctgggtgatggctagcctcccgccctccaccaccgcatcccacacgtgctgcgcactgtccccgtgtctcctggagaaccaaactggagaaaacctttctgagtatctctcatagtaccccttccttaagaagatgtggtttagagcatgtgtg

SEQ ID NO: 842 - DNA, 46806 bp, Human
cactctgccaaactgatttacttgaacaataataagaaagggacaaatatgttcctcctctgacacatctaccgttataaaacatttgccctgggcttctcttgccttgctagtgcacagttagtgtctgtctgctgtgagaatgaaacacccttgagagcttgaggccacaactcaggccgaggtgtgaagggaaaagaagacagcttacccagccatcaacattcacacatgtggatttacagaacagacaacaaagctatcaatcggagcccattccatttcatctcatgtgagttacattattgtaaaacacttaaccatgtcacatggcttattaacattggcatttgattttgtaaagatgctttatgtttaaagaaattatgtagtgcacatttctgcaaacgtggaggcaaatgaaaaattagcactacagagcctgatcctccaccaagtcttgtctcatttgcttcttgtaaggaacatctcttgcttcctttctccacttgttcatatgctttctttccaaccttctcccctttcttctatttctacagcatagatcgcgccctcgggcggttgagctttaaaaaaaaacaacaacaacaacaaaaaaaaaaacaaacttcccaggtgcagcatactctctcaattccacctcccggcgattttacttttggcctgagtccaacacgttcccaagagctggacacaagttgtcacgatcatgaacctaaccacactcccccctgcggccaatttcctattttgctgttcaaaagagggaaatgcacatatcaaaaggaaaacagcttggtgctggccagctgcagaagggtggaggtctttggtgctcagaagagagagcagctcctgcggcagtcctgcgtgtgtcgctgtccagacctcggtgctgaatactaggcactggtatctcccgccaggttcaatccctcagggttcgaataggctccaccatgggagactgaactcacttccctagggtgaggggtggagaattcatttagatgtttgcttgctctcctcccacaggaaaccatttttccacaaagaggcattgtgcattttatgggaaagtaatggcacagctccagctcagcaccaaagtgaagagctctactgaggcacaatggaaagtcgaggtaaataaaaactgctctttccctccctgaatcaacacaacagcttttgggatcctagatccccttgttgacgaattcttaaaaatatgtttttttaaaatcacatgattaatcattttactgataaacaccctaaaaggtggtggtggcgctggctttgcaatatcggagtataactactgatattgttttactgaggttgagaaacaaaggggaggagggaagtaaacttgtaaactaaggtggcttgaatggttaaaaattcatttttaatagtattgctttaacatagacatgctaattttctcagacaatttagaacagaattgggacagtagtagcttcccttcttctccttactctcctagcctctctctttgaaagacctaagagccttgttcttcatagcaggtgctgatgcccaaagggccattataagaatcctatagcctccccccctccccgccacacacatgagataataaagtaaatacagagaaaatggatggaagggagggaaagcactcccagcctttgattcttggtagttatgttcaagtggggcacttctctttgaaaagtgaaaatgtttctcacggtacagaatttatgggcagacaaggagcagacttaactgatcccagcaaacagttccttccttttcctaatccctggctgcttattttagccgcttctccgccccgccgggaataccattcggatcttagtccaggtagatctgacgtcaagagatggctttcgtcgatttgacgtgtaaacactcatttccattctggctgggaagggctggggctccactcagcctggagaccgaagcgcttcactgagcgctcgccgccgcccagcctctcctctcgcgcctcctagctcttcgcagagcaaccaggagccaggagtggtctagagcccgagggtgggaagggggagtctgtctggcttttctcctatcttgcttctttttcctcttcccttcccactcttgttcaagcgagtgtgtgagctatggagcgaagagcctggagtctgcagtgcactgctttcgtcctcttttgcgcttggtgtgcactgaacagtgcaaaagcgaaaaggcaatttgtcaatgaatgggcagcggagatccccgggggcccggaagcagcctcggccatcgccgaggagctgggctatgaccttttgggtcaggtaagagtttccactttcaagaaactttctggggccccaggggactggcgggactggagcgcggtcttccaagtgggagccccaggttgcactctccagagcccagagtagcaaagagcaaggagctgctccagccctcgcccctgtcgcgcttggagagagagaaagcttgcattatttactgtttaggctgggcgcagccaagcagaaggaagccgctgcagctgggtagggcttatgcttactgttggccgctctagaattgaaatccgttcccgcgcggtttggaagaaaaatccctccacgcttgttcagggaacttgagatacactcaagctcttaccaaccaagcgcccccgggagaagcagtgcgctccatcccccgggactgaggcggtctgcgtcaggagccggctgttgccttcttttcaatatggcagcatcagatccaagtcctgatgcaaggggctaagcaggcttggggctgtccgccctggcagcctgtaagggcacgcccagggcattggaagagtgccagctgctgggactcgcgaccaggaggttgggaggccgcggagtagcctgggaagctggggggagaaatggtgggtgaaagacacgggaccatctatccccgcgactctctagggagctccggcttttcactgggaacttataaagtccaagcttcataactttgcccggccagtcccactgcagggtcgagatgccgaactgactatggggaagggatctatttctttcttgttcttcagccaagtacgtaatcgttttcccgggaatttcagcttattgttgcctgtccaagtgaaggcttggtcgataggtagctggttggaggtgggtgggcgtcaagacattaagtgggagactgcttatagctgagcgattccgaggggaccctagggagtgtgacttctagtctagagctttcctttccttggctcggaatcaagccctcgccccctgcttgggaagttggtctgcattgaagcgtgggaggaggcagttgtaaaacattttggcgcgttttttctggaggtggtggttgagacgccgctggagtcacggatgagtaatcggcgggggcgttggcgattctgtagaccgaaccctctggggaattcgcctgctcttgctagaggcttcattctcaactttataaaccaaattgtctttgaaatgcccgaaaggaaaatcaatgcagattggcttcctggtgtcccagcagcagatgagtcttttgcttttggccagcccttgccctcgtgccaggctccgtgttaggggctgaggaataagaggagggaaagaaacgctctcaagtaatcaagaatctagaggagactagcttagagataaatgattgcaactgattgtaatttgtgtaatcatagaagttgtacttgaagtctcaatattcattggttgaaggaatgaaagtagtagggaattcgggaggggtgaatgaaaactgcccaaaggagaaaacatttgctccgggaacagaagtcaaaggttgccaggagcacataatgagatcggagaagacagtctaggcatagaaaacagcttgtgggaaaacagtgagacataatacagtttagtagtaagtctgggaattgcacgcaattattaggaatttttgagacccaaagagggtatgagtagcagaggaaattgtgctggtgggtactgtggacatcatacaaatcatgtatgacctatgggggtggacactggggatttaattgtgtattccttgagcagctactgaaaggctaaatagcactggtaaccgtgtaggaggagactggggaagacagcaaaaactaaatctctcttctttttcccacctgttagctctaggcatgcatctaaacctagaccattcaatgtgaaaactgcttttcaaaataaataaacataaatcttaatagtaaaaaacaatacatcatcattcttgggaggatctttgagtaagggatagcatagtcacaaaagcattaacaaatagtgggggaaaaccatctatatttatatatgatttacaatactatctttcctctaaccatttttagttaagatggcattactaacaaaagttttaaaacaaacttaacaaaattattttattagaataataattctttgtagaaggctgatagcacgttcctggttctgcttatttctctttttgtttaatattactaaaattacactaatttagcattactatattgggtaccttattgcctcaggataaagcttggattaaggtagtgacaagaagaaaaaccagttgacagcagagaaaacagagctaagcactggtgatctttttctgcggctgctgatttctctccccagttccatccacagcttataggaagattcactgagattcaggcttggagcagggcctaagcttctctattttaaaattctctgggcgatgagaatcaccaatttaaagaacacgtttcttctgtaatatactgttgtcaactgtttgtttcttaattttaaaaatgcagggttacctagaggatttggtagcctcaaatttagtactgagtaaagggagactagctcaaaagaataatgaatatagtcctaaatgaaccaaagatgtcaatagatacccggagaagtacaaaccctctaaagtgggacaactgccctaaatgtagcatgttcttttctgaaagccttgaattagtggaaaatcaaacgatcactaatagtggctaatagcaatttatcactatgaattcaatggctacattttataacaacgataatttattttagtggaaagtggcactgaccatagatagtatcccaggtgtttgcctgcttaccacaaataattgttctttgaacagatatatttgattaaatgagcattttaatatgatattgtcacacatgaaaaacatgtatttcctccaatgtgtgtaaaatagaagcatcactagcctcctactgtgagctaatgaatatactgtgaactcaagcaataatattctgagggtcatcttaagacctctatcagtgccttcttcatgaagaatgtggatggagctggaggccattattgttggcaaactaacacaggaacagaaaaccgaataccgcatgttctcactcacaagtgagagctaaatgatgagaacacgtaaatacatagaggggaacaacatatactggggccttttggagggtggagggtgggagaagagaagggatcagaaaaaaataactaatgggtattgggcttaatacctgggtgatgaaataatctgtacaaaaataccccgtgacacaagtttacctatgtaacaaacctgtacttgtactgctgaacttaaaagtttaaaaaaagaaaaaaaatattaatttcagataccaggaatgggcttaataaaagttgcctatctctaagttagctgagttttaaactagtccatatatacttgtttgggaacgtggatatttattttatttctttccttttatagattggttcacttgaaaatcactacttattcaaacataaaaaccaccccagaaggtctcgaaggagtgcctttcatatcactaagagattatctgatgatgatcgtgtaagtgttgtacatttgtcttcaaaccaatactctagcttatctgctttctttatgatttctaataaaaacagaagcattttgcaaatgtggttttttttttattgtgaccaagattgtttatctgtattatttctaatttctttccataaaattataatggcacataataataacaagattgggttgaattggttgagccaaagttaattttacacatatatacgcagtttaattatataattacatatatatctaaagttaattttatatgtacactcacaaattcagtctaagagcatgaaagtgaatatttaaaatgagagggcagcactaataaaaatgtttgacaatacagtcaatcaacaaccttttattaggtacctattatgtaccaaacactttaataccaatgtgggctcaaagaaatacatgggccttactttcaataacatttcagtataactgaaaaaaaagtctattatttctatttggttttgctgtataaggagctagtgtttatgagagaactgtaaatccatgtcttcatgaggcaaatgtttccataagtaatctattgttggatccaaaccatctgatctcttttcatcctagtttgtatcttggttcaatgattaggttacagcagaaataaatataggtaaataaggtagaggcagtttgaatagatagctaatgtacctattgattttgaagtctattttcaaggtcaacaaacatattagaaaatgtttactatgttgggagtattgtaattttcatacagtgttgccttttctcaaagaaatgccatactggaagaaatttatcctgattcgcctgatatctgtgtacataatttttgttacctaggacaacctggagaattagaatgagagatcctcttggtgagaggattaaaaacatcctttcaacttcccagggggaaaatatatatatatgtatgtgacagaaaggtgatagaactgttgaaagtagacgaaattcatgaggactgtaagataatttgcccttttattcattctgaaactgatagaatttttaaaagaagaagaaaaagacaaattatgagggtagggaatgggaatggcctgggtcaccagtgttcgaatgtaaaagaaacaacaacatcctgacaatgctgtattaggaccacggacagtgaccgtatagctcatctacacccactgctagctcttttttgtcaagttattgcttgatgtgggagaccaaatcagaggccctggaccttattacagaagtttcttgtccactgaggtcttcccttactcacttcaagggagagggctcatcgtgtgtgggctctgaaaagcagaataacttctagcactctggctaggcttagtccccgggctaagcagaagagagatttccttctttgcctaaatgcatgcccaaactgcatgcccattaatgcacatagaactcaaactgacctgccttctcactttcataggagaaaattggacagaatagagcatacctaactgttattcttactcaaagtatctcatgacaatgaagatggcccattctactctttatacatccccttgatagctgatttggtgggggaggggtggaatctcaagacattatgaaaaaatgctaagaattcattctccagcacaggtataactttgtaaaaaattagcccaagaataattttattttaggaaacattctggaaccatagaaacttgcattggaaggttgaattagatgatcttcaatgctctttccagatcaaaagtattatttataattaagtacatgatacctataatgcataatagaaagacactaccaattttcctctataccattcagcctgctcttctagagattaatacatgattctgagttaatgacattaatcataacactgttttctacaattggatgtttatctgatcagacggcagagtgcctcctcttatatcccatttccaaaaaattgctcttggttttcattttattgctcttttttgatggaggataatattctttcaaatcagccctgtgaaatgcagcaacagtctatctttacaagtctgttaataaaatctccaagtgtaagtgaccctctacctcaaagattagtacttattccctagcagtcagcttccagagatcaactcagatgataggcagcattccaagcattgaggtattttaagccaaaacaattaagcttgaaaatacaagcactttaaaaataaatcatagtgactaatttctagctttcaggttcttcccattatttttaataggtttgcagtatatttttaattgaaaattgagggcagtcttagtggatggttttatccttcagttgcaaattatttttcggtttttatttttggagctgattcatgagtactctcacattaacaatattccaccacacactgaattgtcatcatgcatacagcagaaaagatgtgtttggggtaggaaatagtcatattgccaagaaaaataagagtatagaattatctcataatgaatataactacaaggcagcccctcactctctcagggcttcaagtataatagtattatgctgtaaatatggggcaggtaattttcgtattgtcagatctctttgcataatacatgagactgaattaatggtaagtgtgcgtggtcagtagtgctcattcatcacccaggatctgtgtctcatattaaatacttttaagcagaggtcgaagcacaggggagggagtttcaaatttgcatggatacagcaccattcttactttataaaatatttgcaatttctacctgttgtatgtaaagacagagaaattaatctataaaagcattataacagcagtctcttggcttgttgactcaatccataaaagcagacaaattttcagccatggagccctgaaacctcaatataaaaatgagtattatggtccatttgctgatgaaagcagactgaacttttgcttccactgtaaccacaatgtaaataatttagggaattatcatttcactgactgcttctcctccccctaaaggtgcactttactgtaatagaggaaatattcatctccccagtgggcaatcccttcttctcactgaggtgccagtttaatctgtagtcaaatgaaaatattgcagagctgcctgaactctgatgggaagggtactggagatagttagaggaagtatacagaggtagatatttgacttttgattttcttgctataaaaatccttgtaggtgatatgggctgaacaacagtatgaaaaagaaagaagtaaacgttcagctctaagggactcagcactaaatctcttcaatgatcccatgtggaatcagcaatggtacttggtaagtacctacagaaggactatgtgggtgggacctgggacctggcttctttatgttgttacatttgcaacatggattttttttttttttatgatggagaatttcatagggagctatattgtctggagattagggctgatgggatcttcttgatctgcctcttctgttttgctgagtaaggatgttggaaacagatatctttagctgctgtgaaaaaaataggttgtattttttgtcttcttaagtttatttgggataaatgcagaaaaataatatcttgcaggttagggtttccaaaaacagtacttgtggcaaaaatctcatttggttaaagttattcttcagaaccctttaaagcactcacagagtatagtgaacataatttggcatatacaaccctgaatgacaattcttatatgacacagatgagaatctctgaaagaggttaaaagaaggaacacaagaaaagtctattgcaaatgtctagacttgcaaaccattctacctttaagatagttaccaaatccttgagcgaagaaattgttaagtgttgctgtctacctgcagggtgtcctctcttctgtttaatgttacgtctgtatggtagtagtataggctaatagaaggatttgttgttgagaattttataaaagattatttctcttgaaaaacacaagctaagactttgatactcttgttgcataagggttagaaaaggggatcagtttctcttgaccctacgttttctttctttctttctttctttctttctttctttctttctttctttctttcttttctttctttctctttctttctttctttctatctttcttttttttttttgacagagttttgctcttgttgcccaggctggagtgcaatggcatgatctcagctcactgcaatctctgtctcctggcttcaagcgattctcctgcctcagcctctggagtagcttggattacagatgcccgccaccatgcccagctaatttttgtatttttaatagagatggggttttgtcacattggtcagtctggtctcgaactcctgacctcaggtgatccacccgccttggcctcccaaagtgctgggattacaggcatgagccaccgcaccgggcctcttgccactatcttaagtatttgctcattgcagcacaagagacttatcagttaacacttgtgcatttcctgtgtgacaaacactattctaaaatgtttgatatgaattaattcattttgttctcatgattgtctgtgttgtagaaatagtaattatgcccatttaacagatggaaaaacagagatattggaaagtagaataatttgccaaaatccatggctgctagtggtgggactataattcacgactccagagtccatactcttaacaactacagtctaaaattgttcctgcaactgacatagaggccttcttctctgactttggccaacaatctgtgtacagttccagcctcctgtgattcagcttcataccagcctggcaaatacttgtcaccccaccccccaacctctttatggggaggagggcacaaaagcaagagggcagctccttcactgacacttttgattgtggttatttatagatttcttattgaccctttcaccgggtacctggcattcttttactgtctctgtctcacatgcttagaaatgtgcttatatctgtgttcccttgctaccctgtacttatctcctgtacagtcccacactctgactatcagaaaatgtattttaaaaggaaaaccctgaatctcctctcacagacacttaccccctaaatcactcatacttaaaaataggcaatcacattgcaattcctgaggcaatcacagtctcctgagcattccaggttctgctttttcctttagaagaaaaattctaaaacattcatgaatgactatgcaccaggcaatataatgagagctcaatgtggcaatggagaatcaggatttggggggagatgaaaacatcgactatcaaatagagcttccatagatgaaagggttgagcatgttattataaatgaaagaaatttagggataaaattcttcaaagccatgtagttcaaagagaaggagcacaggtgattcatcttttcaagtgatgtccatttgggacaatcgggagaagagcagcactctgggggttcatttggccttactctcaactttgttttctcatttcactgaattggcttcttctaaagagtagagtgacccaaggaaaaagaaagatgggtctccaggttggaactgaagtgcccattttgtagcaagcaaatgataattttatcaatgcttcgttgtttttctttaccagcaagataccaggatgacggcagccctgcccaagctggaccttcatgtgatacctgtttggcaaaaaggcattacgggcaaaggagttgttatcaccgtactggatgatggtttggagtggaatcacacggacatttatgccaactatgtaagtgtgtgccttctcatgactgtgacttagggagctgtctgtgcagacacacagttagggctttccttcttttcaaggggatgctgctctggtgtcagtccctgggattatgggccaaggttatgtcccttctcccacttcccactagcttatatgaatttattttgtaccagtgggcattgaaataattcagtgggatcaaaaattgtacaaaagtatatgtgttgggagaagaaggggcagtgcctacaccaattaagttaccaaaatctgatgactttgagttgctcagtgtttggggcattaaagtaatcaaatcaagccccttgcctgagatcattgtcacagtttccctcctcacctcttttatgagtctatatccctgacattgtaaaattatatgaatgtgattccttccatgcaaatccaaagtgaataccacacaatgcacctatgccaagctgagaaaggaaaagttttctagaaatgggaaaataaataaataaaaacaatttgcttcattgtttattaagtttataatataatatgaacaccatcatatatcttaggtctttagatcaggaggctggtgtttcatctttcagattatcccttgtttttctctcatcctttccacctatcaaacattccccagctataacaccaagctaaagagccaaggaaaagagaaggaaaaatagtagcacagagtagaaattaggaatgattgaaatatacggaaagcattgaaaagtaacagtaagggtatgcgggaggcgtttaagtgtagctattgggttggaaaagggagtggagcctggaagcttgtcttgaatttcaagcaccctctctcaaattaaattacatgtttatttagtgtgcctgggaggctgaaggagagcaccatggacctgagtcccaccctcagccacttctttgcacctatattcataagagagatgagtgtcaaagtgtcactaactagctttatggccttagggaagtcatttaacttctctgggcctcaattttctcatctgaaaactgagatgactgaactaagtaaactaattccttccaactccaatatcccatgagtgcctgtgaaccataggcttggtaacattcactgagaattgaatgctggctcacctggctgtgttcatcatctctgcctggtttgtgagtaaaataaatattcagtgactcggccagaaactctaaaatgcaggcttttgagctatcagccaggatgggaaggcatagggtaagaggcttgggaagtgatgctttttttttttttttttttttttttaatgctgccacagtgttatattttgttgtctctttaggatccagaggctagctatgattttaatgataatgaccatgatccatttccccgatatgatcccacaaacgagaacaagtgagtaaatatgcatttgtgtgaaataaagtactttacaatgcttttatcttgtttgagaaaattataccatatatttcatccacattccagtgctcaggaaatgttaatgcacaacatccataccacaatattttgttgcttttaaaacagaaaccaaagtttctatttttatattccctttggtttatagaaccatattttcattaaacttcttacattatgaaattctcctctcaaatgttactgaactgttgtagctttagaaagaatgtttgagacataaagagtacacactttgagcccatccctcccctcaattcctctatgaatcttttactcttagcaacatgctttatgttagtcatgaaaagaaatatatgtaaagaaatggatatgaacaatgcccacaacttctgacggtggctacagtcaccttcaccagttctctcagaagagcatggccaaactccagacaagagaaatgcctctgaggtctggcccctgaatccaacacagtctccagggcattgagccagccggaagtctcctccagagttcctgctgctataaggccataggaaagagagaggagacagcacccgactcccagattaactctctgtcccttgaagccacattatggtgagagaggccaagagccacagaggccaagagcaagatcttctaaagggagaggtgaaagaaagacccagaggcaagagactttcaacttctctcctagccccaaagaaacttcacgctctaggcatgtggaccctcaaagtgtccatgcccatgggagagaccatctttgctcataccgatgttctcacagacatcaaggagacactcaaactttccttttcattttctctacacagaagagacttgcaccaaaatgatcaaagccaaggtcaaaattagggcttgttgctacaagtgaggatggaaaaagccaagcatctaacagctcttggtatatgtcacatgaagcgcttctttattctctctggatggcactgtctcttggactgttacccaacttgggtcagacaagtctgtctctgtctctctctctctctctctctctctttctctctctctctccctctcttccttcctccctccctccctccctcccttccttattctccctcagaactcccaagtggctggtgcagtaatactgatctaaagttatttctttctttggatagtcttccctccagaaagccaacaaaccccaggatgggaggctggggtacatggacttggcctcaacttctgggtgtttatttcttccttggggaaaatgggaggcttgtggatagttcagggatatgacttctttccgtaccatttatttctttgagggtgactaaaggggttaaccgcaaatatcccttagaggtgaaaacattccagtaaaaacacaataggaaccactggcaagggtacctttggagcaaagtgggagtgtttcgagagcttacagcagaccctcagacaaactttttgctatatgtctgaagcaggataatgcaggaccagtaaggacatctactcttttggggcacagccttgcaatgtagttatggctttgccaattcccagagtaaagggtgaccttggagaaatcacttacctctctctgcctctattccattttcttcccctaaactgggtgacaacgtaccttctccctatgtttcttaaatgaacttcctgaggaaatggctaataagcacttggaataataagccttcttagagtggagtagaaacaactttcattccacccccttggttaagactacgggaaatctgttcccagacacttgaggagacttagatggaggcactggctccttcctaggcagtatacggtccttccaggcagatcctgggtctggccccaggatccagtgtgggtgataacttgtacgatggctgcatagtgggcgaattcttgatgaaatgacattctctggagtttttccagtcaggagatggaacactcagaccttcctcaaaacaaaggggatctcacagcacagcatttataatagttgttttatatatatgaatataataattaaaataaaatataatttccctgactcagggagttacctgcaaaggccctagggaagcagcccatataatgctatttgttttgtgcctgaaagccctgagcttccagatcatagcctgctgtgaatcttccacacagcattgagagagcatgtcatagcccaacagttaagagcagacttgggagccaaatttaggtcaaattttagatctgccacttagtagttgggtgatcttgaggaaattatttaacttctttgtgcttaagttttatcatcttttgaaaaagaatctctacttccttgagttagaggtattaagtgagtgtatatatatatagagagagagagggagagagagagagagagagaggtattaagtgagtttatatatatatataataagtattatataacatatataatacttcattgagttaggggttaaagtgaggttttatatatatatatatatctcacttaatatatatatacatataaactcatttaatacctctaacttaatgaggtagattatttatctatatctatatctgtatatctggcatttaaacaaattgatttgtttaaaaattattccacaagatatttaaatactacccttattctggttaaaatattcttgtcacacttgttatttaagccatatatgtatatgtgtgcatatgtatatatatggcttaaataacatgtgtgacaaggatatttggcttggacatacacatatatatggcttggacactggtacacaaaaaagttaagtaagtgtttgctgtggtgatgatgatgatgataatgatcacagcttctcatttagtaactgaggtagaccttctttcagtgagaaatcaacatgacaagaataatatcatccgatgggagcagcagagacaagtcaattttctgagccaattcagaatctgctatttggaaatgacataatgagcaactctctctcaggatcctcttgactatcaaccaaaaaggtggcatccttatcatttatcagaaggtataataaaaagtagatttgccttctagcatgttgtcagacataaagcccttaggtttagaaaatgaatggctccattttgtcttggcctttacagcaattggagaggtattataccccaattccaaggttattatctcttcaaactatcagtattgctgttgttctttattaccacgtaaatgagattaatagaagctacatttgaatgctactctgaaagtcaaaagaggaatcactaaataataaaatcttaacagtgcaggtaatgcttaccattaagctggcataaatctgtattcattatttcaacaccaattacagattgtttttctagttaaataacaaatgtgacaaggatattttaaccagaataagggtagtatttaaactatctcatggaataatttttaaacaaatcattttgtttaaatgccagttactaccattgttctaagataatagaaagttctttactgcagcacctcacttagaaaagaaaaagagctgcggcctataaagaatgacataggaacacttttctttctctcaacgtttggaggtggaacctgaggataagaggaggaaaacatgtcaatgcatatttgtaccatgatcctcctgcagctctcactagagaatagtcgtccatatacaaggagagataaataataggtgctgtcacactgcatcattttttaggacaaaggcacaaacctggggatgtctgtcagcagattgattctgttggctcaggctgaagacctgcactggattcttttgctgacctgagccttgtctcccatcctgtatacatggaaatatataagaaggcagtggtgacttctggaagtacatttctcagagatgacaactgaattactccttctactaaggcaaagagcgttcatccatccacaaagcataagttgccttctgtatgttcagatgtgtgcacttttctcagagaatggtgtggtcaggacagcttcagttgcaaatgaaagaatcctaactcaaagattaagtaacaaagggattttaaaaatattcacccaagtgatgttctagtttctgatgtttcaagatccaagagctcaaacaatatgttctcaggacaccaagcactctgtttccatctctagtgctgctcgcctctgcttggcttcactttcaagagaatcctgcctggcagagcaagacccatatgactcacatggaacttaaagctcataattctcaagaaagagtggggtttcttccctataatctacatcagtccttgaaagttgtctgagaggaggggccccatgattgaaaaaaatcacaaaaagtcaggagggctgcttccccaaacaggaaaatgctagcatacataaaagaagcaggtgtttgctgcatcaggaaagatcttgaattaaagataattatattgtcctgacttagaattcctagccaggattaacatgaaggagcaggaatcttattttgtggaaggagaccaggaaatcatctttgctacttcaggaaaaagagaagttgaacaattcttcttgatggccagtcaatttaggaattttatattccatgctatgctgaattaatagatggccagtatagtagaattgaaatgtaactggccaacattattgctccgagctaacccttcctctctttcactctatgttggtatatctggtaggctcctccaagccaccaacagccttcacactcttacaggttgtttccacaatagaataaaatcacgaaataaatgaattcacattaatgtgcttttggcttgttggccctcctgagtcaggatggtggtgggaaaagacaattatcatcctcagaatttcagaatagatgctttagtggtggaatttggtgttttgaagacgcatttttcttccaaatactctgaaatcataaattaccctctttgcttgactgcaaaaccaatcatgttcaggcttctggccccagttgggatttcaggagcatcttggctttccaattagctggtaatgtcttgcaaatatctcaagctcctcttggtaccagataatcttcagacattttagtgtggcatatatttagaggagaggaggagggcttaataggggacttgttctaggatatcctactaaggctgatcaaggataatctaatccaaggcagtcactagggagaaaagtgaggagccactttgctaccaaaaagtacaaagcagaagccatttctctgaaattgtttctgaatgtcagagttcttataatagtatcaatagttaacactcactgtgttcttactatctgccatccactgctctaagtgttttacatataatttgtcatgtgaccaagcctttgcagacaagtaacttacccaaggtcacacccttagtgaatggcagaagccagaatttgaaatcacatactttgtctctaatacttgtgcccttcatctgaacataagttttatgttatactaatttaaaacaaacaaacaaaaacagtaacaaggccgacaaaaagttaatatacctatgccccattaattcattcatatgcaaaacaaatgtttgttcttctgtatgttttataattcttatttttcaatcctcagacacgggaccagatgtgcaggagaaattgccatgcaagcaaataatcacaaatgcggggttggagttgcatacaattccaaagttggaggtaaaacagaggattgtccctatagcttggcattttaatgtgaagcttacatcacccattgtaaatgggggaggggagcttttctttttaacaactggaggaacaaattagttccatgccaaagttgctacaggacttgaatatgatttgccagcgagtcaatagatatggattcctagaaaatggacagttgaatatagcctatacatctttgcaggaaaaaaaaaatgtggaaatgttgaatagcatttgaaccaaatctaattttctctatgttctgatttagaatggtttgttattgagtgcttgctaaggaaacagaaggaggaggtaaatttaggcaaagacttttcctgcctctcaattctgtagaagttcttcactttatagagaagaacagcttcaaaatttaaaaaaagtacatacttattatattaaatagccaaattttatcttttatagcaaggatgtaggatttaattgttttcatcagtgtccttatggggaaacacatggtaagttgcattagggcaactgtggacattttaataaagaaacgatttacaagaattagagaaaaccaacaaggggctaagaagtggtaggcagatgttatcacctttagcctcaaggagcaaagggaagaagtcagcagaaaatagagagggaaagctgtggtcacaggagagagccactggataggccttgagtacaacaacagagccacttctaggcaaaggggattcaggggtataggcacctcattctcctcttgattcccaccctcttgctggtgtcttcagttggctgaacccaatgggaagacagagcccattgatgcagtccatgttctaatggagaagagtggaaagtggatctgcaggggccaagagaaaagaaaaaactgtctctcctctttatgctatcccaacctcaggctttcatgttatgttataagcttcaagtttagtttggttttcaaaaaccataatcacaaaaagaatcaattgtagaacatttcaattacaataaaaccccattaaactctacatgagtataccttgcatttggttatgcattcctttttagaaaccaaataaatatacatcgtgacatgtaatgcatctttcatgaatatagggcactcttagaattttaagtgtcattcctgattcctttgatactaacatcttcaaagtgttctgttaatttttaaaaaaaatgaagggagaagcacaaattatgtaattagctagtaaaagaattcactcttttagtcataatgaacgaaacagctatagtttgtgaaagaatcatctgatcccttcattttgtagagaaagaatcagaagcaagctgctcaaggtaatgaaagcaagtttgtggcagtgtagaactgaaacacaagattccaagcctactgatgttttccattactccatcctttgatggtctggccccaaatgcattttttaccaataatcttcatttattaggcacctattgtatgtcagttactctacaaatattataggcagtgtatcctggtggttaacagatttaggggctagatttgtagggttcaaattctggctccccagtttcaagctatgtggccttgagcaagtcactatcccttcctggcctcaatctctccatttataaagtgaggagaattacggcacccacctcaaatggtggttgtaaggtttagatgagtttatacatgtaaagcctgtggattggtggctgcatatagactatcatgaatgcacatgagctgttattatcatccctattttacagttgaagaaactgaggcacagagggttaactggcttgcccaagattccacagctggtaagagcagaactgggattttttttttttttttttagacagagtctcactctgtcgcccaggctggagtgcagtggcgcgatctcggctcactgcaagctccgcctcccgggttcatgccattctcctgcctcagcctcctgagtagctaggactacaggaacccgccactacgcccggctaattttttttttttttttttttttttttgtatttttagtggagacagggtttcatcatgttagccaggatggtctcgatctcttgacctcgtgatccgcccgcctcggcctcccaaagtgctgggattacaggcgtgagccaccgcacctggccgattttttttctaaatgcatttttttttttttttttgagacagagtcttgctctgttgcccaggctggagtgcagtggttgcaatcttagctcactgcaacctctgcctcccaggttcaagcatttcttgtgcctcagcctcctgagtagctgggattataggtgcgtgccagcatgcctgactaatttttgtatttttagtaaagatggggtttctccatgttggccaggctggtcttgaactcctggcctcaagtgatccacccacctcggcctcccaaagtgttggtattaaaggcatgagccactgcgcctggctctaaatgcatttttgaacaatttcttttttacaaatacaactttcactgatcatatcaatttcatatcattttacctttgctccatagtaaataagtgtgaaaatctaaggctgtgcactttattgtattatgagcctgaagccagaaataaccaggtagctgcctgtaatctgtccagattgtttttgccttcctggctcttgaattcataagtctgatgacgggtgacagcctgttggaaagcacaaagagctaccgcacctacattgtcctgatgaaaaatgattccccttgggggtgaaatccatggcaatgatttcatccttgagattatttagaagaataggaagcatgttccttgaaaatgtttcttagcaaacacatgaaaggatggcctctgggttatttttaatcagggcttagaaacaaaagtgctttccctatttgttagtttcctgttgtgactagatcttttgaagctacatgtttcctgtccagagtccttgtgtggcgtagactgggccacagccatttgtgggacagccatgaggaggtgcatcaccagagggctgcttggagggtctttctgaaagctggtctgtcatttagttggggtgggagggagggcaaacattttgtaattgacaacaatcacggccacttcctctcatccaaggatgctgctccacttcagactcaatgcccagagcttttgctgggaagagagccttgagtgggaccaaaaaaaaaaaaaaaaaaaaaaacatcacagctgcctacacagtgcatggtattgcatagtattatctctaaagtgcgacaaaaaagcttatgggggcagcaacatgttccttccttctgtggtgtcagtagctgggttacagaaattggggacatctatctagtagttacctggtttttgactcttaaaatcctttaaaaatacaaatagtaagagtattgggcttttgtccatgtacatactgacatcaacctttgtgtgtctttgtttattttgtttctcaggcataagaatgctggatggcattgtgacggatgctattgaggccagttcaattggattcaatcctggacacgtggatatttacagtgcaagctggggccctaatgatgatgggaaaactgtggaggggcctggccggctagcccagaaggcttttgaatatggtgtcaaacaggtaagatgctttacacagacccacatgaaatgaaacctgaccatctggatatgaggagaaggaaagaacacttaggttacatggaataacattgttgtggatttcttaacaaagtcctttacaattttaaatgcacttagagggccaaatcattcttcagagggatgggagttaaggcttaagaaagttttccctatttgtggccaggcgcgatggccaagggaggcagatcaattgaggccaggagtggccaatatggagaaaccccacctctactaaaaacacaaaaattagccaggtgtaactaggttgcactgttctgcaacctagtttagacagtgaaactgtggtctcaacttagatgcctatagtcccagctactcgggaggctgaggcacaagaattgcttgaacccagaaggcggaggtagcagtgagctgagattgcagcattgcactccagcctgggtgacagagtgagaccctgcctcaaaactaaatataaataaataaaatgaattttccctatttgggtctgaggttgaatggaaatttattacttttagcatatttattttaaaagtgcttctggacatttctttctccttactcattttcctgctgcttttgggtttttacactagtaaaaaactactcagtcttcttccaagcgcggaaatgcttttcaaatatagaaacgtgttgccttctgctctgcacgtgcctgttgaatacctgtgccttggttggattgctctgtcacttgggtttactgtattcttgcacagattctaaagccttgtgctccataagatgaaacaaaagtagaaactctggagagcacaaattgaaaaatcatagaaagggcggctttgacgagttccattcaattgaagagtcccttttaatgcagctgcaaggcagatctgaataattcctaattttgtcattctatcagtcagccagaagattgaagcagaaagaaagagaggaagttcaaagatttaagtgcagtgacataaactaagagaagggtggaaaaatatgagcaagtgcaaaacgctagattatgaatctgcataagaaagaaaagcgtgtgctcagccctaccccaggagggcccagagactggcagggccagagtccagtggcttataatacacagccttgtgagatttccaatatcgaagccaaaagatctggaattgaaaatagatcccaaatagctgtctctgagaatttcacacatgtagtcgttggggattttattgggatataacaatgaccccaatagatgataacagataatatgcattctggcttttcctttaggggagacaggggaaggggtccatcttcgtctgggcttcgggaaacggggggcgtcagggagataattgtgactgtgatggctacacagacagcatctacaccatctccatcagcagtgcctcccagcaaggcctatccccctggtacgctgagaagtgctcctccacactggccacctcttacagcagcggagattacaccgaccagagaatcgtatgttgcttttgtctaattctctctgcttagttaggagagcgtggcatgcatgtgaaatgattcccctaactgacctttggtacgactgattcgcttaagcttgatgtctcagttgggagaactcacacttactcacttgaaaggctggcatccatcagaaagttttctctccagggataatgacacttctgccaagatgatcttcccctctgtcatttttaaacccagccttgagaagccaccaaacctgtcattacacacagcggagactccaaatgtcttttctgcttgtctgatgcctccctggaaacagccttaaaggagatctcagggttgtaggggctttatcacccttgtacttgctgatcctttaacagcagggatatagtctgacctgccctgtcgcagatgataaaaatacagagtctacaccagctatgtctcctaagaatggatgacctgcaggaaaatagcagtttcagtgtcccctgaggtgaactgctcagcatctgggtaagcagctcggggaggtcgtatgctcagagagctcctccagcccacgcttgcctgcgcctttgcttccatgagtcagacggccaagggcaattactggatttcccttcaagggcatgacgatggaggggcatttaggggctttgagaacaaagggaggcacctttaatttaaaaaatgtaaggcccccaatttaactcctgacacagaaaggaccaactagctaaagtatatagatcctatctcagtgaaatagcaggtcatgatctaattagagggtgggtgaaccctataataatgaccttggaatgcgtgcaagattcctattaatggcatctcaacaaaattgtcaacacgaacatcttcttcatacaggatcacttctgcaagctagtttagacagtaaagctgtggtctcaacttagaagtgtgggcctgcttctcacgcgcatctcttcagctactcaagtaatagacagtggcattctaccgaggggttttatggcaggcacattttaaagggtttgaaaggggcatatcagacatctgccccacttgtcttcagagcccctggctgttgtcatttccctgggtgtccagagctgcctttagaaaatggcctgttgggcatttcagaatcaccatttcacagactgttccttatcttgggtaacctgcactgaagcagaagaaagattttctatctttgtaaaactccctccttaagaaagccagccttaggagagacagctggtggattctatttgagacagtctcagtaacataacctttttcttacgcaaaccttttcctcagcatagtcatctctgggggcttgcttgcgtcaacaggtaaaaagggcaaccttgcttccgcagccctctgaggagcagagccatcataacttgagaaattcagcaactccaagcaggaagccaatggaggtgataatagaacaaattatttttttacacctccctcccacacatcgaaatctcgagctagaacttcggtgctggagcctgggtgggtgtcttgttagtaatcccttggcccaaccagcagcgccgtggtccttaaggcagacaggaagtcttttcagtttcttcccttcatctcagcaatctcttcattaccctaaagttagccagggtaattccttacttgcaagaaaattatgtaaaactactttcacagagaacatctcgggtaagtctcgcatatgagtcagaaaatataaatcgcattttacagatggggagccaaatgacttgcccgaggacaaatctattaagtagcagttagagaatttgaacccagaactaagtccagcacactttccattttaaagacccatcgttttcctcaaagtgtaaatgtggacaccaactcacaggtatcaaatctagttcaacagtgagtgcaaactacatattaagcattttttgtgcaagtagttcaaatggctaaggccaggatgtcttcatatccttgggctgaagaggcagccaaatgtcaatctgaaggcaaaagggaattttgtatgagacagaatttctaaatatgccagaccaaacacaatggacccgatgattaatgggccagcatgattcacagtgattttgaaactttgttttttatagacagcatttcgtttgggaatctcagaaaagaaaatattcgtagtgggagtacttcatccccagaaaaggcatcttgctgccagaattatagagaagttgcatatagagggtgaactaaaatatcagcagatggcaaacatccgcctgtggtttagaggagaaagtaggcaatcgaatcagctgagtttcctggtcatagcagatgcagcctttggtacagttaacccccaagacaggcccacactcctcacgtgttctccctgcctttctctccttcctgacgtcatccagacgagcgctgacctgcacaatgactgcacggagacgcacacaggcacctcggcctctgcacctctggctgctggcatcttcgctctggccctggaagcaaagtaaggcccagaaagcttctaatcacctttacaaaggctgattctccttatttttaataacacttttttttctgaatacatggttacaggagaaattttggaatactgcaaataaagataagctctttcctgccacttcgaggtcactaaccatagttaacatctcaatgtagatttaatacacacacatcttacaaaattgggatcttaatatagacattattttgtaatctgtttttaaaacccattctacaatatattaaacatactttctcctgtctaaatcaatatgctttgacctttaaaactcatgctatccctcaaatcttcttcccactcagctacaacgccttttgtttattctcttccagcaggattttgtttaaatagtttccagtgggcagtattaggaacaagtttaaaaaactcctttctttgaatatgtaagcctagtcctggagctgatataaccacatcaggggacatgagatttaaaggcaggagttttatattttcacagtgttccattgtataaacacaaatttccttaaagtcatctaatcatgcttaaacaccattgtcagtaaatattagttgtcatctctgacaatttcctcaggataaacactcagaattggaatttctgggtcaaagggcaagcatgttttaatgatttttatatatattgacaagatgctgccttgaatgactataccattttatattccctccaggaatatatgtgtgaaagtgccagtttccaaaacccttgtcaaaactacttttattatcttttaaaatatttgctatgttgataggtgaaaatggtatctcattttaatatgcttgtatttaattactaatgaagctcaatatttcatacccttcagctctttgtcttctggggttgcttctttatggccttagttttgttttatggccttggttcacaaaagctagatgctttataagtttgacatttaccttttaatttgtttctatgtaatttttaatgaaatgtagttaatatgtatgtagttatgtttgtcagtctgtttctttaaggcttcttcctttgcttttatgctcagaaaaaatcttcacaaccccaaattagataaacattaattatatgtcttttattatggtttctttaccatatttaaattctaaatccctctggaatttattttagtgtatgatgttaaaaaaagatttaactttttttttctcataattacccaatagtccaatacttaacacagaggaaaaaaattgaactgtctcacactgcacatcacagctttttatgtgtcctcattcctgctttctgatgtgtggtgacagtgaatcttgaaatgtcaagtcaggtgctatggttgcatattagaagaagtgattaaacttgtaaattactattatccttcctaataaggagattatcctagaataaattacatattctctagagagagaacaaagcagtgtccttatgtcatattcagtagactcagttcgtaataacagaaaggaaaaatatcttggcctttgccatgactggaaaagccctgaggttcctgagcctttgtccaggagagtccagtttatctctaggatccctggggcttcctatggagatggggtatattcctgggtatctcggctgtgagatggctacagtggctaagcaaggaagtctagcaaggctcttaccaagagtccacctacttggaggggctggcaagatgtttggtaagggaagaagtaaattcaggtgctcaattagaaatagatattgggccctccagaaaagctatgttcagaatctaagttcacttataataggaagtagatggacaaaagacaaaaatctatgaacacaagctgagactggcatcagcagatccaaattaaccgagaaataattgtccaagcagtgaaaattgcaaggaacacctggcttcaagttctagctctaccactagctatgtggccttcggcaagttaatttacttgtggggttcagtctttccatctataaaatgaaggggtcaaacgagacctttttttacaaacttcttctcttcctaagattctcagagttgagattgaaaatgtcagcctgtataggtaatccaacatgaattgttggggtcagtgatgaggggtctggactggaagaaaatagggtcctatggattataggatcctgtgcaacagacttattatatttaagatttcaaaacacagactactaccccagggagctgttaaaagaaagcaatcttaaaattttatgtctagagcctttcttctctatccaacacctgtcagatgcatgtaaatataactagccgtgcctagcccatccttgtatagtgaccaatatagtagaaatatccatctgctgaacagaagtaatgccaattttatgtaagagctgaaattgtaaaagtgcaatccttggtttctaaaacctcaaggcttctttttctgtatagtggaaaatgatcctatacagaaaataatcctttccttttctttttcttttggagacagtgtctcactccgtcacccaggctggagtgcagtggcaagatctcggctcactgcaacctcaacccctccggttcaagaaattcttatgcctcagcctcctgagtagctgggattacaggcatgtgccaccatgcctggctaatttgatccttcttttttctatgtaggagaaaatgatctaggaatgatctagcctcattaatctcagtctctgatggacagtctctaaagcaggtgtttcatttctgtgaaacactcagatgggttccaaggggtccatgaatctctttgcaactaaatgcagaattgcttataaatgtatgtatggcatatttctggggaatggcttataggtttcaccagattctcagtgttcgtgatttaagagatattaagagtctatgatctcccaggtgcttatcataagaatttaattcccttcattttgactcaattcatcagtaagataagtatgactgatctatcttaacatttatatccttactgccaaggtacatagaggttattaagatttctgttctcaattgaacatttttctgaactctattcaattgtctataccaaagctgaatgccagaatttctagacatgtgaccaagctttatcccaaggcactcaagaatgagaaaatcatttaatcatgtgccatcccacaggaacaactatggagactgaagagcccttgcctaaacttatcaagaataatggcacccaatattgattaggttcttactgtagaccagacacagctggcctctttatatacaatattaattataacgcttacaacattcttatgacatagaaattattaatttcacctataaatgggaaaaaataaggcttagagaggttgagatatataaccaagatcccacaaagaaattcaaactcaagtctctctgactgcaaagtctgtgctatcagcaaccacaccttgcagcctcccacagccctgtgagggagaggcaatgttgaatggcagcctatcatctcctcaaataaaggagggttcggaagattgaggctgataaatgaacatgcatttatgagtttcttataagttttctgtcacaagcagactactcaatatgctgtgttaaatgttatatagccagagtattggggaatgggaggagaaaaggaaaggagaaggaatggtttctggctgaatatgcacaaagaaatactttccttccccaaagcgatgtttctcaagtaccagcatatatagtcatcacctggggagtttatttaacatgcaggttcccaggtcattttgccagcaactattcagaccttgtatctgcctaggagtttctggtattcaacctaggaattccttttttaacaaatctcccaggcactttttaatgctagtaataccttaaccaagttttgagaaacaaatgctataaagagttacttttaccactgtgttttcctacaacctcatccacctgtgtttgtgtagaaacccattagggtagttagtaggtgtatcttggagataaatatactaagagaagaaggaattccttgcataaatgtttgtggcactattattattatgtagtgagtatacctaagaaagctgtagaaaatagcctcagccttctgaggagagatcaaaagaatcagaataatttttaataggtgaggaaaattctgaagtgaaccattgaatcccttcacacctttggaaatattaaacaaacagataagccaaacttctggtcttattaaaacctggagaaagagaaatggactttcaatgctgcatgaaacctttggaaaaaaatcacaacaaaaaagtcttgacttagtgggttgtgaaatgttagaaagtccaagttagaaaaattttaagatctaggctaatttaggtatgattagaggctgaaccagatagctcctaagacttttcactctggaattttgtctccaaattacattacctacatctcttctaattagaagcaatgcttaattcggtgtttaattccatacccttattttctgtaaacatatctttgattagccactcaatgcagtgtttaaaaatttaattatcgtggatgtcattgagcacaaattaacaaaggaaggctgtcaggaatgagttgcactgttgttagcagctccttttcatttatgaaatacaagcacacgaatgaacaataactctgttagaaaaatacaccggggcctgtcatggggtggggtgagtggagagggatagcattaggagatatacctaatgtaaatgacgagttaacgggtgcagcacaccaacatggcacatgtgtacatatgtaacaaaactgcacgttgtgcacatgtaccctagaacttaaagtataataataataaaaaaagaaaaataggtttttctaattgcatgacaatgaagctccttaatattttgcagagactagataaaggaaatttttaaaacaaaataacctgcaactgcatataaaataaatgctctactacagaaacataggacacacatgctatatgtgataatcatgattatcagcaccttgccttaagcctcctcagtacgcttcctccttcctgcctccacacatgcacctgcacatactgatgatccaaacggaaaactggtgtgttgcccattgactgccttgataagaggcttttacctaaaactccttttaaaagactggaaggaagcaagcatttcaataaaatgtcctattctatttacaagtgtaccaggtgatcatgaggcaagcattctgggactcactgaggatccctaaactggtgtccttccaaggcctctctgtcagtcactctccagggtaaagtggtatgtttgtcgggagctcagctcaggtgagctgagctgtcaggtgtggagtagcctattaattcaacaagccaaaaatgaaagcattgagcctttagtcacttactgctatgacataagcaagagtctgaaaccggagaaaacacttactcgccctgttcctggcatactggttgagtggctcagcacagacttgagggtcatctcactgctgagggagccccgaacaaaaggctctggcaattttatggactctgaggtgtgaggcggggagggaccaagagagtacgggagtggagaagcaccaggcactgagtctgagtgaggaaagtgtctagatgtttcccctcctctctccacgaggaggcctgaccaagggacctaggaaggaaagctctcaccagctaggaatgtcaatatggaaagaacatgaggggccagggggcctgcggccttcatggaaactcctctcagaggctgcgagccacaaactgcacactgtgtctgcatggggagggcagcttccccgtgtgtcgtgccaggtaagacctttgaaatcgcctatggtcaggcctgaaaaatcacacacggtttttaactaggagccggactcttcagtgtttaggaatgtccactgcctctttcttgtcacaggggattactgagccagtacatgatgggctctggggagaaggcagcaaagtgagccagactcccctgatgattgttctccaaccgagtgctgagacaggaaccttgaggagtaaaaactgggcatctacttattacataatgcttgattggcttcagggaacaatacaggtctcaaagtcgaggaaaagtttgagaatctgactgatgactaggagcaatatgttttaaaattatatttggggctagttagcacttaggcatgttcagtctctgaaccaaccatatctgctgagcatatataccctgtgcccagcattcttctgggtgctacacatcagagaacaagatggataaagatctcaccacttctcatggttaaattagaaccagggagagagacatcaacaaaacacaatacaaatgagtttcccgcatgttagaagcctataagtgcaatggaaggagaatatgcacatatagcagaataagagagctcgggaccatgtgggagagtggaaattttaaataggctgatcaaggaaggcctcatcatagtataatagatccaacaatcccttatatctctgatttatctttatagtgttgctaaattaatcttactaagacttatgattttactatttccttactcaaaaattctcactgattcccactgcccaaaagataaagtataagctccctttctggcatgccaggttctcatcgctctggcccagtactcctcactgcctctcccctgccccagcaaaccaggctgtcatctggccacacctgtactgtcccactttggtgcttttgctccagtggccttcttctctatctccacttcttaacactctaccccctgtcaaagtccagctcaaatatttctcccccacaaagttttcctagatctttctattccatggaaattctttctactctaaactcccacaatgcgttaagctatgaatatagcactcaccagatagaattataaaagccttaattctttttactggattgtaaacttcttttttttttttttttttttttttttgagacggagtcccgctctttagcccaggccggattgcagtggcacaatcttggctcactgcaagctccgcctcccaggttcacgccattctcctgcctcagcctcccgagtagctgggactacaggcgcccgccaccgcgcccggctaattttttgtatttttagtagagacggggtttcaccgtgttagccaagatggtctcgatctcctgaccttgtgatccgcccgcctcggcctcccaaagtgctgggattacaggcgtgagccaccgcgcccagcctggattgtaaacttctaaaagacaagaaccacatccttgaatatccccatggtattagcatagtgccttgcaagagtgagctcaaatagctaagagtttcttgacgcttttgatagataaagaaaaaggcaatacatgtttacagcaggtagccagtctgtgtctttaacatctcactcttcctaagaaggaagtcaaggcctcgtctgtgggttcataatgctgaaagtgctaaggcttttaatggacagcatgagactggagggcataaagaaagtgttaccatttaaaatgtttgctcagttaaatggaagtaattagaaattaaggacaaagttttatacttctatattgctgaggactgaattttactcatagtaaaagcttatatgctctggagagaagtcataacttatatgttacagggagaagttttcagctctgtattctgaattctgaatgaaaagatatatgaacagtaatagacactagaataacataactacaatagcaaaaggcacttcataatccctgaatggagatgcttattgttagcacttgcttttgcaaggaaacttcatttttctctgaaagacactttgggtcacttcccctccagcccaaatctcacctggcgagatatgcagcacctggttgtctggacctctgagtatgacccgctggccaataaccctggatggaaaaagaatggagcaggcttgatggtgaatagtcgatttggatttggcttgctaaatgccaaagctctggtggatttagctgaccccaggacctggaggagcgtgcctgagaagaaagagtgtgttgtaaaggacaatgactttgagcccaggtaagtatctcctggaattttaaacacatgtgtgcccatggcataatttcattactatgtttgccattctgcctgatttttttgtatctacccttctgaagtagatggaggtggaattttctagtgttctctgtgggtatccatggggactaactaagagaccaaagctctagaaaccatgttaaccatttgcatgttcctcttgtagtccacctaccacatagcacccagtctaagatgcaccattgttttattgtcaattaaactgtgatcaaccacccatcagttttaagattcattctaaattcaatgtttaactatttttttaaaatgcatcttagggttgatgaaatgcagtacttgccaaccagttttacccaaaatctgcttgcaaaatagccttgcttcatgccacagtgctgtgtgattcatggcttttcttccatgagggattctttatcatacacttacttagactccctctagcacaccacatcttgtcacagaagaaatttctactaggagtgttttgtaatttctatcaaagcaatcaaaataatactgaagacctgctcacacaaaatatccaaggatgggaggcttggggcatgccttcagaaggccttctagataaaatcatttttttcttaagaggggctttttgatgggtctacaataaatctgcctgaatttgactccacagcaaatagcattgtatttaagtattagtgccccttaccattttcttatgcattaaaattcatgtatacataattctgaattaggttctacacatcacagggagtgacaaaaagcttagttgagcatctagtcaagattgatgcatgcagatatgcataaaatgcaaggaagtttggatatactttattcaatgctgattctttaatgtatttagagccctgaaagctaatggagaagttatcattgaaattccaacaagagcttgtgaaggacaagaaaatgctatcaagtccctggagcatgtacaatttgaagcaacaattgaatattcccgaagaggagaccttcatgtcacacttacttctgctgctggtaaattaaaaaagttctaagccatttatatttttaagtgtaagttgaatgattcaaataactgattgcttttgtttattcatagaacaaagtctcctaatagatattttcaggtcttaaaaaacatgcttattttttcctttttcttggtgttagatctccctctgccctgcccatttccactgatcctttgataagcagagaatgaggcccattcaaataatgctaattaatacacttttctgaagtcatgcattttcaaactgtttacttttccattttactgacctatcacttttctcttagatagcaaattagtgaaagttactctgataattaaccaaactcacagatatatccgaaacatacaaggagtccattgaaaactgggaattcagatcgattagaggagattgagaagattaacaaatttatcatagtaacatgaataaggccattttatatgatgtatgaacatttgctttttcctgcgagggcactaattcagataagatagtggatgggaaagagctcgtgaaccataagccataatctaaccaggaggagcagtcccaatactcctttatgttttagcaggactcaactgactaaatttggtttctgtgggtgatatgtgaggaaagatgagctatctctatgatcttcctcctgaatattaattcttagaggtttggaataggctctgttaattttgaagttatgctttctagatgtattggaattaacctgaaatattggtggaatgcttttttaattgatagacctgcagttatttaacccttccacatagaactattatcaattgatctagaaagggctgggacttaaaaatttacaggtaacctgtcttttaatataagagattgttaaattaatatatctttaagaaattaatacattaattaaataattatgattattaatgattgcataataaattaaataataatttttatgtttaaatcattatggagtcaggcacctactaaattttcaagatttcctctcacacttcagaaatgatagtttcattaaaatatttttagatttttgactctctaattcaatttgtaaatgtagttcgccgagttttccttatttaaataaaccttagtcaacattttcattcattcattcattattttttccacaatatttattgaggcaaataatattattcattattatatatgccaggcaatgtgctaagcactatagataaaaacatcatattttttccttgtgagtgtctctatcctggtcttatactaaaagagaaaattaggagaactcatctttttcagcttttattttcagttatcagatgctagagtgtatcctactatcagagctattaggacattcattaacttgtatttgtttcataggaactagcactgtgctcttggctgaaagagaacgggatacatctcctaatggctttaagaattgggacttcatgtctgttcacacatggggagagaaccctataggtacttggactttgagaattacagacatggtaagtgtgaatgagaggatgaaaaaacacaagcttacttttaaacattttgaagcacttttaaggttgatttcatcattaattagggccctaaagaattgtaccccttcttagtagaagtaagggaaaagtagagtgtttcaagccctgaccacttggttacgtagataatattcaaaaagaaagattaggcttcagccatactataagagggggaaaaacacttatataaacaatgtgacagactgtgggacaaatccaggtgttcccatgtctgcatgcagccagccatctaacctattcagccaacaaaatcaatcatattcacaaagatacttaaatgctcagaccaactttggtgtgacattctgccagagtcacatcttaaaggcatgcttatgattattctgcaatagctatttagatgtagcttaatgtttggagagatatcttatttaatatgacttttttaaacagttttagtcatgaaacaaaccgaaagcatttctcatttctttttcattctgtttactaacattctttgacatccttctgtaattttaacacacagtcacaaaaatgcaagtacagagcaaaagttagaaaaaagccaaatatagcttaattatttatttttgcatcatttctccaacattctctgtaggtgagaatataaatgaataatgttttggctctgagttcttctgtgacaaaagtgtaataaatatcagcagtgtagaattatacgcctaaataacttttttttttttttttgagacggagtcttgctctgtcacccaggctggagttgcagtggcacagtctcggctcactgcaacctctgcctcctgggttcaagcgcttctcctgcctcagcctcccgactagctggaattacaggtacccaccaccaagcctggctaatttttgtatttttagtagaaatggggtttcaccatgttggtcaggctggtctcgagctccttacctcaggtgatttacccacctcggcctcccaaagtggtgggattacaggtgtaagccaccacacccggcctagataactttttgaaaataaatcatttaaagttcttggagatgtcaattaaattaatacaaattctatagtcgtttgttacatttttttctctgaggatagctttctcctaaagactgctaaaattgtgatttagaaatggaagttgtaaaatgtccttctctcatagagcaaaaaaagaatgttcttagcatctgggcctgttcttgaatttggcctctattcttcaactcaatttcaccatcaggaaactaagaaaatctatttaccaaggtgggatttatttcatgtcaagtctgcaaaatctgaccttacacttctaaatttttaaagatattttagattttaacacattatttataattgttgagccttgaaaattatgactattcccccaaatatgcaactttttgtaactgaatttatagacctcttatttatttattttttgtcattgaactttatagacctcttttatttagttttttattatactttaagttctggagtacatgtacagagtgtgcaggtttgttacataggtatacacatgccatggtggtttgctgcacccatcaacccatcatctacattagatatttctcctaatgctatccctccccttgccccctactccctgacaggcccattgtgtgatgttcccctccctgtgcccatatgttcccactgttcaactcccacttatgagtgagaacattcagtgtttggttttctgttcctgtgttggtttgctgagaatgatggtttccagctttatccatgtccctgcagaggacatgaactcactcttttttatggctgcatagtattccacagtgcatatgtgccacacaatttttaagggcttattaatgctagaggttgtttataatactccatagaggctgacttttttcccagtggaatgtttctataagttgataattgggaaatatatttatagaaggtacagtcagctttccaagaacacatccaatatggaaaagaagacttacatagagatttctgatttttaaattaaatgtttgattatgaagcaatcagtttctaaactgttgaacctacaaattgtcaatttttatagcaagagtggatccaatggtttctttcacatgaaatgcacagaatcttaaaatgagattttaacaatgaaatcctttttagctattttgaatgagtttgttttatattatctaaaacacatactaaatgtaggtatgcttatttgttagtctggaagaattcaaaatgaaggaagaattgtgaactggaagctgattttgcacgggacctcttctcagccagagcatatgaagcagcctcgtgtgtacacgtcctacaacactgttcagaatgacagaagaggggtggagaagatggtggatccaggggaggtctgtgtggctctgttcttggcatgctctcttttgaactggggtagacaatgtagtcagtgaagctgtacccaacttccaagcaggaaataagtcaaacatggatggggaggataagaagtgatagtggtaaactattcttttccataggataaaactgtatttttttcattcaatattttatccagaacttagaaatcacaattaatgaattcaaaagtattaaatttcctaacatgaattttctccacttatgacagataacaaatggaaaaaaaagttatctttatgcccaatcacatatatctaacatttgtactgtactttgtttttaagcattttccacattgtctcattaacctataatccctataacctaggaaggatagacattcgtgtatccattttgcagaaagaaaaacaaggctcaaatggccaaatcatgtaggcttctttttattaattcattaactgacacttcttggcaacaccaaggggagcgatagatcacactttttctcaaaaaatttcagaggatagctaaaataagtcgttcacattcctgggtttcagcctgctatggctcctggcttccttctatcagatggtgagaaaagcccacattttctttatctctgtatcccagcatctagcacagtgcctcaggtgtaataggtaggttttcagaattttcagaacgccctgctctgaataggtccagctctgagctgggtgttttggaagatacagaggcaaagtacatattcaagaaacttacacatgaactgtgaaggcctcagcttgaattctagttccatttatattcttcaaagcagcttccctccaggacctgagtcctgagtacttttcttcacagtctgggaagcaggttaaccttgtcagtgttggaatattgaaacacttccacagcagttggccaaggttggcttctctgagctctccagctccctcctccccagcctagcacctcagtctctcccctgaccacttcttacagctcagtggctaaaagggtagttctgaaagccagtgcctccaggaaggcacacccatgctaccgcaaccagtgggtgccttctatatgacttgttagatattttgatatcctctgcttcccaaaatggattccatgacagcaggctgacaagtaaagaaaaccaccatgtactgagtacttacctatacagtctcatctagtcttcaaaaccaccacaaatggaggtactcttattccacctgacaggtgaagttgagggagattaaaaaggttgttaaaggtaccccagagggtaggcaaatgagggttgaagcccaagtccatgtggctcccagtcttgaactctctcccctcccctcattgcctctcaagcggcaggcagcgttcctgtggtagggttgcaactagcttgcctggccataaataatgaaccttcttccctttgtggatggcattctatgttttaggagcagcccacacaagagaaccctaaggagaacaccctggtgtccaaaagccccagcagcagcagcgtagggggccggagggatgagttggaggagggagccccttcccaggccatgctgcgactcctgcaaagtgctttcagtaaaaactcaccgccaaagcaatcaccaaagaagtccccaagtgcaaagctcaacatcccttatgaaaacttctacgaagccctggaaaagctgaacaaaccttcccagcttaaagactctgaagacagtctgtataatgactatgttgatgttttttataacactaaaccttacaagcacagagacgaccggctgcttcaagctctggtggacattctgaatgaggaaaattaaaataagtgtgtggtcccaagttggaaatattcatgcttcttccttaccctgcgattttgcctgtgtctgaagtggttgttttgtcatgaattcttatgcttataatatcctttgtggcaccttttctttttctccctaaactgtacatgtgaaggggatgagctcaagcaggaagttcaacttccagaattgatcataggtatttcaaaacacatctttcctgtctgcacaagtgaagtgttttgttctttctggagtcacagttgacaaaaagctcttacactacattagaacactgcattagagcccatttcaattctcaaaagaaaaggcaaaacctgggatatcaattaatttgaaaacataatctgcaaagaatgagaaggagtcagaaactgtttctgtagcttgttccctgtcttgtccatgtggttcttcaaattttgatgccaagaaagtatttggtaggcctaatgaaggagttcactgtaagactcattccctagatctttctattccaaagtgccactcattcctgtagtcaaaatctggtcatgttggtcaaaagctggattatttagatctagaaacagatcttgaaatctgaatgctctggtttgagcaattttcgaacattctttgcctggtgcactgtgtctgtggtgccagaggcgtccgtggatccagaggtggttatgactcgtgctgcatgcctggtctttcctctgtttctccttctgaaagttttctatacctgtctcctttctcagccacaaaataaatgttgggagaaatgatatataccactttcccagaaaaaaaaaaacttacacttgggacttggcaaattcctagtcacaatttttttcagcagtaacaggaaaccacttatcacatggagacctaatgtaataatagaaaaatactcataatagggagaaaccaagagaagttttgtttttgtttttttccaactgtgttcattagaacagcgtgttctaagtatttgaaactgaatgtttattccttgatactaaaagttcttctccaatcctatcactgatagtgtccaaattctcaccaaattgctcctaagcttcaaatcagaagcagaaactggcaggccatggaccttaattgtccctcaggtagattttgtttggtatgcagaatgtttttaaaatatgagtggttattgaaaatatgatgtttcacataaaacctcattctcggacccatctttgctcatggcaacagttagctggagctgagtagcagctgcctgattagatgactctcagtccccatggcaccctgctccatgttacctagagcaggcacttgattccttgctgggcagtatccaataggcatttgattttgcccactcctacactaagcgaatgtgtacaaagtgtaaatgcattaggaaaaacaaactacccgcatcttctgttaggcaggatctgtacaataataattatgagtttgcttatgtaatctcacctcacctggatgatcactaatactaattcatttattactaaccttctggcttccttctctcaatatgcttacaaagtctccagtcacctacaatgctggctttctcccactgagtttgctgtttgcaatttttccatgaagtttgaacttcataaggtaattcatggcattgaactggttcatgaaaagaacactagagtctgtcatttgctttggcttgaagtatggttggtaacacaaattttcacctgctcttctaccatttgaatttgtgtagagggtgtttgcagagcaatgcccgtaatgcttagagaatgttctcctaaaagacttgcggaatcactctgtccttggaagtttcatatattgtttgatatgaagtgttagatagaatttccaatattggagcatatcaaaaagtattaaaactaaaaaggaccagagaattcttagattggcccggaaaggccaataaagagttagaatgaaaactcattacttttccattcccaatctagtgctagatgtataaatctttcttttgattcttcctaacaaaatattttctgggttaaaaccccagccaactcattgggttgtagccaaaggttcactctcaagaagctttaatatttaaataaaatcatattgaatgtttccaacctggagtataatattcagatataaaacagttttgtcagtctttcttagtgcctgtgtggatttttgtgaaaatgtcaaagagaaaacttatatactatttcccttgaaattttaaactatattttctttacaggtatttataatataccaatgcttttatcaaacagaattttaaagagcataataaattatattaaagaaccaaaagttttcctgagaataagaaagtttcacccaataaaatatttttgaaaggcatgttcctctgtcaatgaaaaaaagtacatgtatgtgttgtgatattaaaagtgacatttgtctaatagcctaatacaacatgtagctgagtttaacatgtgtggtcttggtattcttaagggaacttccacattatacatttgatgtattgaccagaatatgtaaaatatgcttataaatcagaaaaataaattgtttctcactaagtcaaaagaaaaaaagctcatgtttccaccacaaacaagatctccctcttttattgtgtttcccaaatggactatacaaaagaaaagctgacagtttacattaaggagttaattcctttttaggaaattgggctttcttggagtcaatttaagaatctacctgaacaaggtatgttttattttcctctctagcccatccttcactttcttgacaacatgcaaagctgtatgactgagccttaactgaaatgttgagaaatgaacaaactatctaaactaaactaaacagacttactacatgtaagagaaatgattcccaacatttcaccaaataggacttagtttacaggctagagtaaagcagctaagtgtgaaatccttcccagaggttctctcattagaaccctcaaagttccaactttttttttttcttttgctagagtctcactcttttgcccggactacagtgcaatggcatgatcatggctcactgcagcctccacatcccaggctcaaacgatcttcccacctcagcctcccttgtagctgggactacaggtgtgcaccgccacacccagctaatttttgtgttttttgtagggacaggtttcgtcatgttgcccaggctggtctcaaacttttgggctcaggtgatccacctgccccagcctcccaaagtgctgggattacaggcatcagctactgtgccaggccccaattcccaactttgatttctgaacttcaggcccacttctctctcttgcttcaaacttccattcctggaatttcgacccaccatctcagaatctgacctttctccccttgggaactggtttttccccagaatccattcatttctcctaagtcataatcattcagtaaaactagaatgatctttcagaaattccagaaggacttctttccatcaggattagttgaagatatatctctattttcatttcattgattaatcgattaattgattgattgtacatatttaaggtgtacaatgtgatattgtgatatataaatacatagtgaaaagatgattacagtcaagcaaattaacatatccattctctcagttaccttttttcttttgtggtaaaagcacctaaatgctaagaaaactctttaagcaaatttccagtatgtaatacatttttattaactatagtcctcatgctgtacatcacatctctagacttttatcctacataactacaacattatactatttgacctatatctccccatttccccccacctctcccaccccactgcaaaaaccattctactctacatttccatctatttgactttttaaaaattccacatataagtgacattatgcagcatttttctttctgtgtctggcttatttctcttagcataatatactctaggttcattcatttattgcaagtggcaagagctccttttaaaggctgaatttcatatgtgtgtgtgtatatatatgtatatatatatacagaaatagtttgtgtgtgtttgtgttgtacataaaacaatttccatagatggtctctactttcttttgaatgtccatctggtaactattggattaaccatgtacatgctgtgagtacaaacacaaatacatgcacgtgtacaaaggatacagattaattcttaaatacaagtttaaactcatgaggaggaagagaaatgccttccaactgccttgtaatttgcaaagctataacattcatataaatgattgtttgaattatccactctgttccctctgcccctgtggacagagtatactttcttggaccactgatgttgaccatgcaatctactttggccaatggaatattaatgaatgtgatgcaagcagaggcctcaaatgtgcttgcacagtttggcttggcccttgcttttcagtgacccagcgctgtgaggagagtgtgccccaggagctactgcc

SEQ ID NO: 843 - DNA, 64518 bp, Human
tgactgattttttgtatttttagtagagacggagtttctccctgtcagtcacgctggtctcgaactcccgacctcaggtgatctgcccgcctcagcctcccaaagtgctaggattacaggcgtgagccactgctcttggcctaatttttgtatttttagtagagatggggttttgccatgccgaccaggctggtctcaacctcctgacctcaagtgataagaccaccttggcctcctaaagtgctggaattacatgcgtaagccaccatgccaggccacctttgcaggtcttttcctgatcctgagggtctaggaatttttaacggtctgaataaacaatatttgcgaaaacatttgccatctattacctgtaagggtggtcatctatgagacttcctctacataataagaaccttggtcttcacaacctgttttttgtttgtttgtttgtttgtttgttttgagacagggtgtggctctcttgcccaagctggagttcaatggcacgaacttggctcactgcaacctctccctcctgggcttaagcaatccacccacctcagcctcccttgtagctgggattacaggcctccgccaccacatccggtacaggtatgtttggtacagacagggtctcaccatgttgcccacgctgctctccaactcctgacctcaagcaattcgcccacctcggcatcccaaagtgttgggattacaggtgtgagtcaccgtgctcgtgcccacaaccccttatcttcacccagacactctttttattgattccaggtctgtataactcaactcttttttttcttttttttgttttcttttttttttttttttgagacggagtcacagctctgtcgcccaggctgcagtgcaagtggcacgatctcggctcactgcaaccgcagcctcccgggttcacgctattcttccgcctcagcctccccaggagctgggactacaggcacgtgccaccttgcccagctaattttttgtatcttagtagagatgatgggttttcaccatgttggccaggctggtctcggactcctgaccgcaggcagtccgcccacctcagcctcccaaagtgctaggattacaggcgtgagccaccgcgcccaaccagaactcaactcttttaaccaattgccaatcagaaagtatctgaatccacctatgacctctaagtatttcaccctttgagttgtcctgcctttccacacggaaccaacctatgtcttacatgcattgactgatgtcttatgtctctctaaaatgtataaaaccaagcaagctgtaacccaagcaccttgggccaagttctcaggaccttttgagactgtgcctccctccatgcacactcatatttggctcagaataaccttctaaatactttagagtttgactcttctcgacaaggacaagagaagtggaataaacgaataaccgcagttttcctggtggtattggtcactgggttcaggttttggagtagtagccagtcaagcctggaatccccttcctcattcgctttagctttttgtccagtcttggtttgcaagagacttgcagcggcctagacggatggccgggattcacaaaggtcgcagacacgggaactgcttcttccccagcgtcgcctccacaccctcgcgtggatactgacatccgccccattccaggaatgcgcacagctaggcgcagccggccagcgtgggccgggggcggcggggccacctcccccacctccgcgcgcaaggcccgtcgcccttgacaacgcgatccaaggtcacggaggtcccacccccaggcccgaccgtccacgagacgggtagtaccccgccacgcgcccgagcaggcagctgcccggacagcccggcgcccgccgtgacgtcaccgccccgcgcccgaggaagccccgccccgcgcagccccgtcccgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggtgagggcgtcctggctggacgggcagcgggcgggccgggccacggagacggcagggacgtccctgtgctccggggagcgaggcgccggcacctgcttcacaggcgtgggaggtccggcgaggccaagcgcggcagacgcgtttactttcgctccgctcctcgccagctccagcttggctgccttttcctcggctggactcccctcgccacccgcccatgggagccctgaaggaggctgggtcttggggggtcgcggggtcgggcggagcggctgcggggtcgtccctcctggagcttcggtccagtcaggtagcgcacgtgcaggtggagccgctgcggagcgcggagtctttgcgggtgcatgttgcggggaatggactcactcggggtgatcgtgctagttccatggatcgtgctttacccctccccgcctcccagtagcgcactgagggttcatttgttaattcgttcattggacgcacatgtgagcgcccgctcagtgcccggcgccgtgcaggttctggggacgccacagtgaacaaaacctatagcagtcatccgggtccccagagcaggtggactcgatgtcgttgacgcagctgtgtcctcggggcctggaattgatggatgcgccaataaatgtttgtaaaacagagagaacgaccctaacctctgctttcccagtccccactcggaggtaacaacagtgaaagtttcggcattgcttcggggctgtacacagtgttatacgtgtaaatataaatgtctgcgtataagtattttttattctaaaaagcctaaaccatgtatgcattgtgctacgttgtacttcagaaaattttaacgctcccagcattctttccacatcttttcatgtcagtgtatacaggtccatgtgccttccagtgaccacacagtattctgtatgatggacgtgtcatttgtttaaacattgtcctattagtggacgcaataaaggttatttcaggttttactttttattacaatgctgcatagaatgggtgagtacttaaatatttgttcacgtgcggtatttctttagccttacataattagaattttagaattgatatttcagagcctatgcatttttgaaatgttagcagatactgccaaattgtccaaaaaggccttatcaatttatatcccctttagcaggcatcaagactgcctattccaaaggtattttcttcaacgctgaatcttatgtcttttcaaaaccagtggtctataaaagataccttgtggccgggcgcagtggctcacgcctgtaatcctagcactttgggagcctgaggtgggcagatcaggagttcaagaccagcctggccaacatggtgaaaccctgtctctactaaaaatacaaaaattagctgggtgtggtggcgcgcgcctgtaatcccagcttcttgggaggctgaggcaggagaatcgcttgaacccaggaggcagagattgcagtgagctgagattgcaccactgcactccagcctgggcgacagagtgagacttcatctcaacaacaaaaataataataattttccctcagaaagtgatgctgttgctctcttctagcaccagtgtctgatcaattatttatttatttttttgtctttatgaggtggggtttcactatgttggccaggctggtctccagtgcctgacctcaagtgatctgcctgccttgccctccaaaatgctgggattgcaggcgtgtgtcaccgtgcctggccaactgttctgttaatttggttctcgtttcttttgtagctgactcgggttttttcccccttggaggttaagattttttctctttgtcgtttgtggtctcgcgtccacaggtgtttgtgattcatgctttgtatcatgcactgtcccttccatttggaaaatatgtcagttttcagcccagggacattttaattctgtttctttatctctttttctttttctttttttttgagatggagtcttgctctgtcacccaggctggagtgcagtggcgcgatcttggctcactgcaagctccgcctcccgggttcaggccattctcctgcctcagcctcccgagtagctgggactttaggcgcccaccaccatgcctggctaattttttgtatttttagtagagacggggtttcaccctgttagccaggatggtctcgatctcctgacctcgtgatccgcccacttcggcctcccaaagtgctgggattacaagcgtgagccgctgtgcccagccctttatctctttttcttaaaaattgtctctctcctctcgtcctccatcttctggtgcggtggttcaagcattcctctgcctgagtctaagaaatggaacatgttcttggcagccttctgcgtggcaggtgcccttgtcattgtcacctgtgtggatgaatgggaaggtaaattgtttggattgattgaacgatgagagaatttagctaagaaaatacatgtcttgtgcaacaggggagaaagaatagtttaggcagatccacctatgtagaaaatccagacctcttgaaatttttttcttttcttgggaaagtatttccaggttgtagcatgtgcctggcttcaggtgtgcgtgtcttatgtctgtggaatcctctcgcccatgctacgctgcctcagtcacccatgagctcagccctcttaccctttcagacctcactgacccctgacactgccagccctgtcacttgccctcagaatatcttatttgattttttttgagccggagtcttgctctgttgcccaggctggagtgcagtggtgcaacctcagctcaccacaccctccgcctcctgggttcgagtgattctcctgacttcgcctcccacgtagctgggactacaggcgcatgccaccacacccagctaggttttgtatttttaatagagatggggtttcactatgctggccagggtggtctcgaactcctgacctcatgatccactagccttggcctcccaaaatgctgggattacaggcgtgagccactgcgcctggcctaccctcagaatatttctgtgaggggtgggctaggatatccgcttgtggactttatatttgtcatttttgcccataacagtttattcagcaaatacatttccaatgcccccgagtcttcaaagaaaatgtgaccctgctgtctggagtcataggtggctgctgagcagtgtaccagggccatcttggtggcctggacagcacattagagaaacaagagctgcttgccccagggtaagtttcacagatgaggagcgatttgggccgagtgtccaaggctgttttcactggaggggagggaggaacgttccatgtctggaaagctgcaggtgcaagggtaaggagatagctctgaataattggtttgatgaaagacttgcgggagtgtgcaggagtgatggtgaatgaggctagcagttgtgtcttttctgtcagatataagcttgtgcgtaggagcctcatcctgcattcctcaggacagtcacagagccagccctgggcctggtgtgtggggagcccagccacgtggcccaccatgagagcttttcgtcagagctccaactgtcagaagtgtcagatgtgccagtagaaggatgaggccgcctcctaaaggagagggaagacctggaaagatcaacagcagacgcagtctcccaaagcaaacgtgattctgtggtcaggcaggtacggtgacgggttggtcattttgcatgacgaggtgactgccacaatcaccaagggtgccgagtccagtctcctggtcatgccagatgctcttgttttcgtgaaattgccagaacatgactgaggcaaccacgataggactggttggtgcaggcgttaagatcttgggcctttttgttctctgtaagctggagcctttgctggaacttcctgtcttggaaatcagagttgtgagagtaggtcccctgccagcaccaggaaggtcgggagagctggtttcctcactttgctcagggctcaagtactagctagtttgtttcatcttccaaaaagagcctcacctggaccccgctcctgtaggtggtgcctgcctgctgcgccctccccttcagtacttcgttttgttgacgggttttgcctcctccctctgctctccctttgtttggagcctgtgctgtttgatttccgtgtcttgtgtgctgcacccttcaggagaattcaggtgaatttctggtgctctccggctgttcttttcagagtggaggggagtagtacttgctggtcagttgcgactctgtctgtgaaacagctctttgtgttgctgagatgacgctagaggtgtagcgtccatgacatgtttgtcgtctgattaagctgtggtgctggcacttagacggcagaggaaggtgtggcccagctgtccaaggccaccaggaggaccttcagcttagttaggaccaagggaactgagttatctgagtgcctgaaaaagaacacatcaggccgggcgcggtggctctcgtctgtaatcccagcactttgggaggccgaggtgggtggatcacttgagttcaggaatttgagaccaacctggccaacatggcgaaaccccgtctctactaaaaatacaaagaaattagccagggtggtggcaggcgcctgtaatcccagatacttgggaggctgaggcacgagaattgcttgaacctgggaggtggaggttggaggttgcagtgagccaagattgtgccactgcactccctcctgggcgacagtgcaagactctgtcttggaaacaaacacatcaatccgaatgtaagagattagcaaagcgtttattggttactgggtgagtagttggcctaagctaagacaaaagaggaatctccaagtattttgctaccccttggcaggaagagagggaatgcagcttgcggggtggggatgggggtgtcaggttgataagaaaactgtgggaaaataaacatttactcctgccccccatgtcagtaaataccatgtgacaaaggtgagttccatgaaagaggctgttactgaggcctgtgatacttgcttgtctcaaaatgctgacatatcttttttttttttttttttttttttttttttttttgagacagattctttctgtcgccaggctgaagtgcagtggcatgacctcagctcactgcaacttccgcctcctgaattcaggcagttctcctgcctcagcctcctgagtagctgggactacaggtgcatgccaccatggccagccaatttttgtatttttagtagagacgaggtttcaccgtgttgggcaagatggtctcaatcttttgaccttttgatctgcctgctttggcctcccaaagtgctgggattacagacatgagctaccacgtcgggcctgacaaagaatcttgatagcgattgaaaatgtatccattcatactcaaatgaagtaaaaagtgcttttgggttcaaagccagagaatgttcatggatggcgtttttggtgcctcaagtgtagccagctagaacttttcttaccaccgtcctgcttagtcctactgaagacctgccttctactaggaagctgctcttagtccacaaagtggcttccctgtagttccacagcatttaacaaaatagatttcagggagtttatttgtggtgtggctggttatttctgctaaaaccactaggaattaccataaaagctgtagcttggagaaacagtatctacttgcgggagtattactgccacctgtgttttttttgtttttgttttggtttttgttttttttttgtttttttcaagatggagtcttgctctgtttcccaggctggagtgcagtggcacgaactcggctcactgcaatctccacctcccgggttcaagcagttctcctgcctcagcctcccaagtagctggggctacaggcatgcactaccgtgcccggctaatttttgtatttttagttgaggtagagtttcaccatgttggccaggctggtcttgaacttctgaccttgtgatctgcctgcctcggcctcccaaagtgctgggattacaggtgtgcgccaccgttcccagccctgccattggctttttaaccaggtgaattcctgtagattgggtagattgaaaggacatgtagctgaatcattggttttaaaaggaatggctcagttacttcatagccatataattaagaaatgtggctagaaggtaaaaaattggccaggcctggtagctcatgcttgtaatcccagcactttgggggctgcggcgggaggatcctgtgagtttaggagtttgagaccagcctgggcaacctagagagacccccatctctaccaaaaaacccttttttttttttttccaattagctgggtgtgcctgtggtcccagctacccaagaggctgaagtgggaggctcccttaagccttgagaagtcgaggctgcagtgagctgtgatcacgccactgcactacagtctgggtgacagagtgacagtgtctcaaaaaaaaatatatatatatatatatatatatacacacacacatataaaagaaattaattttgagatagctaaattaaatgccatattaagagcaggaggctattcagcaatgctgctgagaagaagacagaaggacgtgggtccttctaatgtaactatgtgtgtcgggttagtgatatgcacctcgaaggagaaattaagacagcacattgccatgttagttcacacttgccagtatttcagcatttgtcaggcaatggaatgttcaagcgaattttccacgaggctgactttaaaacatttcattttaaccattatgatgagaagtctttctagaacactccatcatttgatggcccatgactgaacctctcttggatgttttcagggtcattattacgggtgttaatgtttggtcttctgttttaatatgtaggctcccgtagggccattgaaatgtgaagaatccttcgtctatgaagtgtccccacatcaaaactgcattgtgagtgtttatatttttggcctctcttactgtggccttaacttgcaggtctgtctggagccctgttctctcctttcctagtttgcagatgtggctgggaaacttgttagcatcaaattgttagaatgagatggatttcatatggggccagtagtcttccatgagcaaagctcagggtgagggcttcaggcccatattttgactattccgaggtgccctttcgctttttgttctttttctttatgttcaaggagttatgtttcctgatgaatgaagtatcagtatatcatagtagagaacgattagaccaggttctggaacacaggaaacctcaagaaacagtgagtgttgagaatgccagagctaagaactcagacatttgtgagggaatacaggtctttctgttcagaatgttcatgtacttaagaatcttctcgccaggcgcggtggctcacgcctgtaatcccagcactttggcaggctgaggcgggtggatcacctgaggttaggagtttgagaccagcctgaccaacatggagaaaccctgtctctacgaaaaatacaaaactagccgggcgtggtggcgcatgcctgtaatcccagctacttaggaggctgaggcaggagaatcgcttgaatctgggaggtggaggttgtggtgtgccgagatggcgccactgcactccagcctggcaacaagagcgaaaactccgtctcacacacacacacaaaaaaaagggaaacaaaggtaaactgggaaggaaccgtgtgtaatcttccgtaccttgcattttccacttatattctggggtttgtttcctgtcgccacagagctctggtattccatagcgaggatgttttgtaatttatgtaaccctctcatggcggacatttaggttgttgctgagtttccccaagataacagacggcattgccaacagtttctcacaccttcaccagtgctagaatgacagtatttaaaacatctgtcaatctggtagtgaaaatgctatctcgttttaaagtgcatttccttagttatgagtgtggtaaaacatcttttactaggacgtaaagccattgatgtttcttgtttttgtgaatggccatttttctcttgaaccaatggcctttttcttttttttttttttttttttgagatggagttttgcacttggtgcccaggctggagtgcagtggcgtgatcttggctcaccgtaacctctgcgctagcccttttaaataacttttaaaaattgagacagtgtcgggccaggcacggtggctcacgcctgtaatcccagcactgtgggaggccgaggcgggcggatcatgaggtcaggagatcgagaccatcctggctaacacggtgaaaccccatctctactaaaaatacaaaaaattatctgggcatggtggcgggcgcctgtagtcccagctacttgggaagctgaggcaggagaatgccgtgaacccaggaagcggagcttgcagtgagccgcgatcgcaccactgcactccagcctcggcaacagagcaaaactccatctcaaaaaaaaaaaaaaaattgagacagagtctgactctgttgcccaggctggagtgcagtggcgccatctcaccttactgtaacctccgcctcccgaggttaagcagtcctctcgcctcagcctcacaagtagccgggattacaggcacgcgccaccatgcccggctcatttatttttatttatttatttatttattttgagatggagtctcgctccgtcgcccaggctggagtgcagtggtacaatcttggctcactgcaacctccgtctcccaggttgaagcatttctcctgcctcagcctccctagtagctgggactacaggcacccgtcaccacgcccggctaatttttgtatttttagtagagatggaatttcaccatgttgatcaggctggtcttgaactcctgacctcatgatccatccgcctcagcctcccaaagtgttggcattacaggtgtgagccactgctcctggctttctggctaatttttgtttttttttgtatttttagtagagacagggttttgccatgttggccaggctagtctcaaactcttgacctcgggatctgcccgcccccacctcccaaagtgctgtgattacaggcgtgagccacggcactaaattttattttagaggcagggtcttgctttgtcatccgggctggagtgcagttgtgcgatcctggctcgctgcaggcctgacctcctggactcaagtgatactcctgcctcatcctcccaagtggctgtgacctcttcctcccaaggagcatgtgccaccatgcctggctaattaaaaaacattttttttagagatggggtcccactatattgccccggcttgtcttgaactcctggtctcaagtgatcctcctacttctgcctgccaaagtactgggattacacgcaggagccgtcgtgcctggcccccagtttttttcttaatgtgtttgtcttttttttttttttttttgagttagagtctcgctctgtctgttgcccaggctggagtgcagtggcacgatcttggctcactgcagccttcgcttcccgagtgcaagcaagtctcctgcctcagcctctggagtagctgggattacagatgcccgctgcgactcccagctaatttttgtatttttggtagagacggggtttcaccatgttggccaggctggtctcgaactcctgacctcaggcgatccacccacctcagcctcccaaagtgctgggattacaggcatgagccacctcacccgggtgtttgtcttttgacttaaatttttatgtggtccttatatttatggccttttgggttatatattttgtttagaaacatttcctcttaaggccgggcgcggtggctcacgcttgtaatcctagcactttgggaggctgaggcaggtggatcacgagttcaggagtttgagaccatcctggccaacatggtgaaaccccgtctctactaaaaatacaaaacattagccgggtgtggtggtgggcgcctgtagtcccagctacttgggaggctgaggcaggagaatggtgtgaacccgggaggcggagcttgcagtgagccgagatcccgccactgcactccagcctgggcgacagagcgagactccgcctcaaaaaaaaaaaaaaaaaaagatttcctcttaaatcattttttttaaaaactcaagatgcctggcagtttaggaactgcaaagcaaaactacagtgagttagcacttcctactcactagggtggctataattaaaaattaaagaaacaacaacaaaaaaacaggtgatacaaaatggataactaggatgtggaaaaatcagaaccctcccacactgctggtgagaatgtaaaacggtgcgacctctgcaggaaaacattcttgcagctcctcacacagtcaaaccgaattaccatatgaccccacagttctaccctgaggcacataccttgtagacatgaaaacatgtccacagaacagcctacacatgaatgttcatagcagcattattcataataacccgaaaatgaaaacaatctgaaggtccatcagaaggtggaaacgaggctgggtgcggttggtcatgcctgtaattgcagcacttcaggaggccaaggcaggaggattgcttgaggccaagagttgaatgccagcctggacaacatagtgagactccatctcgaaaaaaaatttttaaaaattgctgggtgtggtggcacatgcctgtggtcccagccatttgggaggctgaggtgggagaattgctcgagcccaggagtttgaggctacattgagctgtgattgtgccactgcacttcagcctggtcaaagagcaagaacctatctcaaaaaaaaaaaaaaaaaaaaaagagtgcaaataggccaggagtggtggtgcgcccttctaatcccacctgcttgggaggctgaggtgggaggatcgcttaagcctgccagttggaggctaccatgcaccatgacagtgcctgtaaacagccactgcactccaggcaacatagtgagacccccaccccaccccaaaacaaaagttacagtaaaaagttggaagctgggcctggtgcagtggctcatgtctacaatctcagcacttcgggaggctaacgtgggtggattacttgaggtcaggagtttgagactagcctggccaacatggcaaaacccgtctctactaaaaatacaaaaattaactgggcgtggtggcgggtgcctcagcaggagaatcacttgaccctgggaattggaggttgcagtgagcggagattacaccactgcagagtgagactccgtctcaaaaaaaaaaaaagaaaaaaagggccgggactggtggctcacgcctgtaatcccagcactttgggaggccgaggtgggccgatcacctgaggtcaggagtttgagaccagcctgaccaacatggagaaaccccgtctctactaaaaaaaaatatatatatatataaaattagccgggtgtggtggcacatgcctgtaatctcagctactcgggaggctgaggcaggagaatcacttgaacccgggaggcagaggttgcagtgagccaagatcatgtcattgcactccagcctggcaacgagagtgaaactctgtctcacaaaaaatttggaagcaacccagttgcccatcatttgatgaatggaaaaaaataatctatacagcggagtgctcttcagttataaaaaggaatgaggtgctgatacatgctatatgtggatgaaccccaaagactttatgctaagtcaaagaagccagacaaaaaaccatatattgtatgatttcatttctgtgaagtgcccagaaaaggcaaatccatagagacagacatagatgagtagttgccaagagctggtgggagagggaaaagagagtgaacatgagtggctgtagggcttcttttggggtgataaaaatgttctgtagttgtccgggcatggtggctcatgcctgtaatcccagcactttgggaggccgatgcgggcggatcacgaggtcaggagatcgagaccatcctggctaacatggtgaaaccctgtgtctactaaaaaaaaaatacaaaaaattagccgggtgtggtggcgggcgcctgtagtcccagctactcgggacgctgaggcaggagaatggcatgaacccaggacgcagagcttacagtgagcccagatggctccactgcactccagcctgggcgacagagcgagactccgtctcaaaaaaaaaaatgttctgtggttagtggtcgtggctgtacaactttgtgaatatactaaaaccactgaattgtgcacttgggtgaattatatggcagatgtgttacatctcaataaagttactaaatctttcatgttttctttcagtacttttagcttttatttttacttctatggtccatctggaattcattttgacttaataagtgacagcggaaattaaaaaaaaaaaaataagaggttggtcttgctatgttgcccaggctggtctagaactcctggcctcaagtgttcctcccaacttggccttccaaagcactggggttacaaacatgagcccctgtgccctgctggaaattaatttaacctttttttgtgtgtgtttactttttgagagttgggggggtctccctatgttacctaggctggcctcgagctcctgagctcgagggagcctcctcctgcctggatctccctcccaaagtgctgggattacaggtgtgagcagccatgcctggtctggaaatttattttaatattgtagctttatattaatgttctttaatatttgatgaatttcctcagttttttcaaaatttctttggctatttatgtacactaacttttccacatgaattttagaatgagaatagtttaaaaatgtgtttgaaattttgtaaatgtgtttatgtttctcgtaagtttttaagtgttttttataatgcaacgttttgtttgttttgagacagagtcgtgctgtcgcctaggctcgagtgcagagatgcaatttcagctcactgaacctctgcctcccaggttcaagcgattctagtgcgttggtctcgcgagtagctaagattacaggtgtgcatccccatgcccagctaatttttgtatttttagtagagacgggttttcaccattttggccaggctgttctcaaacccctgacctcagctgatctgcctaccttggcttctcaaagtgctgggattacaggcgtgaggcacctcacctggcctgtaatgtaacttttgtaaatagttttgttttttgatttttttttttgagacggggtctcgctctgtcgcccaggctggagtgcagtggcgcgatctcggctcactgcacgctccgcctcccgcgttcactccattctcctgcctcagcctcccgagtagctgggaccacaggcacccgccaccacgcccggctaattttttgtattttcaatagagactggctttcaccgtgttagccaggatgatcttgatctcctgacctcgtgatctgcccgcctcggcctcccaaagtgctgggattacaggcgtaagccaccgcgcccagcctaacttttgtaaatagttttataagtagggtatttattttgtagattattgatatatgtagtccaatatgcaaacgatacagaggtatatctgatgaaaaactcgtctcccactgacatgcctcagacaacacccctcctggtggcaagtccattagccagtttttgggtgtccttgcagagatctgcgtggcatatgagaatagctatgcatgcatgtatcacataacatgtatatgcatttgaacaccatggtagtgtgtgcaaaccgctgttctacctctagtgttttttctttgtgttagaggtaattcagcatcagcacacattacacagcattgtcccatttctctataatcccatgctttccaagtgttaccttacgtctgtagtttacttgttagtcctccgcttgtgagtatgtagcatatgtaacagtcttaagtgggttatttaatgacagtctttggccctagtagtgtttcagagttttcttaaaagatcttgccaaaaaagaaaaaaaaggaaagattttgctttcttggtaaatgcattcttaattgtttagtttttgttcctggggtctcttatgtcatattttctaactagttttctgtatataggacgtccgggtgttgatttttgtattctaccatcttactgaatgctttttttttttttttttttttttcaagacggagtttcactcttgttctccaggctggagtgcaatggcagcatcttggcttaccacaacctccacctcctgggttcaagcgattctcctacctcggcctcccaagtagctgggattacaggcatccacgacaacacctggctaattttgtatttttagtagagatggagtttctccatgttggtcaggctggtctcaaactcccaacctcaggtgatccgcctaccacagcctcccaaagtgccaggattacaggtgtgagccaccgcacccagctttttaaatttctcttaaagacagggtctcactttgtcacccaggctagagtgcagtggtgtgatctcggctcactgcagcctttaccctctggtctcaagtgatccttccgcctcaagtaccccaagtagctggaactacaggtgcgtgtcaccatgtccacctaagtttttgtatttttggtagggacggggtttcaccagtttgcccatgctggtctcaaactcctgggctcaagcgatctgcctgcctcagcctcctagagtgctgggattacaggtgtgagccactgccctaggccttattctttaaaatgatctgcctcttgaaaaatgaaagtcttttctcaaaaaacttcttcccaggtctgtgaagcagcacagtggccccttctggctctcaccttgtacctcgtccttgtttgcctcgagcataggaccttgtctgtgtttgtgcctcaggccccctccctctgtgtttgctgggtccacttagtctagtcattgggccttggctcctaagaggcccctagactgaattcctcatccgatgtgtccataccagctttcaagtgacctcaacatcgacagcagggaaaacattagcacttttgtgacagcctcatattttcccccgcccgagatggagtctcactgtgtcgcccaggctgggattacaggtgcacgccaccacacccagctaatttttgtatttttagtagagacagggttcaccatgttggccacgctggtctcgaactcctgactttgtgatccacctgccttggcctcccaaagtgctgggataacaggtgtgagccaccgtgccgggcagcctcatatttttaataatttaatatctgttttgaataaataaatatggtttgattaaccaaaaccatgtgaacaggtaaagcttgagaagtcttgctgctgttcagagcacctgctgtcttcataaccactattagttgcctgtgggtcctgccactacttacttgtatgactgtagtaagtgcagatgtacatattccctcagggacgcacccttctctgtgttctgttactcactacatagctcgtggagagcttgctgtgttcatatatagtttggtgctccttcgctttctgtagccactgtgaaatgccgttcatatcttttgccccaggtttttcttctggactgtctggctattttttttttttttttttgggacagggtcttactctgtcacccagactggagtgcaggggcgcgatctcagctcactgcaacctctgcctcgggttcaagcgattctcctgtttcagcctcccaaagtgctgggattacaggcgtgagctactgtgcccggcttctgttttattttttggtttgattctgtcagttattgagagaggagtgttaagatctccagctgtgattgtggaattgttttgtctttaattctttccgttttaacttcatatatgttgaagctctgttattaggcaaatacacacttgtgattacattttcctgatgaattgtttgttgtagtattctgaaatatccttcttttttcctaataatattttttattttgaaatgtattttacttgatattaatagagccactccagctttcttaaacacactttttggatggtatgtatttttccattcatttgtcttaagtgtatctttttctttatgtttaaagtgtcttgtagatagcatgtaattaggtcttcctttaccaattctgacaatccttgccttataattagagttcagtctgttaatgtaagagtaaatatcgatgtggctggatttattgctaccattttattatttgccttttatttgtccttttggattttttccctgtttttcctttccttatcaatgaaatgtatttgagatttccattgtggtttatctaatgctttttaaagctattcttctttgaattattattttagtggttactctggtgtttgaaatatgcacccttggccaggtgcggtggctcacttctgtaatcccaccactttgggaggctgaggcaggaggatcccttgagccccagagtttgagaccagcctgggcaacatggagaaaccccatctctactaaaaatataaaaattagcctggcgtggtgatgtgcatctgtagtcccagctactcgggcggctgaggcccgagaatggcttgaactgggaggcggagtttgcagtgagccgagattgtgccagtgcactccagcctgggcaacagagtgagactgcatctcaaacaaacaaacaaaaaagtctgggcgtggtggctcacacctgtaatcctagcactttgggaggccgatgtgggcggatcacctgaggtcaggagttagagagcagcctgaccaacatggagaaaccccgtctctacaaaaaatgcaaaattagccaggcgtggtggcacatgcctgtaatctcagctactcgggaggctgaggcaggagaatcgcttgaacccgggaggaggaggatggggtgagctgagatcgcgccattgcactccagcctgggcaacaagagggaaactccatctcaaaaaaaaaagtttgtaaagagtagcttttgtgatagatactttggcataccaagaaatatggatgttcctgtcttcaaagagtgttactgagaaatacaagctttttcctgccctaatttggtgagataaattatacattaaccaaaaaattaacagtgggaaatgtcatatgctggcatatagcagcagtttcaaatgagcagcacaggctgggcgtggtggctcagacctgtaatcccagcagctttgggaggctaaggtaggaagattgcttgagaccaggagcttaagaccagcctggtcaacatggaaacaccctatctctaggaaaaaaaaaaaaaaaagaatttagtcctgtgtgatggtgcttacctgcagtcccagctgttcaggagagtaaagcaggaaggtcccttgagcccaggagttcaagactgcagtgagccatgactgtaccactgcactccagcctgggtgacagagcaatctcttttctaagaaagaaagaaatagtaaatacatgaataaatctttttttttttttttttttttgagacggagtttcactcttgtcacccaggctgctggagtgcaatggcacaatctcggctcaccgcaacctctgcctcgtgggttcaagtgattctcctgcctcagcctcccgagtagcggggattacaggcacccagtgctaattttgtatttttagtagagatggggtttcaccctgttggtcacgctggtcttgaactcctgacctcaggtgatccacccgcctcggcctcccaaagtgctgggattatggtgtgagccactgcgcctggccagtataaaatttttttaaatgggcagcataaaaagttaagtgcagtgaactcataggaagagattattgtgaactgctggggccagggaggcctgaatgggagagagggcctgcagccaggccctgcagcaactcggatgggaaggagtcccagctactgagactgcagctgcagagtggaggagctgcatgggcactggcagtagtgggtagggatgtggggggtggaaggggaggggtgtgtggtgtcacattcaaactatcagtgcttcccattttgtgcgaccccaaaccaccagatagtttaacagtaagatcttgtagcctgacattgaggtttgtggtttttcctttagggtgtaggagaaacacaaagacggaaattgtacagctagcgtgtttggtatctggttcaggcagatttattcctctaatggtttattttttttttaatttttaattttttttttgagacagggcctggctgcatctcccaccctgaaatgcagtggcgtgatcttggctcactgcaacctctgccttgcaggctcaagtgatcctcccaagtagctgagactacaggcatgcaccaccacacctggctgtttttttgtagagatggggttttgccatgttacccaggctaatttcaaactcctgagctgaagcgaccccccggccttggcctcccaaagtgctgggattacaggcatgagccactgcacctgagttagtgattaaaagttgttgtagaagccgggcgcggtggctcacgcctgtaatcccagcactttgggaggctgaggcgggcagatcacgaggtcaggagatcaagaccatcctggctaacacggtgaaaccccatctctactaaaaatacaaaaaattagccgggcatggtggcgggcgcctgtagtcttgggaggctgaggcaggagaatggcatgaatccgggaggcggagcttgcagtgagccgagatggcgccctgcactgcagcctgggcaacagagtgagactctaaaaaaaaaaaaaaaagttgttgtggaaagtttacataacctgaaatcaaatctgcttttaagaatgctgtcaattcaattaatgtaatcttggcgttatgatactaagtcttgcaattctggctggaaatatagatttcttatttttttctttttcccaattgtgaggacttctatatactcctcccataatgaatattatattaaatcctttcaaaaatataggctgggtgtagtggtttgtgcctgtaatcccagcactttgggagactgaggcagacggatcacgaggtcaggagttcgagaccatcctggccaacatggtgaaaccctgtctctacttaaaaaagaaaaacaaaaaaacaaaaaaacacaaaagttagccgggcatggtggtgcacacctgcaatcccagctacttgggaggctgaggcaggagaattgcttgaacctgggaggcagaggttgcagtgagccgagatcacgccatttcactccagctctgggcaacagagcaagaccttctcgaggaaaaaaaaaaaaaattctgcatattaattggggaaaaaccaaaaagactagaaaaatgaaacatggggaaatcatgtttaatcttagagtgaggaaggcttttacaaccaaaagactaatttccttttttttttttttttgagacagagtcttgctctgttgcccagggtggagtgcagtggcgccatctcagctcgctgcaaactccgtctcccgggttcatgccattctcctgcctcagcctcccaagtagctgggactacaggcgcccaccactacgcctggctaattttttgtatttttagtagagacggggtttcaccgtgttagccaggatggtctcaatctcctgacctcgtgatcctcccgcctcggcctcccaaagtgctgggattacaggtgtgagccaccgctcctggcgactaatttccttaatatataaaaagctcttacaaatcaataagaagaagatttaaaatgtagtagaaaaattatcagaggataccaacagtcccttaacaaaaaaggaaataggaaatatttaaaaatacgggacagtgctcagttttgcttataataagagaaatgtaagtgaaaactacagtgaaaattttatctgaccaataggcaaagatccaagagtttcatctcaacactgacttggcaggaatgtaggatgatatgcactttagtacattgctgtgggaacgtaaactgataggatctctgtggagtgtgacttggcagtatctaccactgcttaaaatacataaccttaggctgggcgtggtgtcttacggctctaatcccagcgcttgggaggcagaggccgggggatcacttgagctcaggagtttgagaccagcctgggcaacatggtgaatccctgtctctacagaaaacacaaaaattagccgggtatggtggcatgagcctgtagtctcagctactcggaaggttgaggtgggaggatcacttgaatccggagggttgaggctgctgtgagccaagatcactctactgcacttcagcctgggcgacagagtgagacccagtcaaaaaaaaaaagaaaaaaaaaattagctaggagtggtaatacacggcctatagtcccagctactcaggaggctgaggtgggaggatcacctgagcccgggaaggtcgaggctgcagtgagctgtgattgtgccattgtgatccagcctgggcaacagagtgagaccctgtctcaaaatagtagtaacttacaccagccagttattgctgtggtgtttcctgatggtgtgctttctgttttctgccattccttgtgtttattcattggaattctgctgtgatgaagagctgctgctcctcctctgtttaagtgtgcaccgatgtttgcttgatttgccgggtcacagcttacaatccattattgtcgttcgttattttgccgcacagattgtcctagattctgccactgggagcccttctggctgggctgtgtgttctcctgacacaccccgtcctttctcgtccttctgcacaccactgggtgtcctaggctcctctgtgtgctccgcagggatctctggttcctgtttttggagagaggtattcacaaaccaagatctggctgccaggtagggtgaccagccgtcctagtttgccaggacaaaggctttccctgggacgtgggactttagagtgctgaaactggaacagcttttggactttgctctctgtagcctaagtggggggtcatcgcgcctgggccctgtcacgcgtcagtggacagagctgggaaatgtgtgtgtgtaaatgttccggtattgatttctgcatccagtctgtacacatggcaaaggttgtgagcctgtactgatgcctgtacctccagtgccgccccgcagggtttattcctgccccttccttatcagtgacttttcttcaactgtgaggaccccaactcagtagccacaatcagcttttccgcttgatcttggcacatgcgtaaatcgggctcagacctgctgactccgcaggggacacatctcctgcccgagcctggtgatggtgtgctgtcctctgaggttagttttacagtaacagtcaaagtgctattttctgaagtctcttaggttagttcttctttcagagtggtgatgtcatcgtcacagctctgcatatttgctgtttgtatttcattttgtgttcatgtgcgccctgttttgttttcacggtttctttttctttttctttttcttttctttttttttttttttcgagacagagtctcactctgtcgccaagtctggagtacagtggtgcgacctcggctcactgcaacctccacctcctgtgttcgagcagtccttccacctcggcctcccgagtagctgataactagaagtgcgccaccacgtctggctaagtaatggtttgttttttgagtatgagaaacctgaccatggttctaagagagacatacgaaaagatgtatgtggaagtgtcatgttccctcagctctgccagccctctccccttcccgctttctttgcattctctgtacatatgctggttgggggttgaattgtgtctccccacgaaagatgttgaagtcccagctctcagtacctgtgaatgtgaccatatttggaaatagggtctttgcaggtgatcaagttaagatgagttcacttgggtgggccctaatccagtatgactgtgtccttataaaatggggacatttgaacagacagacatgtgtagagggagaagggcagacgtcctgaagggaagacacagggagaagatgaccacccacaagccaagcaacgccagaggctgcagaggctggaagaggcgcaaacagaccctccctcccagcctcaggaggaaccagccctagtggcaccttgatcttggacttcttgcttccaggactgtgagagaataagtgtctgttactgtaagctaccgggtttgtgccacggggagtttaatacacacctcctgtaggtaaccaagctgtggggtttgaaggccgggtacagtggctcatacctgtcatcctagtgctttaagaggccaaagtgggagggttacttgagtccaggagttcaagaccaggctgggcaacaaagagaaaccttgtctctatttttattcttttttaaaaagaggccaggtatggtggctcacgtctgtaatcccagcactttgggaggccaaggtgggcagatcacttgaggtcaggagttggagaccagcctggccaacatggtgaaaccatgtctcttttaaaaataaaagccaggcatggtggtgcgtgcctgtaatcccagctactagggaggctgaggcaggacaatcgcctgaacccaggaggcagaggttgcagtgagctgagatcatgcccctgcactccagcctggatgacagagcgagactctgtctcaaaaaaaaaagagaaagatacgttcgcgtcctcatccctggtacttgtgagtgtgagcttatttgggtcatttcagatgtatcaggttgtgatgaggtcacactgcatgggggtggggcctaactccagtattcctggtatccgtataagaagagggaaatctggacacagccaggactcacatagagaagagcttgccatgtgacaagagacagagcctggagggtctgcaaagcatgaaacaccaaggatgccggctactgccagaagctggggagaggtgcgggatggactctccctcggcacctccagtgggaagcacccctgcccagaacctgggacctttttttttttttttgagacagagtctcgctgtctcacccagcctgaagtgcagaagtgcggtagtgtgatcttggctcactacagcctcaacatcctgggctcaagtgatcttcccacctcagcctcacaagtagctgggactacaggtgcacaccactacacctgcctagtttttgtgttttttgcagagatggagtctcactttcttgcccaggctggtcttaaacccctgggctcaagcgattctcctgccttggcctcccaaagtgctgggattacaggtgtgaggttgtgtgcctggctcagaactgtggacctttttgaaactgcctagtttgtggtgctgtgtttcagtagtcctaggaaacaaaatacacagtcacatcagtttctggtttatcctttttgtgtttcttttacacaaatggtgagaaacactgatatgctctgtgggcaggtgttggcacttggacacttccctcctgtgcccccagggctggctgtgctttggaaggaggcacagagacttcagcaccctggtttgatgtagactgttcgcgaactcctctaatgccaaataccatttaattccagaagaaatgtcccgggattttttttttttttttaactgtacgaataaagtgaacaatgcaattacatgggcccaaataactggatgtttacatggtttggaatttgaatactttctgaattgtggtagatgtttttaaggtatctgcatagagataaagacaggctagggttggccgggcatggtggctcacgcctgtaatcccagcactttgggaggcctaggtgggtggatcacctgaggtcaatagttcgagagcagcctgaccaataaggtgaaacctcgtctctactaaaaatacaaaaattaggcatggtggctggtgcctgtagtcccagctactttggaggctgagacaggagaatcgcttgaacccggaagatggaggttgcagtgagccgagatcactgcactccagcctgggcgacagagcgagactccatctcaaaaaaaaacaaaaacaaaaggccaggtttgtgctgtttgtaagtccaggaataagcctaaagaataggcaagttttggctgggcacggtggctcatgcctgtaatcctagcactttgggaggctgaggtgggcagatcgcctgaggtcaagagttcgagaccagcctggccaacatggtgaaaccctgtctctactaaaactacaaaaattagctgggtgtggtggcaggcgcctgtaaacccagctactcgggaggctgaggcaggagaatcgcttgaacccgggaggtggaggttgcaatgagccgagattgcaccattgcactgcagcctgggcaacaagagtgagacttcatctcaaaaaaaaaaaaaaaaaaaaggcaagtttttgtaccttttaggagtatgaaagttgatatgttaatttttttttttttttgagacagaatgttgctctgtcacccagcctgtagtgcagcggcacgatctcggctcactgcaacctccacttcccaagttcaagccattcccctgcctcagtctcccgagtagctgggattacaggtgcctgccaccatgcccggctaacttttgtatttttagtacagatggggtttctccatgttggccaggctggtctcgaactcctgacctcatgtgatccgcctacctcagcctcccaaagtgctgggtttacgggcgtgagccaccgcacccctggctgatatgctgatttttaaaaccttgattcctggatattctgttgtctttcctttctacttgttacaaatttgtgaagaacaggagaggctcccagttagatgcggttcatttaggcttagactttgacacggcgtggctggctggccacatatccttgacaccatcacgtattgcaaatctactgaccaaggcagggtcctggtatgtggtccctggggtcagtgggtgttggtgttgggtcggtccagtcctgtgttggagtgaaagtgtctggtttctgggcctgcgtcggtgaactgcgtgcggctggggacacattggctgctttcctccctcgctgggctctgccggcaactttctcagcccactggactgagcaggaagttacagaagacaagtctccttcttagttagaaggtagaacccatcgtcagctgtttttcagtttttaaagtacacaaattttttttaaaaaatctgttttggatgaaaaagcaatgggaaagaatcaacttttagaagatgagacagtttcagaatattaacatttaaatatttggatcccttttgggaggattttttttttgcttgactgtcaagagcaaagaagtgtggcccatcgggggcttctgcaggggctgcgagggtcgagacaggtttcagtttggtaggttgatgcgaggtgtcacccgtgaggcgaatgtgggaagtgctgtcagcaggcatctgccagctgggcatggtggctcacgcctgtcatcccagctctttgtaaggccaaggcgggaagatggtttcagcccaggagttcgagaccagtcttggcaacatagcaaaaccccatttctacaaaaaattttttaaaaaattatgggggcatggtggtctgtgcctgtggtcccagctactcgtgaggcggaggcaggagcattgcctgagtccaggaggttggggctgcagtgagctgtgatcgcagtgacagagcgagaccccctctgaaaagaaggcagcagcccaccccctccagtttcgcttctgcggttctgagaagacacagtatcttacactgatgacatctgtgagggctccttgccaaaaccacaccctgacactgtggcatttggtcctgtggatttctctttcagcaacagcccgacttagagatgtccacgctagcttctgctagacacccttgatgggacgaattaccatattgtttctcgtgtcttcctaattctcattctttctgcatatttgtcttttcaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggtagccttggctcgtgctttggtctgggagggctttttggttcactgctgtgcgtaaaggggcattttcagggtggaggcagtgattggtagagccaccgccttaggtgtgaaatcagaaggtcttggctgtagggagtgctgcgccctccatttctgtcccagcgagggacttctgccagtgtcgggtgtgtcttgccccctctggtggccacccgtgagtttgccgtccggcacctcccctgagtggtgattcatggcacatctgctaataatcatggaagcgggaggggaaactcagcattggcccagtctgcgcaggaccgaattctggagctgtcttttcattccctctgaagtataaaaaagcagtctttggagccagtcctgaagtggctccatttctggcttttaagtgggtcgacaagagtagaatctttgaagttaaaaagagaagtgaggttttcttgttattttgatttctaactaattaatttggaaaccgcttttttgaagaatatagtccaggcacagtggctcacacttgtaatcccagcactttgggaggccgaggcaggaggattgcttgaggccaagtggtcgagaccaacctgggcaagatagaccctttctctacagaaaaaaattaaaaagttagccaggcatggtagcacacaccagtggttccaggtacttgagaggctgaggcaggagaatcggttgagcccaggaagttgaggctgcagtgagcacgatcctgccactgcatagcagcctgggcaacagagccagatcctgcctctaaaaaaaaaagaaagaacatataatctggttcttagaggcagtccagttctcgtaaccatgcacattgggaaaccaggctcagcattccctcgacatagcccgaggcatgtctggcctcagcagtgggaggatttgtcctgccctgagacctcctttctgagagactttttgttttgttttgttttgagacagggtctttctctgtcacccaggccgagtgctgtagtgcaatcatggctcactgaagcctcgacctccctggctcaagtgatcctcccacctcagccccctgagtcactgggaccacaagtgtgtgccaccaccgtcagctactttgtgtattttttgtagagatggcgggatccctctgtgttgcccaggctggtcttgagctcctgggcttaagtgattctcctgccttggcctcccaaagtgctgggattacaggcatgagccatggtgcccagccagactttgtttctgtctgcttctttctttttgttcatgatcttaaatgtgtgggaggccgaggcgggccaatcatgaggtcaggagatcgaggctatcctggctaacatggtaaaaccccgtctctactaaaactacaaaaaattagccgggcgtggtggcaggcacctgtagtcccagctactcgggaggctgaggcaagagaatggcgtgaacccgggaggcagagcttgcagtgagccgagatcgtgccactgtactccagcctgggtgacagagcgagactccgtctcaaaaaaaaaaaaaaaaaaaagtttaaaactcataaacttaagctttctttggaatgtgacgtagcgtattcttgcacaaaaatagaagttaaactttgttggttgtgtctgtgtttcattactaggttccacttccaaacatgagttccaggccgagacaaagaagcttttggacattgttgcccggtccctgtactcagaaaaagaggtgcgttccctgctaaccatgcccgatgctagcaaagtttcttttcacaaagctggtttttatgccattctggagaattgccagataatatattcgctgtgagaaagcattaaactttggacaggtcctcatcttaagctaccagtgagaggagttttaccagaatctattttggtttcctggataagtgtatccagatggttctttgggctggatcaactctgggaattaattgaattttgccaataattttaaaagttcccgaaatacaggcctggtgtggtggctcatgcctgggaactcagtgctttgggaggtcgaggcaggaggatcacttgagcccaggagtttgagaccagcctggtcaacacagcaagactccgtctctacaaaaaatttaaaaaattagccagctatgggggcactgacctgtggtcccagctactcaggaggctggggtgggaggatgacttgagcctggcagactttggggctgcagtgagccatgattgtgttactacactgacctgcacaacagagtaagaccctctctccaaaaaaaaagtcccccaaatcctagcgtgcagctctgctgaattccgtctctgtggagctttggatacgctctgaggcccctttgcctggtgggactacctgcaggtcttggcggctttggctgccggaggaagaaggttccccagtcctgtgtgtatggagcagggaggagttactgaggaaattaaaacgcatttggggccaggtgcggtgacccacacctgtaatcccggcactttaggaggccaaggtaggaggattgtgtgagtccaggagtctgagaccagcctaggcaacgtgaagagaccccatctctattaaaaaaaaccccgcaaaactcatttggggtgacaggacaaggaaaaagaaagatgaaggccaccatcgttgacatgctgattattgctggaaggcaaaggagagtcctgaagaaagtttgtaaagcagcagatttcaaagctcagagggccttctaggagctgtttccgggtttcgtactgatgagtgctgcattcctgactcccagtgacctccagcttccgcccagatcagccaccgcttcctcttcacctatgtgctcttgcggacttaatttttctatttttaattgtgtgggtttttgttttttttttttttggttttttaattttttggaacagggtctgggtctgacgcccaggctggagtgcagtggtatgatctcggctcgctgcaacctccgcctcctgagctcaagccatccttcctcctcagcctctggctgatatttgtatttttttgtagagacggagttttgccgtgttgcccaggctggtcttgaactcctgggctgaggtgatctgcctgtttcagcctcccaaagtgctgagatcacaggtgtgagccaccacacccggcctctctcactgattttaaatggaaggtctgtttgaggtcagtgtgcttttcagctcctgagggacagctgggccctgaggcctgtttttctccgggtgtggtagacctggtgtttggtggtccccactagatgagatgaagctagggaacctgtttttgtggagtaggagtgtattagtccattttcacgttgctgataaagacatacctgagactgggcaatttaccaaagaaggagctttaattggacttacacctccatgtggctggggaagtctcacagtcatggtggaaggcaaggaggaacaagtcccgtcttacatggatgacagcaggcaaagagagaatgagcaagacacaaaagcagaaaccccaaaaaactgtcagatctcatgagacttactcactaccacgagaacagtactggggaaacggcccccatgattcacttatctcccaccaggtccttcccacaacacgtgggaattatgggagtacaattcaaggtgagattttcgtggggacacagccaaaccatatcaaggagaaatggatgtttgagtgatatgccgtcatccctgtgcaggagttgggaaagaaattgttcctcgcaggcctcttttgtttgtttttttgagacagagtctctctctgtcggggctggagtgcagtggtgccatctcggctcactgcaacctccgccttgtgggttgaagcgattctcctgcctcagcctcctgagtagctgggattacaggtgtgttccatcacgcccagctaattttaatatttttagtagagactgggttttgccatgttggccatgctggtcttgagctcctgacctcaagtgatccacctgcttcagcctcccaaagtgcctggattacaagcatgagcccccaaccccagccagagggctcttcttaaagttataattaacagatggacacgtaacttcaggcttgattaaaaatcctgaaaagggccaggcaccgtggctcacgtctgtaatcccaacactttgggaggcggaggcacaacgatcacttgagcctgggagatcaagaccagcctgggcaacatagcgagaccctgtgtctataaaaattttaaaacaattagctgggtgtggtgcatgcctgtgggcccagctacttaggaggctgaggtgggaggattgcttgggtccaggaggttaaagctgcaataagccgtgattgcagcctccagcctgagtgacagagtgagactctcaaagaaatcctgaaaggaaagtcagcaccttcagtcactttgtgaccggcccagaggaactgcctttgactaaagcagaaactctttatgctttgagaattgactattctcctctaccttttaacagttattggaagtgcagctgaccagatagatcctgcaggatgagtgtccttcattgtctgtgcctcccatttctattcctgtaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggtacctccctcagtgtccaggcgtgtggcaggcccggccatgcagcaaggacaggatccgccttctagtgatgtctcgggtcccagggacgtactggccgtccgtaccaccaggataactctggctataatttagtgttacagtagcactcattcattatagaaaattttggaaaagcaggtaagcagaaaagaagaaaatttgaaatcaccccatcatccagcaataactactggtaacatcttagcatatggccacacagggttttggtatatgcaggtattaacatatctaaacatatcttatttttaatgtactcttttcatatttttaactgcgttttcccctcaaaatgccgacgaagcagtgctgtggctgctgctgtagccttgtggaaattttaaggctgaaaagttaggccaaagaggatcaggtaggggccctgagagacattgcatccaaagacagctgcctcaggacctgtcatcccagggtcacggcgtcattgcgggggtgtctgtctctgtggagaggtggacagactggcctcggtgggatctgagtattcccttttagggtgctggcttgctctgaaggtcatgccacataaatgaatgcaggcacgcgtgaatgaatggacttgtgaagggatggctgttttaattaaaggaggggcttttgtgaggtgtcagctttacgcactccctcttgggtttagagaatccagactgagccccgtggtacgtgccagctgtttgtcatagcccttggtcataaggattgggtggggagtgggtttcttctctccctgcctttgctgagctggcctggctgtggaatgggccctgtgggcagggctgcagcgccctgtgctttcctcctgttttcagcacagaggttccttgcagatgattgaaaatggatgtgctggggcaaggggtcatggggacatgattcttggtctttagcagaggggccagtcctcatgtgccagtacttcctggtactaagaccatttatgttacaataatgatttttggttttgtcttttgtcttcttttttcttaaagaacagttctagatttacagaaaatttgagcaggtaatttagagctccattatatcctttgggacccagtttttctattctcaatagccgatgggagcgtcatggtccatttgtttcatcttttttccttttttttggagacagagtgtggctgtgtcgcccaggctggagtgcagtagtgtgatctcagctcactgcagcctccgcctcccaggtccaagcaactctcgtgcctcagcttcctgagtagctgggattacggatgtgtgccatgatgcccaactaatttttgtatttttagtagagatggggtttcaccacgttggccaggctgggcttgaactcctgccctcaagtgatctgcccgccttggcctcccaagtgttagattacaggcatgagccaccatacccagcccatttattacaattaattaactaatattgatagattattcttacctaaagttttagaaaaggaagctttcttgtggggtctcagaggtattatgccattccatctcatctactgatatctcagctacattgctttttgttatttttaggggattttctagggaataaaatatgcagccttaatttatcactgtctagcttgaattgatatttaacacttcattgtaagaatcttacaacagtatcattccggtggcaaaatcatctttttcttttgatgtcaaatattttatgtatatacctgttgtaaaccctcacaaattcctttttatttttgtttgagacagagtctcattttattgcctaggctggagtgcagtggtatgatctcacctcactgcagtgaggcctctgccccccggatttaagtgattctcctgcctcagccccccaagtagctgggtttacaggcacatgccaccacacccggctaatttttgtatttttagtagagatggggtttcaccatgttggtcaggctggtctcaaactcctgacctcaagtgatctgactgccttggcctcccaaagtgctgggattacaggcgggagccaccgcgcctagtctcaccatttccttttaaaatcacattgtgcgggtcgcctggcaacagatgatttctgtctacatctgaaaaatctatagtttttttttttttttagtaaatattttagaacagatttcaattttcagaaaaattttaaagatagtacagcgttgccatctactccaacacccagcttcccttatgattgaaaccttatggccgggtgcagtggctcacgcttgtaatcccagcactttgagaggccaaggtgggcggatcacctgaggtcaggagttcaagaccagcctggccagcacggtgaaaccccatctctaataaaaatacaaaaattagccagatgtggtggtgtgcacctgtaatcccagctgctcaggaggctgaggcaggagaattgcttgaacccgggaggcggaggttgtggtgagctgagatcgcgccattgcactctagcttgggcaacaagagtgaaactcgtctcaaaaaaaaaaaaaaagaaatgttagtatattacattggttacagttaatcaaccggtatggatatattattcttaacacaagtctattcaggtttccttagtttttacctcatgtcctttttctctcccagcatcccacatgacatttagttgtcctggccccttagctcctcttggctgtgacagtttctcagactttccttgtttttgatgaccgggaagatttttttttttgaaatggggttttgctcttgttgcccacgctggagtgcagtggtgtgatttcagctcactgcaacctccgcctcccgggttcaagcaattctcttgccttcagtctctcgagtagctgggattacaggtatgtgccaccatgcctggctaattttgtatttttaatagagacagagtttctccatgtcggtcaggctgatcttaaactcccggcctcgtgtgatctgcctgcctcggcctcccaaagtgctgggattataggcatgagctaccgcacccagcctgacctggaaggtttttatgtttgtttagagtcaggatcttcttccgtctccaggttggggtgcattggtgctatcagggttcgctgcagccttgacctcctgggctcaagtgatctaccacatcagccccctgtagctagggccacaggcacatgccaccatgcctggctaactttaaaaaaattattttttttgccaggcatggtggctcacgcctgtaatcctagcactttgggaggccgtggcgggcagattgtctgagctcaggagttcaagaccagcctgggcaacgtggtgaaaccctgtctctgctgaaaatacaaaagaaattagctgggtgtggcagcgtgtgccggtagtcccagctactcgggaggctgaggcaggagaattgcttgaactcgggaggcggaaggtgcagtgagcggagatcacaccactgcactccagcactctagcctgcgtgacagagcgagaaatttttttttttttttttttgtagaggcagggtcttgctttgtggcccaggctggtgtcaaactcctgggctcaagcaattttcccaccttgaccttccaaagtgctgggattacagatgtgagctgttgtgtccagccctatgttttcttctagaggttttatagctttagctcttatatttagatctatgatccatttcaagttaatttttgtgtatggtgtgaggtagggcttgaggtttatgttttgtttatgggtgtacagttgtttcagtactatctgttaatagacctatcatcccccattgaattaccttggaatctttgtcaaaaatcaagtaatacactctctgtgcatctctgttcctgtgctctgtttggttctttcatccatgtgtcgatccttaaatgcccacatcgcactgtcttaattattgtagctttataggaagtcttaaaattaggtattttaaattctccaacttcgttcttcaaaatattttgaaaattttctaagttctttgtatttccatatacattttagaatcggcttgtcattttctacaaaacctgtgaggatttagactgggattgcagtgcagatcagtttgggaaaaaataaaaataaattgaaaataggagctattagttgcattttttcctttaccttggtctaacattaacctttcccttaaggactctatttaagtttctgatgtattaaacacttaaatgaaacttatatttaatgactgatatcaactagatactaattttaagtagttttttattcataattattacatgatctacaataaatgaatcaggctggattttggactattcaaaccggcacctcagaaataattgcccagaagcctcttggtgccatgtttcttgttggctgctggggcccgtgaaacatgcacacatgtgtgcactgcagtaactggtggtgatgtggttttggcacccattctgcctgtgctgcctacaatgggaaggctgacagctggccagtctccctggcctgctgcttgctgtggattatttgctgagtggcactgaccacccttgctttgccaatggagacagcactggcgcctggtgctagtgggctcccatggctcctgcaggctgtcctggagaggaagtctttagaaaggaacttcctagaaggaagttcagaaaactgtttctgagggcctttgtcccaattcatagatgtggaggcttggagtgagctcttttatttaaggtggtctgcacatcatagcagagcaagctggggctgtggctacattatgggcatgttgagcgaggatctgcagatgggagtctgactgggctttgaggaaggaggagcccatggtcagtaaggccttgtgtgttcaccagcgcgttggtctgtattgtgattcaggctgctatagccgaataccttagactgggcaatttataaacaacagaaccctattgcttacagttctagaggctgggaggtccaagagcaaggggccagcagattgggcatctggcgagggccctttgactcaggcagtgcctcttgcatcttcatacagaaggtggaaggggcaggcaagctccctcaagcctgttttctaagggccctactcccattcatgagagtggagccgtcgtgacttgatcacctccccaaggcccccctcccagtgccatccccttgggacttaggtcttaatatatggatttgggtgacactggcactcagagcagagcagctgcaacaggataggccagatagaggctccaacgcaagggctctgccttcccgcaggagaggcgtctgtgcccgctgttcccatggtggtagggtgggagtaggtgccgcgtgcagagctgcgttcccaacacctgcttcctggtgtcctcagtcagatcattctgctggattgagagagccaccagaggggatcactgttccccagaaccacagccagggagaaggcgtgggggccacatcttgatggtgggagagctgtgcttttcctaattgctggtgtaatattttcttttcggaatggtttttaacaaacaaagcaactttctgctgtcccttcctgttttctctggtgaggccaagctgctatgactagaattagtcttttcgttttttctttttttttttttgagatggagtctcactctgtcacccaggctggagtgcagtggcgcaatctcagttcactgcagtctctgcctcctgggttcactgggctcaagcaattttcctgcctcagcctccgagtagctggaaccacaggtgctcgccatcatgcctggctaatttcttttttagtagagatggggttttaccatgttggccaggctggtcttgaactcctggcctcaagtgatccgcctgccttggcctcccatagtgctgggattacaggcatgaaccatcactcccggcccctagaattagtcttttctgatgagcatctggtgctacctggctgggccctgtctggccaatgtcattgacaccacttgagtccctgggactgctggtgcactcacccggctccccaggtgctgggggcttggcacttagtgcgtctctctcctcaggatactggtatcgggatgacacaggaagagctggtgtccaacctggggacgattgccagatcggggtcaaaggtaagcgtggggcccccacacagcctcccccttcccctcagggtgcaaggatccctccagtaggggtggccctgggtgccagattaagtaagaacgttgtcagttgcatgccacgcagtgggtactgtgggaacacctcatgacatgacagccatccctcagtatctgggggttggtccctcagtatctaggggttggtttcaggaccccccttggatagcaaagtctgcagatgctccagtcccggattaaattggtgccgtatattgtagacacatcttcttgtatgctttagatggtctctaggttagttataatacctgatagaatgtaaatgctagatatagatataacatagttatgttttttatactactttttatcattgtgttgttttttattttttttctgagtattttcgatccttggctggttgaatctgcaaatgtggaacccgtagataggaggaccaactgtattggctcactgcaacctctgcctcccggttcaagcaactctcctgcctcagcctcccaagtagctgggattacaggcacgagccaccacgcctggccaattttttgtatctttagtagagacggggtttcaccatgttggccgggctatcctccagcctcagcctcctgaggcgtgactacaggtgcacgtcactatgcccagacccacagagcagttctgaccagaaccatcaaacccacagacgccgcatcccaagcccgttctcatcacggcgctgtgtgagaggggactgatccctctgaccctctctgcgtcaagcccacaaggctcagggaatcgactttgcagaaaagtgctgtgaggcagagcaacacatttggactcagaccaacagcctgggaacctccagcggtcgcccttttccagctctgggcaaagcacttacttcagtctcctcatctgtaagatgaaaacactaggtcgggtgcggtggctcacgcctgtaaccccagtactttgggaggccgaggcgggtggatcacgaggtcaggagatggagaccatcctggctaacacggtgaaaccccgtctctactaaaaatacaaaaattagctgggcgtggtggtggtacctgtcatcccagctactcgggagactgaggcgggagaatcacttgaacccgggaggcagaggttgcagtgagctgagatcacgccaccgcactccagcctgcgcgacagagcgacactccatctcaaaaacaacaacaacaacaacaacaaacaaaaaacccaccctaactgtgacttgacccccacgttacgtcttttgttgtatttctctcgaggttggtctgctgtcctgtgtagcggccaccagctgcatgtggcagtttaaatgtaaatgcattcaaattaaataaaaggggacattgtgctcctcagctgcacaggccacattgcaggtgctcggcaggctgtcgcattgcacctggcagaacgttcctgttgttggagaaagttccatcggacaacgtgggccagggcagtgggcgtgtgtattttacttgactttggccttaggacctttggcagtattatagtagaaaaatgaagtgctgtgcggtgcttacagacgcatgcgcgtgatttctactctttttcccacaaagtgtagagtccaggagacttgaatatggaagccagtttggagcctctcctcactcctggccttcctatggaaggagcttattcaagggaaagagcttattcaagctgctctttccccacccccaggtgtgacccacaggcctccacctgtctgggacaggcaggactgtgagctttgggaatcaaatggaaaacacacttgtcccactgctgccagctggttgtcctagggctaatgtgtcacctctctgtgacttagctcttcacgtgtagaatggggtggaaaagtactcggtgtggctgttttcaggatgaaggggtcttagcggtgctcgcagaagagccacggtgttgggagtgtctgctctctggaggggaggctgcctcactaactggcctctgccccacaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatgggtgagtgacgaatgtcgcctgacaggcagctcaaagctgagctggagcccttagcatggagtttggaaagggatggactcagaaaacgtacacaggcattttctgggctttttatatgaaatctgactctcccattttggggagttagtgacttttgtggctccaggtggcctatggcacctgtctggtcccatgtggttggtcaccaccactgcgctcgggaaggcaggtccggcccgcgctgagctcctttctcagtggctgagctgcaggactggcctgtcgcctggtggacactatgcagcctcctgtgaccgaccttctgcaagagctcattctgcttcctcccagccctggcatttcctggctttgtctccccagcccacttctgcctctatagggtgaggagcctgctgggggctttttttttttttttttcctttgggacggagttttactcttgttgcctaggctggagtgcaatggcacaatcttggctcactgccacctccgcctcccaggttcaagcaattggcctgcctcagcctcctgagtagctgggactacaggcgcatgccaccacgcccagctaattttgtatttttagtagagacagggtttctccatgttggtcagactggtctcgaaccccgacctcaggtgatctgcccgtcttggcctcccaaagtgctgggattatagacgtgagccaccacgcctggctccgagggctttttagcaggtgagccgcttccagccagccgaggcgtcctccctccgtgatgccatttctgctccacagtgtgtgcactgtgctcagcttgactccccactctcccaaaactaacattcctgtttaattccatgggagcggggctcagagtaaacttaggccaaggcatcaacatggccctgccgggggattcccccctcctgtgcttcggagatggttttctgctcttcttagggggcgcctgtccccctggcctttgtttttgcccctgggcatctggcacccgatttggagctgggccagtcccccaccgtgccccagacctgcttttggggtaagcccagaagcttcttcgaagcccagggtcggtggaggacccccgcccccccgccccccgcccgagggaaccaggagaactctgccgcctgcgacaggctcatcgttcctgatgggcatgtgatggcctgagtggtgcgctggggtcagaaatggggcatttgaggtgtgttgtgtgttgtttgggctctgcctatgaaaccctcgggaaccgctggagtcccatgcagggtatgtcccagtgtcacatccacctggcttttcctttccttgcctgccttagttctggagtgtttgaaatcgccgaagcttcgggagttagaaccgggacaaaaatcatcatccacctgaaatccgactgcaaggagttttccagcgaggcccgggtgcgaggtgagcgggagcccgggcccaggctcactctgggatccatgtgtggcctggaggccaccaggtcagcaggcattttccctggttctacctgcacgtagggtgcacaggcagagccgtgaagggccgagccgctgcgggactgggaggggggctgcccgccagggctgcgtagcatcgagctcctgctgggactgggaggaagctggcctggctgaggcggacctcctcctccttcctctgcgtggcccttggcctttagtgcacctgggggtttggcgcagtcctgtcccaggatgtgggcgtggccttccctctttgtgtcctgctggacactcagggaggccctgagtacccccaggagtcagcccagaaagccatgttccagccacaagctgacattgcagtctcgcagcagccggggcctccacagctctggttctcacgtgggctccgctgctgcccccgtgagactggggggaggacaggtgtccccactgtgccctgtttctgtacctgtgaagtgtacacagcatggaggacccttcccagcaggctggcgctcatcctggagctgctgcaaagcttgcgtttccacaagcattgtagatgcagtgtggtttttcttttgtcccttccagatgtggtaacgaagtacagcaacttcgtcagcttccccttgtacttgaatggaaggcggatgaacaccttgcaggtgagccctgagttcctctagggactggtcaaacatggagacaaatctgtacgtttcagggcagcggagaagagatgagcccaggggatgcggcccagagtcacagggcgagctgctctgtggagatgagacctgggtgtggggatgagacaggggcccagctctaccacagccctgcccctgtgcaccgggcagccggggtcaggggtcagggttcactgaggcgtaacgcccatcccagctggctcaccacatcagtgtgcagccatggtgttcagtgcagccacagagctgtgcagccaccccgcatcaattccagaacatcccatcaccccaaaaagcagccctttccccactgcccctcccccagtcccagcagccacggtctcctttctgtccattgtgctgcctgttccagacgtttctcctggatggagtcacacggcatgctgtcctcagtgactgacttccccctcgcggctcagctgcggtgcagcgtgggtcgtcatcgctctcacggcccacactgtattcgtcagctcgcccctgctgggcagcgtcatcctctcccacaggccccctcaggtcccggctggtcctcctgacatgttgtcctgaggagctcctgccccagagccttgtgtgtctcccctgcactacccggcatagcccagcggtggggctggagaggggtctacgcctgagaccaccgcccgtctgtcccaggagcctgtccagggccaggcgctgcactggctcaggcctgcacggtggtggagaagacgtgcgtggtgaacacgacgccctccccgccgatctccgtttccaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatggtgaggcactgtggcagtcccacggccctcagggtgactctgttgtcccctgtggcatcagctctgcagatgtcacatgattaacatggcagtgtgagggcatgaaaaacataggtagtgctgggtgtggtggctcacgcctgttatcccagcactttgggaggctgaggagggtggatcacctgagcccaggagttgcagaccaggctggccaacatagtgagaccccatctctgaaaaaaaagaaaaaaagaacagatgcctctgggtgggtaaccacagaggtttcctctgtctcaggggtcacacatggcgagggaaggattgatgggcatctcagtgcaggctggggtggaggcttgtggactggggtgtgcctggggagggccctcagagcctacatcatctgctgtggatcagtggatgctgtcctgccaggcgctctgggaagggcctgtggtctgcctctccgttggcctctctgtgtgcttcctccacaccctccaactcccctggtttcctttaccacattgaagttcccgcaaatcctgccgtaaggagacctattcggggctgagagccagcccgtcctgcccccaggctcttctgtccttggctgcctggaaactctcctaatgtcctgcacagctggcatccatcttggaaagagccagccaggtgtggcctccaggggcttgttagagtctcaggccccacccagggctcctgcgtgggagcccacattttaatatctccccgcattttaaccggatcccccccattttaaccaggtcgccccacattttaaccaggtctcccaacatttgaactagatacccgccgcattttaaccagatcccgtgatgaggtgtgggtcccggttcgggaagtaccagtgtggagcaggtgttggcaggcacgttccacgagggccagacaggagctggtcccagcgtttcgggcccggtgtctttcgtagccactaaccctgccgggtgaggaagcagcactgccctgctgccctctgagcacacagggccgggtcccatgagctgcgtagacactgaaatttgagtttcatcttcacttctcatgagatcatcctttttgaaatctttcctcaactgtttgaaagtgtaaaaaccactcttaggctacacagaggtaggcagtgagctggatctggtcggagggctctttgctgatccctgacctgtagcaaggtttggctgtgttcagtgtgttcaggggtacgtgcaaggttcactctcttgtgtcctccttaggggctgggctggggagggcggcagctgccagagaaggccttcagcccctgcagagccacagtgtggggcatcgtggggcccctgcactgggcttcaactcagagcagacgctgggggagggcgaggcgggagtgggctctggattcatcgtgtccgcccccacctcccagccagggcctgcctggggagggtcagtgctgcatgatggcgtgttctcctcacccccagaaaccgtccatgtttgatgtgagccgggagctgggctccagcgttgcactgtacagccgcaaagtcctcatccagaccaaggccacggacatcctgcccaagtggctgcgcttcatccgaggtacgctgctcagagtccgtgagcagtgcccccgtggcccagtgtcgcccgctgcatctgtgagggaccgtgctgattccattctcagcagccctctgcagcgagagcaccgccgtcggcctgcgctgcctgtgtgtcagtcgcgtttacagaccccgggagctgccccacctccctacgcacatgactgatctggggggagcactggggtgttcagattgaggtctttccatatgtagggatactgagtttcagattgatatgtgagttgtgttacgtttgagtgagattatagtttaagaaagacttcagtatttaagccttggtacacagaggtgcgaaccatccctgatagagttttgtttgtttgttttttgagacgagtcttgctctgtcacccaggctggagtgcggtggtgcaatcgtggctcactgcaacctccttaagtgattctcctgccttagcctcccgagtagctgggattacaggcgcccgccaccacacccggctaatttttgtatttttagtagagatggggtttcaccataattgccgggctggtctcgaactcctgacctcatgatccgcccacctcggcctcccaaagcgctgggattacaggcgtcagacactgtgcccagccagagttgtgatttttaacataaagcccaggctgtcattttccgagtgttaccccgaggctgtcccggccacccacagcccaggtcactgttctgggaggtggcaggacgtagaggaagctccggcagtgccgcctccctgcttccctcttagcacacgtgctgggttgaaggccaggcctgaagacaaagggcaggttaatggggaatgttgggtggtgtggagggccgcagccccgggagaagctgactgccgtgtctcccaggtgtggtggacagtgaggacattcccctgaacctcagccgggagctgctgcaggagagcgcactcatcaggtgagcctcgggccgcggggagaggaccctgctggggacaaggcccctacctgctcctttgcccccagagggccctagccgtggcccatggagctgagagcagaggtggtcggggaagcccggcctgcacatgggggccctcaggagccttccaggtgctggcctggcctctgaagcttgtggtccagaagaaggtgggggtggctggtcatggctgaggctggagtctggatagggggaggggccgcagagccagacctgcccacctgtgccccagggttgtgactgcagccctgcagcaggccagccctgtgtggaggggactccagtgtgctggctccaggttctccatcagtagctatcacttccccactctggccccaggctcaccaaatagtctttattcaaaacctcgcttactggctttttttcccctaatgcaagtagtatttccttactagagcacattcaagtgacctgtgctctcacctagagatgactgctgttgatggtttagggtggggtagattggcagccacatagggcaggtttcagagggagcctgtggggtgaggattcagctggaatttggagccctggaggtctctcaagagcccaccacgtgcagcatgccatggaacgggccttgttggagcccccaacgtgcctgcagtgtttctctgcccaccggtttctctccagtgttgaaatggaagcagatcctcggaaaaaggatgagtctgggtaattggtgtgtgttggggctgcgctgtgggcatggcgagaggcccacaccgagaggcactggtcctcagagattctgtcctgtgccgcgggcaggagcaggtctggggagatggtgggcagtgtggtttcctgcctggtgggtccatgcccagccctgcgaggtcacatggcctgccggtgatatcctcctgcctcaccttcagaggcagaaagccatggagatttttttcttttttcaaccaagcaagccgcagtgatgttttattggttgactgatagggtctttcttgttgtccaggttggaatgcagtggtgtgatcacagctcactgcagcctcaacctcttgggctcaagcaatccttccacctcagcctcccaagtagctgggactacaagtgtgagctaccatgcctggctaatttttttgtatttttttgtagagttgggatctcactatgttgcccaggctgatcttgaactcctgggctcaagcgatcctttggcctcagcctcccaaagtgctgggattccaggcatgagccactgcacctggccacttagatttttttttttttttttttttttttttttgagacggagtcttgctctgtcgcccaggctggagtgcagtggcgcagtctcggctcactgcaaccttcgcctcctaggttcacgccattctcctgtctcagcctcccgtctcagctgggactacaggtgcctgccaccatgcccggctgattttttatatctttagtagagacagggtttcaccgtgttagccaggatggtctcgatctcctgacttcgtgatccgcctgccttggcctcccaaagtgctgggattacgggtttgagccactgcgcccggcctgtttttgtttttcatgcaattgaattcatattgcttatactgtttccttttttctacctagtttatttgcaccacttcccatgttgttttttggaagcacttttaattgctacatcatgggacatcacagggatgtaccatagtttactgatcccgtccctcggggctgcacagctgggctgtctcagtgtttctgcagttatgacactgcagtgcatgtttatctttgttctgaaatcttttttttttttttttttttttttttttgagacggagtcttggtctgttgcccaggctggagtgcagtggcacgatctcggctcactgcaagctccgcctcccgggttcatgccattctcctgtctcagcctcccgagtagctgggatacaggcacccaccaccacgcccagctaattttttgtatatttagtagagacagggtttcactgtgttagccgggatggtcttgatctcctgaccttgtgatctgcctgcctcggcctcccaaagttctgggattacaggtgtgagccaccgcgcctggcctgttctgaaatctttacctgcagctgtatttccttaggatagaatactaggggtggggttacttggtcggaagatataactatataaaaggtattttccttgctgactaaagagatgttatataatcaatgaaaagggggcctcagtgcttgtttccccacacagccgtgctggcttctgacagcaggaccccgacttgctgccgacatgaccacagggcagcagttgtgctgacctcaacaggatgcatccccgccccacagcagcgactgttctgtggtcgttagagtcgtgctctttggtgtactgaccctgtgcacttcgagtgcgcctgtgggttactggtgatctgcccaatgtttcagttcacttcagtgaagagagggcttggggctgactcccggattattattgctggtgctggagttgtccccaccttgtccatccccatcaccctgcccaggagtggccacaggaggggaggttccaggtacaatgtccctgggctggataaggcaaaggacacccactgaactgaggacacgtctggcctcatctgggaagctcacggatgaagtggaggcaggggccaggccctgtggagagggagctcctggcgtccctgcgggccgaggcggctgcgttcctctccccatcctgaatgtgtttcctgagtatttcttctccactgagaactgtgctgagcctgcataaacacgtgtttcatcctgtgaggggagccgtgagtcctcactcatagttgtggaaactgagtcacagaggggtggtcctgctcagtaagggagctgcattcctggctgtggcaggcatgctggcccactggtagtgcccgaagctgcagagcaggggtcctcatcccagcttgtggttgtcaaaggttgcgttgtcagtctgagaactcatctcgatcagaaaagagtcagccgaaattagagcttttgaaagaatcacaggcttaaaagttggaagcatggtaccaagaacatgtttttcctcgaatcctgtgagaggaagttgccttctcgatgcctttggggtgcatttccaacaaacaaggatgtccttccctttgtaattaacagatgttataggtattttgaagctatgtaaatgtcacattcttcatgaaactctcaatacattcatttatttacttaaaatatttatgtgttggccgggcgcggtggctcacgcctgtaatcccagcactttgggaggccgaggcaggcagatcacctgaggtcaggagttcgagaccagcctagccaacatggtaaaaccccgtctctacttaaaaaatagaaaaattaggctgggcgcaatggctcactcctgtaatcccagcactttgggaggccgaggcgggtggatcacgaggtcaggagttaccagcctgccaagatggtgaaaccccatctctactaaaaacacaaaattttagccagtcgtggtggcaggcaggtgtaatcccagccactcgggaggctgaggcagagaattgcttgaacctgggaggtggagattgcagtgcgccaaaatcacgccactgcactccagcctgggcgacagagcgagactcatctcaaaaaaaaaaaaaaaaaaaaaatcagccgggtatggtggcaggtgcctgtaatcccagctacttgggaggctgaggcaggagaattgcttgaacccgggaggcagaggttgcagtgagccgagatcacgccactgcactccagcctgggggacaagagcaagacttcgtcggatggaaaaaaaaaaaaaaattgatgtgttatatttatactatttataatttatttatatgggctgatttcctgttttattcaagagtttataatcttgctatcattaataaaatttttttatttttatttatttatttatttatttatttttgagatggagtcttactctgttgctcaggctggagtgcagtggcgaggtattggctcaccgaaacctctgcctcccggattcaagcgattctcctgcctcagcctttcaagtagctgggactacagtcacccaccaccatgccctggtaattttttgtatttttagtagagacgggggcttaccatgttgaccaggctggtctcaaactcctgacctctggtgatccgcccgcctcagcctcccaaagtggtgcgattacaggcaggagccaccatgccccgttgattattcttagcacggttacccatttgaccaatccccctccatgtaaccaatctaccattgccactgccctcttctgcgggtgtccctgtcacctacttgggctctgactcttcacggtgggctggtcacgcccccagcctggacacccttctctggggttcttgggctctgacacccataccaggctcttcccaaccatggccctgcatagacaccttccctgggctctgcaccgcatcctgggctactgtccccccgctcccaggcacgaaggcatgtcctgtcccattctgccctgtggctgaaggactgagtcactggggatggagtgtgggaggaaaggctctaaatgaactcgagagagtgttgttcccatgctctggattattgaaatacattgtaatttacctgcttaaaggaaagactaaatattaagaagaaaataaaaatatccctagtcccagtgataaagttgttcctaattttaggccattatgtaatgctgcagtaaatatcctgatccctaaaatcccaattttgaaaaattagagtatacatatattcagtataaatcccaaattacagtgtacatatatagtatatacagtgctgctcctaatgatggaaaattgttatgtacatgtagaatgtgcattctttgcctgtatctatagacgtactgtaatttacccacattgggatttttctgggttttctttcaacacagctaactttctcatgtcattgaggattattaaaagatgcagttttttttttttatggccatttagcattacataattttagcctatattcttgaacatgaggttgttcataattgttatattttatgtgccacagtgaaaatcctggtacataaatcttggtgtgctcacatgtttcctaaggtgcagttcctataattggaacaactggctcaaaggttggaagggttttccgggcgtgggtatcttgtctctgggggcatcggttctcctactgcctccagggggtgtctgccctccaccctgctgcctcctgtccggccactgcccagggtttctgtctttctgctcagtctttttcagtttggccaataacggtaccttgttgttttcacttctttgattcttagcggggctgaacattttttcgtaccctctggccatttgtatttcatagaggctgcttgtatgtattaaatgcatttcttttctgtaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggtataggagctgtgttccaggcctttttctgggccaccttgtccctggggctgctgaggaagctggtggaggtgtcccctgatgtggcgacggtgcagctgggtaccctggctgctgctgctgctgccaccagggtcaggaaatggaaggccaggcttctgggcctctggcaccttccaggcacatccttaccctcccaccagtgctgtgctgtgctctgaagggctcagcctcactgctgtgtgaaggtgcagcccagggagtggcaggaagagggcgtgcacacactgtctcccctcagaggatgttgggggctggggagccacagacaggtgggacaagccaaggactccgatcccgtgggtggggaagtgggtggtctcagtgtctgttgagggactattcatcatgtactggatatcagtctccaaatactatgctacaggggccagtcgttcagttaatccaatagtggatggctgaaaaacgaaacatttgttccataaacattttttgtccattttttattgagatacaacttacatagcatcagattcacagaattcaccttttaacacgtaaaattcagtggcatttagtgcattcacagtgtggtgtggctgcctccactgtaaccccagaacatttcatcccaggagcccatcccgtgctggtgtcccttctccccagcagcaggaggagggtgaccacgtgtgtggggtcccaaggaggccgtgttctggttgtttgccgacttcggcagcttctgacacaggcctcttcattctcctttatcttcatttgagttaacagcacacaggtaagagtcagagacatttctaggtctttgtaggtgtgcacgtgtgacatgtcttatcaatgcagacccaccatgtgtgcaggggtggcctgggccctgctggttgggtgtccagctccttgcttttccctctttctgttttccccctgcgtccttccagctgcagctcccatgagctctagaggtcacagctgcgttcagctgatggggaggagggcaaacccctcccctaagggcccttctccaaatcccactgaaacccactgggcaaagccagtctctgccatagccagctgtgaggagggccgggaaccgtggacttcacccgtgtccgtgtgcccaccagagactgactctgtcactgagggcagagggaagacgctgggtccaggccgggctctgctgttgggtggggtcccctcccagggcgtggtgcgcgtagctccctggagagcccctgggccacctggggcaggaggtgcttcctaagcccccagagctcccaaaaggggcctgatgggcagagcaaggcctgctctcggacaacccccgagtccactaccgtccctcgggtcagggccagcctggagtgccaggaggccatgggcatcggagggtttgcgcccagttagttgggcaacattgagcccatgggcctggaataagtggtgacctgccccgtcccttctaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggtgggtgagcggtgggtggggcgggctccgggggctgcaacctggggagggtcttgaccttctcagctctgtgctgggtgaacctgcccaagactccgggcagggctgcacagtgggtcagggtcacgggcacagaggccggaccgactgtgacggctgtttcccacttggaggtcacatgtggttttttttgtttgttttttgtttttttgagatggagtcttgctctctcgcccaggctagagtgcagtggtgcgatctcggctcactgcaacttccgcctcctgggttcaggtcattctcctgcctcagcctcctgagtagctgggactacaggtgcacaccaccacacccagcaaatttttgtatttttaatagagacggcatttcaccatgttggtctcgaactcctgacctcatgatctgcctgctttggcctcccaaagtgctgggattacaggcgtgagccactgcactcagccacatgtggatttctttatgcgtggagtgcttctgccttgaaggcagtcagagccttccttagacccaggtgtcgtagtaactgtcatgcaggcctaggaaccccaactgccccggtgttccccagtgtggcccgcttggctcccccagccctcctgccgccctcatcctttcttctgtggtggctggaggcccccggggtctgatggagctgctcttggccacctgcaggttctcttctgctttgagcagtttgatgagctcaccctgctgcaccttcgtgagtttgacaagaagaagctgatctctgtggagacggacatagtcgtggatcactacaaggaggagaagtttgaggacaggtccccaggtcggcatcccctgctctctaggcgtggggctggtttccactccccgcacgcctctcctgccccgcagcgagggcttcctttgggttttcgtcagttgacctgggctcagccacccccgagaagagccttgtgggagcaccctggtgactggaggaaggtgcctcctggtttagatatcaggggtctgtccagtgctcctgccacggtggcttctggagctggcccagcttcttgagaggctgtgtatttttttaaagccctaaccaagttgtatgggcctcaggcaacctgaagcatcctttgaggttttacttttagatgaaaagcatcttgctagcttgtgtctccatcctggtgggagaggaggtgggagctggaagcatgctgcgtggcccccatggaagccggggagttgggatgcaggcctgagctccctgtcgcctgctcttccgcagccgccgagtgcctatcagagaaggagacggaggagctcatggcctggatgagaaatgtgctggggtcgcgtgtcaccaacgtgaaggtgaggctttcccggggatggaccaccacttggccgcagtgtccctaacaggctggccagctggtggctcccagtacctggcccgttgggtgtccttccagcagcagcagaagcccttggtgtcaggtggagaccctgtgggtccctgctcggcacgtgttgctcgggagtgccgctgaggcaggaaggccgtgtctttctcccagccctgctccagagcaggtgtgaactgagaactgaaaaaccagcatcctgagtgggagctgcaatggctgaggacgtgggggttccaaacaagggacatgctaccccagccctcaggagctcacatgctcacttgggtgcttagtcgggggttttgggtgggcttcagagagctaagactccccccaccaacctgtctagctcagagtgagaaatgagcgtcccatgcatggtcacttggaggaaggggcctcatgcagggtgggctggcatggagcagaggacgatggattcgggcagctcctggaggcagcagcggggcaccagggtggtggagcccctcgggcacagtatctttgcgtggggcatcagctcagggcccacaagttagtgggtaatggggagggagcagcgctggtccaggggagtccttgagaccccgcctgctacctcgtggtctgggtgaccttcacccctggtaagatcctgccagccctctcacattgggaacctctatcaccctcaaccccgggctttgctcacaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggtgaggccacgctcctggctcttccagcctgtgggattccccagaatcctgtgtgtggtgttcttttgttgtggaatgtgacacagaagaaaagtgcgtgaggcctgtggacatgtgggtaactataaggagctgtatgcagtttaggctgcacccatgtgaaatggaacctggccagccccttaccatccccaggtgtcacctgggaggttagccacatcccagcctgtgaccatgtcctcgttttgctttatggctttgccacctgtgcgtgtcctggacatgctcagttttgcctgttttgagctttgtacgtggatcttggtgtttgctgaagtctcacgttgctcacttggcatgagggttgcccatgcagaggggctgccacaagttcattttcatagccgaataatgtccgctgcagaaacccacctcggcacagcagactgctccgttctgctctgctgggcctccggtggttcttggtcagaagttgtggagagccaggctgctctgagtattcttgtccacgtgtctggggcttgtgtgggtttctctgtggccccggtggtgggagctgcttccagggtgcaccgagaaccccccagccctgacagtggctgagccgtaagatttccctcgtttcttcctgttgttctttatatgccctttatctgttgtaaatgtcttttcacctgcctttaggtatcttttgagtttctttctttttacagtatcacttctttgcacccatgaatgtgatctatttaggtctttaacatcctttggtaccttacattctctgtagggttctggtaccatttttaaagaattattctttgatgtgtcttatggggtattttaaaatttcattttctaacttgtatatgaactaacttgtatatgaagtttcttttttgggggaaattttgaatgtagcaattttttaaaaaatgaagttacataaacatgttaccaaaaatagaaaacagcaaaaaggaaatcaaaatccatagacttaccaccccccccacaatgtagcctaagtagtattttaatttttgagacagggtctcactctgtcccccaggttggagtgcagtggggcaatctcagctcactgcaacttctacctcctggcctcaaacaatccacctgccttagcctcccgaagtgctgggattacaagtgtgggctaccacccccagccagtttttgttttgttctttagtacatgtctagtttttttcttttgtcattttacaaccataacttttaaaattatactggaggcgagggagatgcatcttcctagccatggcactcctggggaaaggctgacttggcttatggctgtcagtgcacagcagcgccagtatgcagaatgcctgtgcctctgctggagcagctcagtgaggcggacaccaggtcactttaactagttttggtgccaaactagttttgtgagatagctgcagaagtgctcgtttctgtctgttgccacttcacttttggagacagggtcttgctctgtcacctaggctggagtgtaccagtggcgccatcagagctcactgcagccttggcctcccaaagtggtgggattacaggcgagagccactgtgcccagccagcttcactttcatttgttttaaaatttggtgttctgtccacatagttcagaattcaaaactgcttacaggggaaaatttcctcctacctgtgtccccagtgcagccagcattagggcttttgtatttctgcagagattatgtgcatttgtgggcagctgcgcccgtgggcttccaagggggaacttgctgtgcagtgggtccttgccttgcttttctcccttagggtaactaggtgacctccacattagcatattaagaatgtcctttttttccagctacgtagactagaaatgtgaggatgtgcatttgaagtgtttcctctgttaggttgggtgcggtgcctcacgcctgtaatcccaacattttgggaggcctaggcgggtggatcacttgaggtcaggagttcgagacctcatctctactaaaaatacaaaaactagctgggggtggtggtgggtgcctgtaatcccagttacttgggaggctgaggcaagagaacctcttgaaaccaggaggctgcggtgagccaagatcatgccatttcactctagcttgggtgaaggagtgagagtctatctatctatctatctatctatctatctaaaaaaaaaagtgtttaaagggatgcagttaggaaatggaatggctgagtctcagcatatcatccacatgtggttttcccgactccagttgtcctctggagaggttgtacaaatttacagttccccagagccctcggttttatcagacttctaagtgaaaaattataatattcatgttaaggttaaatactacatgatgctttttcctatgcagaaaaaaatattgttctgacgtcaaatatgtcaatcattctttactttttggtttgtggttttgcttggaaaggctttccccttctgagatgatgaaacatttcttccctagaattgtgcttgtcatctttgatccctctggaatttactctggtctaaatggttttctgcatggctcccagtcatcccagtgctgctggatggagtgatctgtctcctccctcttctgtgaaatactgtcctcatcagacactcagtgtccaccctcgttacatggagttgtttgccttccccctttccagacctaaactgttttatttactagagccctataatatgtttcaacatgtgggtcttactcccttctcttttattatttatctaggaaccaaggcatgtcttcacgtactaagctccttttgtccctttagtgtatattaatcttggagtttggctaccttacagcattttctaatactgacactcctgattctcttgggttttctgggtatataatgatattatctataaatgatcattaacataccttatttaaaaaactacagacagtcttactgtgcttctttaaatatcctgataatcccaaaacatgaagggagggtcacagcacgtggtactgagctgctttttctggtgggttctgtgttgcaggcacgcgctcatcaagaagctgaatcagctgcgcgcaagcgagcctggcctggctcagctgctggtggatcaggtgagtgcagcagcttaggatgactgcagggacccaggctaccagccctgccagcctgccttcagggtggaacagcggtttcctctaaaatcctgtctttttgtttgtttgtttgttttttgagatggagtgttgctctgttgccaggctggagtgcagtggcgcgatcttggctcactacaacctctgcctcccgggttcaagcaattcccctgcctcagcctcccgagtagctgggactacaggcatgcgcctggctaattttgtattttagtagagatggggttttcaccatcttggccaggatggtctcaatctcctgacctcgtgagccaccgtgcccagccaaattctgttttaaaaacggaaaaatggccaggcgtggtggctcacgcctgtaatcccagcactttgggaggcggggggatcacctgaggttgcagtgagccgagatcgtgcctctgcactccagcctcggcaacagtgagactctgtctcaaaaaaaaaaaaatgaaaaggtgccccatgcccctcataatgggtttctcctcttgcctttcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgagtgtgtgttgggctttttttctgggtcctgtggcaggatgggtcctctcttcctgcagttcaactggtgtggggaggggctgctcacttcagcatcacctccactggatagtggtcactgatggcttgggcctgcaggcaagtgggcacagggtctgggctgagcctacctgagctcctgtgtcccatcctcatgtggctgtgcaagggaggacacataccagttggtcactcaggccataggcagcctggaagttaaagggaagagccgagtcgggaacaacggcgcctcggagcagcatccctgcaaccacgatcctgatgggtgttgggaagagaaagtaggttcccctttcacacatgggcctggctcagcacccgcaggaactaaactaagagccctgggacctgccagtgcaggtctgtgggtgcccaaaactgcacaccctggtctgtgcccctcaatgtggaaaccacatgacagcctaggtgtctgcctctcctcttatccccagatgtgcttttccgaaaaaacctaaaaatcgtggctcttgttattctgttccctgtagtggatcaactgaagctcagttgggtgagtgttcaaaggctttgaggcttctgaagcccgacctatgagtcacggctgcccttggaggtgccctcagtctgccctaagcgcgaggccctgctcacctgtcataggcacagtgcgtgggtgtagctgtggtgtcagcgctgtcggggatcagccactggaaggtggggcttgtccacaggcggatggatgaccactgggagggtctcacatagctgcagcccgcattgaagtcgcccatcaacatgacgtcctaccaggaaacgctgcctgtggccctgggacatgcggaggccgctggtgcccactgcccctgggagggcctcacctccaagccccatttctcttggacatccaggtagacgtcatagagagcgtcgatctcggctactgcgtcccccggggccgcatgcaggggaacaatggcaaactccctgacctctgtggagacagccacgtcgtgtgaggcacactccctgggggcaggttcagtcaccatgtcagctggaactatgtatcatgacagtccccccggggggtggatattttccaaatgacttgaatggaaaacccaagccccagggactgggagggcagtgtgtgacacaggcattccaggttccctaggagggggtggaggccataagcgccaagccgagccccaccctggcccaggcagcacccacctgtgaaccgggagaagaacctgacaatggctggctctcggttgaaggtgtcgttcccgcagggctcgcagccatcatcgtagtagtagctgtccaccgcagacacctggtcaggcctgcgggaaggccgggcaggaggaggtgaccccaggctggaagctgccccactcctgcttcccaggaggcaggcgtcgcgtcccaggcgacaggagggcgggggagccaggcacctgctcaacccattggtccgggacccaggcgacaggagggcgggggagccaggcacctgctcaacccattggtccgggacccaggcgacaggagggcgggggagccaggcacctgctcaacccattggtccgggacccaggcgacaggagggcgggggagccaggcacctgctcaacccattggtccgggacccaggcgacaggagggcgggggagccaggcacctgctcaacccattggtccgggaccttggggtgttttcactccaccctggaccctgctctgaagcctcaggttcttgccataggacaaactaataggacaaactacttccctgctctgttggggccctcccaggtgagggaggggcttcctggctttctagaccacccacctgtacacgaacaggtagcgctccttatagctgttccgtcccagtggctcactgaccacgtagtgataggtgtctggtgcatccctggattgaagaaacaaaaggtcccagtggcgggggccataggggacccctctggctgccgatagcgaggctgtgcccaggtccccacccttggggcccaagtgaagtgaggctgtgccgtggacgagatgtcaccttcctatgaccctgccactgtcacccactgattgaggttgtccagcagcttccccacggcagtcaggtggctgtctctgacctcctggaccagggcgatgtcatagcggctcaggatctgggggcagggccacagtggtgctgagcagggctggtgccacccagggaccctacagcgccacaaagggagccacagctgatgctcgtggcattgctcggtttaaccgcagcctcatgtttctgcctgggctcctgctgccagccagggacagcacagcagggatgaggaccttggtccacagccaagagcctgttccaccgtgctgggagcagtggtgctcagtaccccacacccgacaccctgtggctccatagggctggccctgcccaccagccctagactccagagctcctctgcttttggggggaggctgccctggcctcacctgcacaatgtagctgacgagggtggcattggacatcttggtctccccaaatgtctggatgttgaaggctgcgatcttcagggacacggccccctgcagtagggccgccagtgccagcagcgcccccagcagcttcatgcccctcatcctgggagagcacagggcacagagacataacagaagtgagacgtcatccctgccacagcactccagccttctggagcccagctggcaggggctggtggagctcaaggtcagggggacgcaggcgggggaaaccctttcctacaacgtccagaaagccaaacagctggcaccacgtagaggaccccgagtcactcctccatccaccagaaaacccgcccgggagggacgctggagcctccgcctcactcgctgctggaggatgagactctaagcctccctccctgctccaaaccggccagtcacccagaggcactccacctggtgctcacct

SEQ ID NO: 844 - DNA, 7311 bp, Human
tctaactagacgcatccgatcagagctgcaaaactgactagcctgcaggacggccccaagacggggtttacaggggttttaggcctgtgttctaccctctttatgacagaaaaacacagaaagacaagaatgaaagacgactatttctggggaaaaaaagcaatcaaacaatatgaatacaaaactaatcacataaatacatttctctcattaaaactttgaagaggaaaacaaggtaaacagacatttttaccgtcggcttgacaagattccagagaggccgggagcctggctgctaagaccttcttacccttctttctgccagcttgtcggctcctgggttcccctgacggaggctcccaggagagtgactttagttatcctaccgactgcaccaaaactgtaggagcctagagaaaaacttttctgcattctgagttcacagaaaatcaactgacaaaagccaggttagtaagaaaaaaggcatacagatttattcatgcacacagggagaaccagagtgatgaccccaacctcccaatggggttcggaagcttatataccatcttgaggttacagaaagaacatgggctcaaagtatggccacagtttatggtggaaaatcaggtgaccagtggcaagaccggttacaggagggagagcagaggaggcctggctagcaaaggtggccttgttctacagatgaaacctcacaggtagcagccctgagagagaacagatggtgaatgttcccttcaggcctttaaaggcgtcagactgttactcttcccagatcaggcaaggagggcctcagaggaggcctggccgcatcagtgtagattctctccacagatgcaaatctcccccacaaaagacagcttttcagctattcttctatttccagtccttctgagtaactgtcttgaaccgtgtcaaggaaatatatttggaggtgacatattgtgttttccttcaagatcaaaaaggttaagtccaaggctgcccaacgagggagcgaggacccaatcacgttgtcctcagatgagtttttccccagcagcgtaaccctgcaacaggccagactggaccccagacacacattccacaccacaccacgcctccaccaccacacgcacacaacagacacaccctaaacaccagacacacacacacacctcaaccaccgcaaacacacatacgccacacctctaacaccacacacacccaacaccacacacatacgtgcctcaaacactacacacacctcaaccaccatacacctcaaccacacacacccctcaaacaccaaacacacccctcaaccacacacacacacccctcaaacaccacacacccacctcaaacaccacacacacatatccctcaaacactacaaaaacacacacacacacctcaaacaccacacatgcacacacacctgaaacaccacacacctgcctcaaacactccacacacaccacacacagacacgtacacagccccccgcacccagccacagcttacacgcacacagacacgcgtacgcaggagaaagggtgtcaaagcttttgctagtcgtgaaggaagagcccgcagtccatggggctgcacggttttccctgccatttgctcattcaccgggtgcccataacgctccgcgctcaggtctcttacaggagggcccgagtctcccagtaccggaggtctgggggcgcacgagccgctcctcctctggagaagctccggaccgagaggacaccggacactgcgcagcgccgagccccgcgcgcagcccgggacgcctcagccagggccgaccgcgcagaggaagctcccagagcccgtttcaagaccgcagccaacagcctcaggcgcacacggcggcctcggagcgagcacgcgcagcaacgcccctcgccccggcccgcccccggccccgcccccggccccgcccccggccccgccccgcaagggtcacaggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcagggtcggggagtatttgggtccggggtctcagggaagggcggcgcctgggtctgcggtatcggaaagagcctgctggagccaagtagccctccctctcttgggacagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctaggtaaagagggggccgcgcctcttccccgccccgaccctccatccctttcctcccaatggattgcaggggggcgggaaaaacgtctgtctctctctctagggaaggccacatttctgtctgtctcagggactctgtgacttgtcccgcagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccaggtaggaaccacccgggccctcagccaccctcccacctcccaaagtcccccagcccttgatgctcccgcagccccacctgccagcccagccctcacggcagctgcccgcctcagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcacgtaagtgatcttggcccaaccccctggctgcccgtgacccctacccagtgctaactccagtctttgcccccagcacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatgggtatgccagcagggcagctgggtgctccggccctgtcacgggccagggccctggaggccttgcagttcagctgcttgccaagaacatagtgggtgagggggtgccaggagatgctggccacgttgcaggggcccaaggtgtagtcaggagacacagtgcacagagagctggtcttggtaggcctgggaggtgccgggctcgtgctgggcacctccgggcaagctttgtgacttagaggtgtggggccactggtcaccctcggtggctcagaggctgtggctccatggctcatgagcgcctcctgtgtcccagacctgagaccatgcgtatgtcccgaggcggctgctccggtctcttgcggtgtggaaagggaacgacctacgagggcggtgtccgagagcctgccttggccttctggccaggtcatatcgctcccggtcagtccgcaggccctctccttggaaccctggccccaccaccccaaccttgatggcgaactgagtgactgaccagcctcctgcccccaggcgtgacccacgagctggccagctccctggacctgctgcctaccctggcagccctggctggggccccactgcccaatgtcaccttggatggctttgacctcagccccctgctgctgggcacaggcaaggtagggccggtgacccctgatcccagatccttggcccctgtcctggccttcccctggggtgagtgtgggcagtgcctgagagtctgtgcctcagtgcctcctgcactgagtggcatccaagtggcgccacctctcaggttcctgggtgggcaagaagcggtgcacgtccagggcctcccaccagggctggcagccccaggtatgtgcagtgcttggggcctgtcccgccccgtgacccctgactctgcccccagagccctcggcagtctctcttcttctacccgtcctacccagacgaggtccgtggggtttttgctgtgcggactggaaagtacaaggctcacttcttcacccagggtaacccctccccgtggatgcctccccccgacctgctgacccctccccggagccctagatccctggcccctcctctcgcccttgccctgtgcacagaattggccccctccccaggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtgacaattcgtccaatcctggggtaatgctgtgtgctggtgccggtcccctgtggtacgaatgaggaaactgaggtgcagagaggttcaggacttgtacaagatcacccagccagaaagaggttgggctgggatttgaaccctggtgtcgtggctctggaagctgccctggcgccttggtgatctgcgtgggtcagtgcacacaggcacacgtcagcctcaaggacatgggcacatctgttcacaggagcagcgccacgtgcctttgagtgccaggaacggggtgggagggtgggagggtgtgagggccagaagactcagaagatgcaaagtgcctgagagagacgggatattcccccagaagaagcattcttagagacacaggcactggacctccttggttcttataagaaacctgtctgaagctgggtgatgagttgcacactccaggtggggctaaggggcctggagcccctgctggctcctaggaaggcacagcagcaggccctgagacggctcctctggggcccctccaccctcccaggcctctgcatttcacctgtgcccacacttctgtctcctgccttcaccttttgacccactactaacgattctccacccagcagacaaagtgatctcttaaaaatatctgttggctgggcacggtggctcacgcctgtaatcccagcactttaggaagccgaggcgggtggatcacctgaggtcgggagttcgagaccagcctgaccaacatggagaaaccccatctctactaaaaatacaaaattagccaggtgtagtggtgcatccctgtaatcccagctacttgggagtctgaggctggagaatcacttgaacctgggaggcggtggttgcagtgagccgagatcgcaccattgcactccagcctgggcaacaagagaaaaactctgtctcaaaaaacaaaaaatctgttaggctgcacacggcgattcactcctgtattcccagtgctttgggaggctgaggtgagaggatgcctgaggccaggaattcagaccagcctgggcaacatagtgagaccccagctctaaagatttgtttttgttttttttttttttttttttttttttttttttttttttttgagacggagtctcgctctgtcgcccaggctagagtgcagtggtaccatctccgctcactgcaacctccgcctcccgggttccagggattctcctgcctcagcctccctagtagctggaactacaggtgtgtgctgccatgcccagctaatttttttttatttaatagagacaagatttcaccatgttggccaggctggtctcaaactcctgacctcaggtgatccacccgcctcagcctcccaaagtgctgggattacaggtgtgaaccaccacacctggccaacaatatttgttttaattagccaggcgtggtagcatttgtcctagcaatttgggaggttgaggtgggagaatcacttcagcccactaggtcgaggctgtagtgagctataattgtaccactgcactccagcctcggggacagagtgagaccctgtctgcaaataaacaaataaaacatcaggctgggcttgagcatctattcctgctcaaaatttcgcaggcttctcagaagaaaatccaaaccccttacagtgacccagtttgcccttgaggcctccacccacacccccttccccccagtcttagggggtggcctggctgttcccttcaacggcaacgctctgcctccattgttggcctcctctgcagggagggactgtctgagcacctgcccgtgtctgtgcagcatggcacactgacgtcaggcccacgtgcatgcccaggtggccagtcacacgccaggtgctccctcagtgttggccaagtgagaggagcacaccttccgggcgttcagacacctccccgtggcagacaccgttcgttgctaccaaacagccacctccttcctaatgggctcccatttttcagtgctgggcaaaggtcccttgatcttggagttgcagcctctttctctccaaggagggcggtgaccagcctgagccagtcaatccagtgattggttcaggagtagcctgtgaccaggagtcctggtagtgaacgactggggcagccctgggggtgaggaccttgcgcagccgtcacaggccctgattggaca

SEQ ID NO: 845 - DNA, 40908 bp, Human
ggtcagggccccaccttccctggaactggggtagtgagtaacccagcctgctgtgctccggcccccctttcccaagaaggttttttttttttttttttttgagagagtctttctctgtcgcccaggctggagtgcaatggcacgattttggctcactgcaacctctgcctcccgggttcaagcgattctccagcctcagcctcctagtagctgggattacaggcatgtgccaccaagcctggcgaattttatgtttttagttgagatgtggtttcaccatgatggccaggctggtcttgaactcctgacctcaagcaatctgcccacctcagcctcccaaagtgctgggattacaggtgtgagccactgtgcctggccaggacttgtctttttcttttctttttttttttgagaaggagtcttgctctgtagcccaggctggagtgtgatggcgtgatatccgctcaccgcaacctccacctcctgccttcaagcgattatcctgcctcaacctcccgagcagctaggattacaggtgtgtgccaccacgcccagctaattttttgtatttgtagtagagacagcgtttcaccatcttggccaagctggtctcgtgatccgcctgcctcagcctcccaaagtgctgggattacaggcgggagccactgcacctggccccaggacttgtctttcttaagcacagaagttctctgaatgatgcctaggacatggaaaggacattttaatacatttgctaatcaaagcatcataaatcttgctttttttccccatagataaaacatctttctaagactctgtacctctttccagagtgctgcacatttgagttagcttaattatagtgtagtgactttgatccaaacttgctggtttaaatcttggctcttccagccgctcactgtgtgaccttgggcaaattaattaacctttctgtgccttagttttcacatgttaaagcagcagtcatagtaatagtatttatcttacagtgttgttgggatggtgaaatgagtaaatatttgtaaatgccctggcacatggtagttgcaatattagtgtgcagtattgtttttatgattagaaataatgtcttcaaagtctcactttcctgctggtttgaatgtgctgtgagaacacatactgtcagttttgcctaccacaaatttgttgagtctcttgcaggtacctccaaatgggcttgtaattcaccatccccacttttcttttttttttcctttctttttctttttatttcttaatttctcccacaaagactgaaagtgaatccccacttttcttttatcttttaaaaattttatttgtgggccgggcacggtggctccatgcctgtaatcccagcactttgggaggccaaggagggtggatcacaagctcaggagttcgagaccagcctggccaacatggtgaaacctcgtctctactaaaaatacaaaaaattagccgggcgtggtggcgcatgcttgtaatcccagctactcgggaggttgaggcaggagaatcacttgaacacaggaggcagaggttgcggtaagtggagatcgctccattgtttatttgcatgtggacataagaaagggttaacatggccgacaactatttcatgagctttttggctttatttgaaaagtgaagtgtgtttggggaaggagttggttaggaaaacagatgcttccctttttgacttaccaaggaaatggagatccaaaggaaagcctgaagcactttgtggcttccacgggttcgtttctaggaagcttttgctttacctggggaaaccccaagctctacagtgagaaagttgtaaattagcctttaggagacgctgtttgtcaaagttatcttaaccctggaaaaggggagggaaaaaggcagataagcagtgatgacatcagcaggaaactagtatcaggctacccagtcctgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggtatgtaattaacaacccttcttactccagagtctcatgcttgaatcttttcctttgcttcatggcttcgtgttgtagaaacttgcaaaaatttgtcagcaatggcactattttttcttagatttctttgtcatgcctgggaaaacaaaagttaaaaaatccggaagcctccaacatagccttttaccggggcagaaatatgttagctcacagagacaaagtttggtagactcactaaaactagagatcagaattgtcaagaaaccacaaggcaaatgctagatgcggtagaatagaaaggtgtctccaataaaccactcatttgacctcagggctagtagcagggaagatcccctggattatcacattaaaaatgacatttttttgtttcttttaacaccaaaagtaatgtgtatgctcacatatgcataaaatttgagaaattcaattggaagcccagaaggaaatttgtattatctatagttatgtcacctcgatataaccactgtttgttatggaggttttgatttttgctgtgtcttccttcctttatttatttatttatttatttatttatctatttatttatttgagacggagtctccctctttcaccctccagcactcaagctggagtgcagtggcacaatcttggcttactgcaacttccgcctcccaggttcaagcaatcctcccatctcagcttcctatgaagctgggaccacaggcatacaccaccaagcccagctaatttttgtattttttgtagagacggggtttcaccgtgttgcccaggcttgtcccgaattcctggcctcacagtgatccacctgcctcagtctcctgaagtgcttctctgattataatgaaatttagtatgtagaataccatagtttatagactagtcagatggaaacattgactcatgtaatttttatcttccttcgctgatttgagcaactcttgtctaaaatcaccctttccttctgaggtctaggaggtttttttgttgttgttttgttttgtttttgaggcagggtcttgctctgtcacccagggtggagtgcagtggcacaatcatggctcactggaacctccatccccggggctcaaatgatccttctgcttcagccctctgagtagttgggaccacaggcgtgcaccaccatgcctggctaatttttgtattttttgtagagatggggttttaccacgttgcccagtctggtcttgaactcctggcctcaagtgatccacccgccttggcctcccaaagtgctgggattataggcgtaagccatgacaccccacctgttccttcctttataaagtattttcttgtttctaaaaatagccaagttctgcatattgactacatacctcaagtgcttatagaataaatagtattacaatgaaaattttatcactgcattgctcctctgattatgatgaaatttagtatagagaatagcatagtttataaactgatcagatggaaacattgactcatgtaatttgtttttttttagtgaaaacaagtttattagagaagtaaagaaacaaaagaatggctactccatagacagagcagccgactcatgtaatttttaacttcctacactgatttgagcaactcttgtctaaaaccaccctttcctcctgaggtctaggatattttatttatttatttttctttttgaaacagggtctcactctgtcacccagggtgaagtgcagtggcatgatcatggctcactgcaacctgtgctccccaggctcaaatgatccttccatcctcggcctcctgagtagttgggaccacaggcatgtgccaccatgccctgataattttttgtatttttagtagagaccaggtctcgccatgttgctcaggcttgaggtctaggattatgccttccctttctgtaagataaaggcctgccctcttacaggtagcagtctgaagttaagatgtaacacacatacctcacggtaccttgctgtctttgggttgatagatcataaggataaccctgcctcccccagattgctttgtgtctaaaacttaaagcatagagccaagtgctatttctgccacgtgctggaaatgaatgtaagggctccaatcaggctaccaggcttgagaaaaattgtgctgtgtccctccatcttaactttctctctctgggaacattttgatttgggagaaatcaaggtgaattgaattccaatataagcaccctccaagtttcctaaaaagtaacttgcaagtgttggggaaaagttttctgggctgttgctttttgaagtagcctcgccgtaatttttatttttcagcacttctaggaaagtctaatgcccagaacggagaaggttgtggtgaggggagggcctgggaagtcagggggccatatgtcctcactctctaactccctgccccacctctctgtccctttcaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttaggtgaggacgggtctgtggtggagatgggaggatctcccatctagtgttcattctggccattgggctttgaaaggaagctgcagttaagatcttttggttatctacctccttggatgataaaccaggagattctaaacctccttctcagcctctgatgctaatgagataagagttgggaggtcagcaaagcttcaagaccaagccctgggcccagaggtggcttccctttgttttgcttctcactagcagtgaagcccacctcagtgtggcagagcccgtgttttccctgcttaccagcggctacacgtgcagatcttctccctcctgggatccactagtctgtctacctgtttcccggggtcttgagaagagagtaatgcatacttggagtgaaataagcaagatgaaaaaagagatgtgtttctggggtagggagggatgtcatttatgccatgtctagttatagaaatttctatatttttgggtgggaatccagaaaggtaaaaacaggcattttgcccaaagaggtaaaatttaggcattggtcttatcatggatgacagcgttttatttttattttgagacagagtctcgctctgtcactcaggctggagtgaagtggcaccatctcagctcactgcaacctccgcttcctgggttcgagcgattctcctgcctcagcctcctgagtagctgggactacaggcacccaccaccacacctggctaatttttgtatttttagtagagacagggtttccaacatgttggccaggctggtctggaactcctagcctcaagtgatccacgcacctcggcctcccaaagtgctgggattataggtgtgagccactgtgccaggctgatgacagtgtttaaaattgttcactgacatagtgtccacatcagagaacctcacgaagaggagcctttggagggtgttttatggtctctgcgattagaacacattaagccttagcggtggaactggcttccagaacctgagttgcccttgagtcagtggaaggaatgatgaattccagaaatccatatttccattctgctggctaaacatctgagggacagtctctgacacataggggtgttagtatgtggatgaaatcctcactgtttctggttgtggattatatctcgaagctggggtagttttcttcccttttcaatatacaaccgactgtaccttggctggcctggggtcctatctaccaagggcctgtaaagtaagcctgaatttcttgatggaatcaggagatgggaaggcatgtcagaattgtgttttatgcctttttttttttaaatatgccttcttagtgtggtgaaaaacagcattagacttggagtcagaaggcctgcttctaccacttactgtgttatctttatttaaacaagtcacttagaaactgaaagttttcattttttgaacctataaatgggattaataattgtctacacatagagttgatcattcaaatgacagaaaacatttatgaaagcacttgattgattatggtgtcctccacaagtgtaaggctttatttgtcattttgggtgtgtgtcttagaaacctgctctacgaactgtcagaaggcattgactcagagaacttaaaggacatgatcttccttctgaaagactcgcttcccaaaactgaaatggtgagtgggtcatacagaatgggtctgtgtgagcactgtcttaatcaatgattagaaagatgctggaaagggtttttagggagatttattttttatgggagacagtatcatacaatggttacgaacattggctttggtgctggatgagcctagattctggtcctgattctaattctaaacccatgctgtgaggccaatgattgaacttttctgagtctctattttcttagacgtaaaattgtgggcaatcgtatgacttccttctaggattgttgggagaattagctggaataatgttcatgaagcattagcatgaggccaatatttggtatagcattcagtaaatgctcacttctgttggaatctgttgtgttttgtttttgtttttgtttttttttgagacgaagtcttgccttgttgcccaggctggagtgcagtggcatgatctcagctcactgcaacctccacctcctgggttcaagccattctcctacctcagcctccctagtagctgggattacaggcatgcaccaccatgcccagctaatttttgtatttttagtacagacagggtttcaccctgttgggcaggctggtctagaactcctgacttcaagtgatctgcctgccttggcctcccaaagtgttgggattacaggtgtgagtcaccgcacctggccttgtccagttttttctttcaagtgccttttaatctgtaggttagatttcctccctgcccccaaatctctttctttttcttaaaatgtatctgttgaagaatctctgggcggttggcctgtggagtttctcacaggctgagttttgctgattgcacactcgtggtgcagtttggcatgttcctctgtcctctgcatttcctgcagactggcagctgaatccagaggcttcatcagactcaggtcagatccgtttggcaagactataggtagtcttgttttttcatcaggaggtacctgattttctctctctttttctttgatattagcaactgttgatgttcaaccattttatatattgaattttgaggggttgcaaaaatggagatattagaatttttttttttttttgagatggagtctcactcttgtcacccaggctgaagtgcaatggcacaatttcagctcactacaacctctgcctcctgggttcaagcgattctcctgcctcagcctcctgagtagctgggattacagcagcctgccactacgcctggctaactttttgtatttttagtagagatagggtttcaccatattggctaggctggtctggaactcctgactttaggtgatccacccgtctcggcctcccaaagtgctgagattacaagtgtgagccaccatacccggccacatattagaattgtatcatttcgttttcccttcatccattatttggttacccagtgatacagcttatatgtgaatccttgattcttttctttcagttatttttttttttttttgagacggtgtctcacttggtcatccaggctggagttcagtggtgtgatcttggctcactgcaacctctgcctcccaggttcaggtgattctcctgcctcagcctcctgaatatctgggattacaagcaggcaccaccatgcctgtctaatttttgtatttttagtagagacagggtttcatttggccaggttggtctcaaattcttgacctcaagtgatctacctgcctcagcctcccaaagttctggggattacaggcatgaaccactgtgctttgcctagttatccagtttttaagttaattggtatcttatcattctctgaaggtgacccattacaaaatatatataaatttaaactcatggatttaaacatatgtgaggtatttcaatctactgcaattattatccttactgaagttcaaactgaggctgggcatggtggctcatgcctgtaatcccagcactttgggagtctgaggtggacaggtcacttgagcctcaggagtttgagactagactgggcaacatgacaaaacccggtctctacaaaaaatacaaaaattagctgggtgtggtggcgtgcacctgtagtcccagctcctcaggaggctgacatgggaggatcgctcgagcccagagaagtcaaggctgcagtgagcaatggctgtgccattgcactccagcctgggtaacagagtgagaccctgtctcaaaaaaatagttcaattgtcccattttttcccaggggatacatcttcagtttggttcctaagtcattttgacatgaccttagtagtctttgatggcttctttactatctggcaaaaatatcccaggttcatcttgtatattttctacccagtcctggaatctctcatttctcccaaaaatcctgacttcttttaatgagagatgtcatttcaagaccacaaactcgatgctggcatgctcattgcttttgagtaaatatatatgcacacactacgtatatacacatatgtatacacacacacacacacatgcacacacacacatgacctaaaggttcagtaattcttggagaattttaaaaatcaggcgattttgttttagggaattcttttttataaaacattgtaaggatcttctgcttttgccgtaaaatttcagtgcccacatttgcagtggtacaaagcaattacctgctcaaatggtagcattataccttaaatacagaatttctcaaagtcagaggagattcctgtagtttgacaagcgctccaggtggttttcataacattctctcccaagttggggcatccgctcacaaattttccagtgtctaggtttatacataaaatgagaccactttttattgttataccccgtcctatgttagggactctctgaacaatatgaggtggcgggtgagggacgagagaaaggtcatttgttaaagcaatctctgatattcgaaacactgagtgttagttttcaaacaagaaaagctggaaaatgtttttttttctcttttgcttgcacaggttctagaactctacttgaaggcatctgtggctacagaattattattattattattattattatttttagacagagtttcactcttgttgcccagtctggagtgcaatggtgccatctcggctcactgcaacctctgcctcctgggttcaagtgatcctcctgcctcagcctcctgagtagctgggattacaggcgcccaccaccacacccagctaatttttgtatttttagtagaggtggggtttcaccatgttggccaggctggtcttgaactcctgacctcaggtgatccacctgcctcagcctcccaaagtgttgggattacaggtatgagccactgtgcctgcccagaattatttttatggtcagaagcattccaaacatttcccccctactaaaatagcttttaaatgatcaaatgcacatgttcatgtggccaaatgatcttgtttttctcagtataacagtaaaaggaaacgtaactgtgcttagctgtggcatggaattgtgatattaccaggtcaaattcaggaaaaccatatttcctctttggattccaaatgatctcagcttttttttgttgggggcggggtggggagatctcattttttgtgtcagaattgtggctgagttacacacctcagataatccaggttgatctgtattggattttgcaatcagaccagcctttggaagtgtgtaaaggacagtctctaagcaacacagatgtttccacaccagggctcagtgaggctgcattatctgcaactgcaattgcaaaagaccttatcacagaaataaattacttacccaccattggaaaagggcctgaacacccctcagccaaaacggaaaggttctaaattcttacagtctctctggggaaacacaaataaccttgcctttgaggggcattctgggctttgtctttgatagctttcatagaaatgtaagcagtatagctggcctacacatatcctgagagatctcacaactgtcaggaaatccgttctcagcacagcaatcagcatacaacattgagtctaaaggaaaccacacctgaacttactctttaacaaaaaagcaaaaaaagaactttcagatgtttgctgctagtatttgccagagtggtgttaaactaatgtccaggtcccatttaagtatgtgcgtgtgtatgtgtgtgatgtactaaacatctaataaacttttagaaagtataatgaatttccgtaattgcttctggaatcacatcttagccctttattcctcctggtaggatgctgtcaagacatgagtttctggcctggcagggtggctcatgcctgtaatcccagcactttgggaggccaaggcaagcagatcacctgaggtcaggagtttgagaccagcctggccaacatggtgaaacccatctctgttaaaaatacaaaaattagctggatgtggtggcatgagcctgtaatcccagctactcaggaggctgaggcaggagaatggcttgaatggaggtggaggttgctttgagctgagattgcactactgcactctagcctgggagacagagtgagagactccatctcaaaataataataataataataataataataataatagctgaattgtgattttttgtttcagaaaattctttttcttttaaaatatcaaatataaaattctttcgaaacattttcccctcatttctttggtgtccctcttttgctggcttcctaagcagtatcatttaaagctgtgacttagagttcagtggttaataacatagactttggcatcagattgtaccagctctgccattaattagctttgtgaccttcggcaagttactggaatttctttgtgcctcaattatttcatctttaaaatgtggattataataatatctacttattcagttgttgtgctgttaatatacagcaagcactgtccctgttgcatagagttatatatatatttggtatctggtattaatatagattgtatacagatttgcttggtaatgcctcttcccctacattcctgagcaacttgagggcagatgctgttatatcttatttatcagtgcaaaacctagtgcctactggccatgcagataacatttgagtgagtggataatcaataggcaagtaaatgtaactctattgattctcttgtagacctccctaagtttcctggcatttctagagaaacaaggtaaaatagatgaagataatctgacatgcctggaggacctctgcaaaacagttgtacctaaacttttgagaaacatagagaaatacaaaagagagaaaggtaagtagcttgtgattgctaacttggaccagaccatggaaattcttaaaccaattggccatgcatgatgttttgattatttgttttgttttgttttgttttgaggcagagtctcactcactctgtcacccaggctggagtgcagtggtgtgatcttggctcactgaaacctccgcctcccgggttcaagtgattcttctgcctcaacctcccgagtagctgggattacaggagcctgccaccacgcctggctaatttttgtatttttagtagcgacagggtttcactatgttggccaggctggtctcgaactcctgacctcaagtgatccacccacctcggcctttcaaaatgctgggattataggtgtaagccaccatgcctggcccgtgcatgatgtttactcatcattctgataatattctgctaggaaagccagaaatcttccccttcgttcattcaacacatattggttgagttcatattttgtaccaggcactgttttagaagttgaggatatagcaaagtacagagcaaagctcctgccctcttgcaacttatattccagtgcagggaagtagttttagacaaacgtctttttctgattctaatatgggagtgagagtatagggaattattttaaatgaaataacatgaaaaagaaggcaggatagcatggggtaagagtggactctatagagtcggattgccaggactccacttactagtggtgcagtggtacttttttggcttttctatgtgtcactttccctatctgtaaagtgggcataataattgtacctacctcctaggtttttgtgaggattgaatgagataatttctgtaaaatgcatgtctggcatggagtaagccttctatacatgtggctattatggctctctcagagagaaaagtcataaagacttcacattctcagaaactactatcaaaaaagaactttattttctttgtgtgtgtgtgtgtgtgtgtgtgtgtgttttaagtctgtctgataaaggtagttctgctgtgatattttatacagatagaagcacagggcaaaagtcaaacctggctgccttaccacgtgtcagtacgctaaatatctgtgtttttctgagttcatttctccactgttaagcaagcgctatacataaaaactcatgagtgtattcatgaaacttttatgccacacccttaatttagttcagtgagtgactctagtgtgcaaatttcttggttgaaaatgaaactagctaagaggaaatgtctgtctaagaatttggttaacacagaatgagttgaggagcaaaatatactgttgtcaaactgataaaatctcaaacaataaaatgatgaataaatgcataatttaagttatgaagaataaaaacagttctttctatcatcaaattatcaaatgagaaataaaaagcagaaggttgatatggaaagaatatttgaaatcctcacatgagctctgagtttttttctaaacacattgtcatttttctgtaatgccatatcccatataaagtaaacatagggcaagtggtcatattattctggatatttaaattctaaagaagacacactagtttctatgtagttgattacatttgcctcagtgagtcttgaagactgagctttgttttttttatttttattttttgagatggagtctcgctctgttgcccaggctgcagtgcagtagtgtgatcttggctcactgcaagatctgcctcccaggttcacaccattcttccgcctcagcctcccaagtagctgggactacaagcgcctgccaccacgctcagctaatttttgtatttttagtagagatgggatttcaccatgttagccaggatggtctcgatcacctgacctcatgatcagcctgcctcggcctcccaaagtgctgggattacaggtgtgagccaccgcgcccggcttgagctttgttatttttatttttatttttatttgagctggagtcttgctctgtcgcccaggctggagtgcagtggcatgatcttggctcactgaaacctccacctcccaagttcaagcgattcttctgcctcagcctcctgagtagctgggattacagatgcccgccaccatgcccagctaatttttgtatttttagtagagatggggtttcaccactttggccaggctggtctcaaactcttgacctcaagtgatctgtgtggggattacaggcgtgagccactgcgcctggtccaggactgagctttatatcagcagagttctagttttgatttttcttttctacaacctacctgtgtgtgatctcttttgggtgtcaatcattattgatattttaatattgactttctttagttctaagagtttgagcctaattctgctgttaagatgaaagactaaaggactaaaaagagtaggtgtgcagactttagacttttctgtaagtgtgtgtgatccaaagtccaagctaggatactggctttatttaaggaccacctggctaactttctaagttgtcttgagccttggtgtttgcttcagtattttttttttcttttttttgagacggactcctactctgtccccaggctgcagtgcagtggggcaatcttggctcactgcaacctccgcctcctgggttcaagcaattctcctgctgctagtcagaaggtgatttttatttttctgtctgtgattttattttcagctatccagatagtgacacctcctgtagacaaggaagccgagtcgtatcaaggagaggaagaactagtttcccaaacagatgttaagacattcttggaagccttaccggtaggttcagtggtgtgctggtcaatgcttaacaaccggctccaccctccaacctcccctccctgccaccccaaaaaagaaaaagagagagaggccccggtttgtaccatttattgtaaatggtctcaccatggtgattgcaagtaaataacatgatatcaaccagagtgcacattttctgaaaatttaacagttggctgacactagctgactagtgagagctagttagtttgagttctcgctagttagtttgagctgactccccacacccctgagttgctctgaaatggttcctctgttcttatctgtgggatgcaattagagccagctttagggacatataatctatggagcacagggcgtctgatagtaattccacagttcaagtacagagcttttgtttaatgctctgctgttactgctttgaaattcttaatgtattgaacaagaggtttgccaagcatgtagctggccaacccagagggcaagggtttctggtttctgtggtgctcagctctgaaaggatgggtggaaggggaaacgttgggagaatttgcagtctgttcctcaccatgtgatcatgatccttgggagatatgtgacagtcttccctgggatttgtggttcttccagcagacttgggtaatttctttgccaacatctgtcagcatcaatgaagttagcttggtctgggaaatgttttgtttttgttttcaactgtgataaaatacacataacaaaatttaccatcttaatcaattttaagtatacagttcagtaatgttaaataccttcacattgttgtgcagacattaccaccatccatctccagaactttttcatcttcttttagtaaaactttgtacccattaaacaataacttctcattttctccttccctccaacccctggaaaccaccattctactttctctctctataaatttgacttttcagggtacctcatataagtagaaccatacaatatttgttcgtttgtgactagcttatttcacttagtgtaaagtcttcagggttcatccaagttgtagcatatctcagaatttccttcctttttaaaggctgaataatattccactgtgtgtatatacagtaagtcctcacttaaaaggttgatagatttttggaaactgaatttaagtgacagcatactgtataatgtatttatttttatttaaaatttttttttatagagataaggttttgctatgttgcccaggctggtctcaaattcttgggctcaagcaatcctcccgccttatcctcccaaagtgctgagattacagccatgtaccaccacgcccagccacataccatataatgaaaccaattttaccataggctcattgatataaacaagagttggccaggcatggtggcccacacctccaatcccagcactttgagaggccaaggcaggcggcttacttgaggccaggagttcgagaccagcctggccaacatagcgaaaccccatctctactaaaaataccaaaattagctgggcgtggtggtgcatgcctataatcccagctactcgggaggctgaggcacaagaatagcttgaacctgggaggtggaggttgcagtgagctgagattgcatcactgcactccagcttgggcaacagagtgagaccctgtctcaaaaaacgataacaaaaagccctaagagttaagtttctatagcatacagttcgttgtttcacttaaaggcggagttaccaagaacctactgatgactctgagtgaggactcactgtattacattttgttgtccactcatccattgatggactcttgggctgctgccaccttttgactatttttaataacgctgctgtgaatgttggtgtaaaaatatctctttgaaatgctgctttcaattcttttgggtttgtacccataagtggaaatggtggattatatagtcattctattttcaattttttgaggaaccttcattctattttccacagtgactataccattttacatttccaccagctgtgcacacatcctcagcaacacttcctcaccaagacgtattattctctttcatttttgatagtaggcatcctaatggaagtgaggtcctatttccctgtggttttgatttgctttccttaatgactagggctgtcgagcatcttctcatgtgcttttggcgatttgtatatcttctttagagaaatgtctgtccaagtcctttgttcattttctaattcggttgtttgtagaagttttatttttaattcttttttttttttttttgagacggagtctcactctgtcgcccaggctggagtgcagtggcagggtcatggctcactgcaacctctaactcccaggttcaagcgattctcctgcctcagcctcccaagtagctgggattacaggcgcgcatcaacacacctggctaatttttgtattttttaatagagacagggtttcactatgttggccaggctgatctcgaactcctgacctcaagtgatctgcctaccttggcctcccaaagtgctgggattataggtgtgagccaccgtacccggcctttattttttaattctttttttttttttttttttttgagactgagtcttgctctgtctcccaggctggagtgcagtggctcaatctcagctcactgcaagctccgcctcccgtgttcacaccattctcctgcctcatccttccaagtagctgggaccacaggcgcccgccaccacgcctggctaattttttgtatttttagtagagacggggtttcaccgtgttagccaggatggtctcaatctcctgacctcgtgatccacccgcctcagcctcccaaagtgctgggattacaggcgtgagccaccgcgcccggcctatattttattcttaaaaattcttttatggcttctttactattgtcatggtctgatatttttacagttacaatttttagatttaaaaataatttcaattttatagaaaagttgcaagaatgtgaataatataaagaatacctatgtactgttttcctagatttacctacctgttgttgatgttttaccccatttgctttattatttttgtgcatttactcacacttgctctctttctccctttctctccacacacacataatttttttctgaactttttgagagtaagttgcatacatcatggccttttactcctaaatattttcgtgtgtatttcctaataataaggatattcttttacagaactataacacaattatcaatgccagtaaagttatgttaatataatacttttatcaaatcaatggtccatattccaattttgtctgttgaacccaataatgtccttgacagtttttaaaccatctagtacaaaattccacataggatcctatataaatgcaacacaaggctgggtatgttggctcacacctgtaatcccagcactttgggaggccgaggtgggaggaccacttgaggccaggagttcaaggtgagcctgggcaacatagtgagaccctctctaaaagaaaataataaaaattaaaaatacaatataatacaatacaatattgtatttagttgtcatgatcctttagtctcctttaatctttttttttttttttttttttttgaaactgagtctcaccctgtcacccaggctgaagtacagtggcatgatctcggctcactataacctccacctcccaggttaaagcaattcttgtgcctcagcctcccaagtatctgagattacaggcatgcaccaccacattcggctaatttttgtatttttagtagagatggcatttcaccatgttggccaggctggtctcgtactcctgacctaagttatctgcctgccccagcctcccaaagtgctgggattacaggcgtgagccaccatgcttggcatagtctcctttaatcttgaacatttccacaacttttatgacatttaatttcctcttttatgccattgagacttttgaagaatgcagtcactcctcccacctttcattaaatagaattttccttatctttggtacatgtggtatttcctcataattagattcaagctgtacgttctggccagaatatcacagaagtgatgtgtctttctcagggcatcccatctggaaatacgtcatgtccatctgcccccctattcgtgatgctaattttgattatttggtcaagatattttctgatattatcactctgcagttaattttatatagttactattttttccccacgcaattaataagcaagtgctggagagacattttaagattctgtaaatatcctgctgcacatgaaaagtttccccctagattgagcgtctgctgatgattcttgtgtgatccagcatttactatgttggttgtaaaacaatgcttttctgactccagtattctctccacattcgtaagttggctctcagcattctactgtaaagaaggaccctcctttctccccaggaaggtgtttttgtttttttaaatgaaggagaccgtggaaactcgccagatgacctgtagctcctggagcttggcaaaggctgggcaaacgcccacctgaagactatgcaggcaatcaggacatgacacagagccgggagaggcctgctcttcggctctgccctgaacctcattcggcaggtggaggtatttaggcatttgagggaatctcagctttgggaggccactttgtaagtgatcttaagagattaagtacatccttaattaaaagaaatggtaacacctccgcctgcttgctgtgagtttattcatttgaattccccatctcccccaatgggaaataacacagaattgcaattatttataaaatcttaaattggcttcttttctctaggaaaatagcccttgattcaattaattccaatcctagaaaagcgcctagatatctgattgaggtattgagggagagaggctgctccccttgattcttttactataatccaattaaagcaacatttatgggccaactccctggccatgggcacagctttgtttagagagttgcaaatccattcccacctccccgctcccccagaagctctttattattttattttatttatttatttttttgagatggagtctcgctctgtcacccaggctggagtgcaatctcagctcaatgcaacctcagcctcccgggttcaaatgattctcatgcctcagcttccctagtagctgggattacaggcacccgccaccatgcctggctaattttttttgtatttttagtagatacaggatttcaccatgttgacttaaggtgatccaccctcctgagtctcccaaagtgctgggattacaggcatgagctattgtgcatggccatcccagaagctctttaaaatgtggttttccagcactgacattttaggattccctaattctaagttaaattgtctgctaaatgtaactcttcccacccactttttcaacttgttttgtgctcagatactgacatgcatgtagaaacacacacacacacacacacacgattctgctcgttgtctttgagaaattcagtggtttctaaaggggcatggctcagctgtggcctctgaagcgctgtggttccgctgacgtgggatgataacttggccacggccacatgcagtagggggatagtcgtggcagtactagaagtgcaaaggggactggggcacagcatctcacgtgttttcacagacttttaaggttggaaggtgtcttaaaagttatctgggcagccctttccctctccatcaaatgatgaataaaataaaacttggtgaaacatctcatgtttcttaagcacctgaggattttttttttaaatttaaaagaacactgccaataattgggctcaatgagaaggaactctcatcgaattttaagcaacatctcctaatatgtttaaaaattaaatttatttttttctcagccccctgcaacttcagcctcccaggttcaagtgattttcctgcctcagcctcctgagtagctgggattacaggcacgtgccaccgcacccagcaaattttttgtatttttagtagagatggggtttcgccatgttggccaggctggtctcgaactcctgacctcaggtgatccacctgcttcagctcccaaagtgctgggattacaggcgtgagccaccgtacccggccaaatcgatttttttgagtgtggcataaggttttcttaaggagaggcatgtctctctatggaggagacctaacacctgcttctttataaggccttattggacccctcttgaaaactatcaaaagaagttgaaagatgattcagtgtggccaggctgtgggacattcactcattcattcattcattcctctctgacatagagacttgagaggtgtcaacagaggatgcaacattctcgggagaagaaaggcagattagaccttaaagcttttttctagtccctgttctggctgactttatcagccaagggaagaacaaatcaaggaaagccagggcctggaggggctgggcagagcctgctgctgtgtctgcattgcccctaatcccagaagactcactcaactgctggacaaaaccagaaggcagtctggccaggcccttgtctgcctcttagaagaaatctaggattctacaggaagggaacagtggcttatgaaaagaaaggcaggaagccttttggaaagtgaagctaagcctcctttgcatttgttcctgcagagctgggggaacagctcttccccaacaccttggtcaggtccccttgggggctttctgctgaaggctgacggctgagagtcatagggggaagggggtgatggtgaatggggaggagggtacagaaaagacagggtcttagactttgttttaattttgtatttaattatataaaacattaatgtatgcccaaggtagtgcatccttgcctctcctccccacctcgattgccatttttatttgttttttgatttatcttattacttttgaaaaaaatccaacgtatatcttccctttattacaaaagaggtagtgcactcaaataccatttcattttgctttctccatatgacagcatcccctggagaagggtatagaggctgtccttggcatcttactccactatgtggacataccacagctttttcaatcacttcctattggtggacattaggctatttccagtccttagtgtaaataatgctgcaatgagtaagtacccttgagcatatgtcacactgtatttttgccagtgcgtctttgtgaaccttctcctttggatggagagagttggttctcttcccatttcctgccaatgaactttctttttttttttttttgagacagagtcttgctctgtcacccaggctggagtgcagttgcgcaatctcggcccactgcaacctctgcctcccaggttcaagtgattctcctgcctcagcctcctgagtagctgggattactggcatgcgctaccacacccggctaatttttttatttttagtagaggtggggtttcaccatgttagtcaggctggtctcgaactcctgacctcaggtgatccacctgccttggcctcccaaagtgctgggattacaggcatgagccaccgcaaccggcccaatgaccttttctgtggctgtggattagatatctgtccttccctgcatcaagtctagtttttgttcctcatcctaactgtgtgaaattcctatgtttcatgccctcctttcttttttctcagcaggagtcctggcaaaataagcatgcaggtagtaatggtaggtatttctaatgtactttttacaacttagatcggtatggtagggatagacatatttgatatataccaaggaattcaaggtgacttggaagagaagctttataaataatgaataattcattttttattccaattcaaggcaagacattgaatgcatggattgtactaggcttttctatggcagtatggagagggctgggtggtttctgctctgaatgcctagtatagcagattctagggactgcaggcggctgttcttcctccacccttcagaattaggccaccctctgtgcagcagaaacagcccccgcagggctgaagccttcaggccagtagtgacagcagaatgtgcagtctgggtgcgtgtcctctatggagtggttccagatgttgcttcagagggagagaagaagcaagaggagggacttgaggatggtgtgtttagttccctgaatccctgcccagaaaccataaccttaggaaaatattccagaatctgccatcaggttaaactgcttatgaacaaacaggctttggcgaagtctttctgtggtatgtaaagtttgtcacagaccattcctcatttttttttctggaaaattatccttcagagtccaagacacacagctttgctagcaatttgtctttttgcctaacacggaggttgtgtgctatgatgttggtgacattgaccaggtcaccattattaagcacttgtcacatactaggcactgttcagagagatttcagggattatatcatttattcctccattcactggaggtaggtaatactgttattctcactaatgatgaggaaactgagacccatgaaatctagtgctttgcactgcagctaaaaggcaccgcagctaaaaagaagtgaagctgggatttgaacccagctgtctgattccagagcttactctcctaaggccaggctatcccagtgtctatttatgtgagctcaggtgactgcttcacccctctgaagaataaagcagtttctttcagctttacaattctgcggttccaacatttagacgtgacttcccgtggagcattaccttctctcatggtgaggaggaatttataggtgctctgagccactgaagcgtggatcccttttgctgtattttctggtctggggaatatggacttgctcagcctgaggactgacccttagcagtagttaataactaactcatgccccagagacaaggacagagtttggtgggttctactacaaacttcctgtgagtggaaaaagaaaactgtttgatgttacattttcctgttagtgccatgtgacaaataatgcattgctgactttctctctgtgatagagtcttttccagaggaatcagggagttggcaggaacacttcaaagcagtgtgatcctcagtcgatgcccaactggaactttctttttcccctcttttttcttttcttttcttttcttttttttttttttgagacagggcctcactctgttgcctaggctggagtgcagtggtgtaatcacagctcactgcagccttgacccctcggactcaggtgatcctcccacctcaacgtcccaggaagctgggactacaggcaatgtgtcaccatgcccagctaattttttgtattttttttttctagagatggggtctcactaagttgtccaggctggtcttgaactcctgggctcaagcgatcagcccgtcttggcctcccaaagtgctgggattacaggcatgagccaccacgcccagcctccctctttttccttctctagggaagaggtccacctagcctctttatatccagtgacataaatgctgactcaatccaaccatacttgagctggaagccttgagctgatccatgggatcttaattaattccccacccaatccctgccagcagcatagtttccaacccagacaaagcaaaaaagaatgcgaagacacatcagtctctcccatcaggaagggcatggtggctgaatttgtctcaggagggccttgagagaagcataattctccagaattagatgcgaaaattatcagtgaagaaatctaagtgcttggggaagatatttggagtctgagtacctctctttctaggtaacagagccacaaatggtgcaccaagcctggtctccagggggatgcaaggagcatctgctaacactctaaactctgaaaccagcacaaaggtctggatggtttcttttattccttttttaataaaaaaattttttttccaaatttaatcaaaaggacggtttctttaggggctctctccctagggtccagccttcgatgattttaagggctccgagctgtttgtttcagacttgtttctccctctctctgtaattatctctgttcttcccacctttttctgtatcaatcagaagtgactgatccctttgactgtggaggaaatgctgttacactttgagtcatgcataccctttgggttatttctggagaggggtagtttcttttcttatccattgaagccacttgttttctgcttggataaagatgtaccacgatttcaaggatgattttagctgcccagaggctctgctaaagccagctcagctaatttgcaatcacatgctgtttacaatagccttaaaaaataattgcacatgtttttaaattcctactgtgaatatatatatatattgaattttaaaaattgaatatacagccatctttatatacatatgaatatatatcagccatctttatatatatatgaatatatatgtgtatatatatactttatttataagtatactttatatatatatacttatatattaagtgtatatatatatatacacacactcatatatatattcacatatatataaagatggcggtctcactgtgttgcccaggcttgtcctgaactctcaggctcaaggaattctcctgcctcagccacccaagtaccaccatgccagcttgtatattatttttatattcagaaataaaattacaaaagatttcccttttttgaaggcattagatcactccagaaatgaaccatctgaaaaaaatctttgatatttatgttgtctcatgaaatccttgtgtatgctttcttcattcatgttgctaatatgaaagtgaagatgcttttgcataaaccctgggtttgacaatattaaaatatatattccattttcttaactgtcatgattgagcttctccagccaaaccaggtgaagtctgaattttaatcaggatctggcatttcaccttggaattaattagctaattccacactagggccaggatcttgagaactctctgcctctgatactgggagtggcatcctgaaagaaaggaactgtctaatctttagtgcaaatgagatttatcctttgtcctgggctctaggacttaaaaaagaatctttgaaattttattcagatcacaattgtgcagtaaaagtgagttgcagagtagtcagaatccccagtttttcaatatgtgacttcagaaataatgtggcataaataccccaaggggtttagactagagtataaaaacatggttttggacaggcatggtggctcatgcctgtaatcctagcactttgggaggctgaggtgggcgaatcacttgaggtcaggagttcaagaccagcctggccaacatggtgaaactctacctcaaccaaaaatacaaaaattatcggctgggcgcggtggctcatgcctgtaatcccagcactttgggaggacgaggtgggcggatcacaaggtcaagagatcaagaccatcctggccaacatagtgaaaccccgtctctactaaaaatacaaaaattacctgggcatggtggcgggcgcctgtagtcccagctactcgggaggctgaggcagaagactcgcttgaacccaggaggtggaggttgcagtgagctgagatcacgccattgcactccagcctgggtgacagagcgagatgctgtctcaaaaaaaaaaaaaaattatctgggggtgttggtgggcacctgaggcaggtggatcccttgaatccgggaggcagaggttgcagtgagccgagatcgcgtcactcactccagcctgggcaacaagagtgagactccatctcaaaacaacaacaacagcaacaacaaaataacaacaacaacaaaaacatggtttaaacaactggcatggggagatacatcctgctcttcctcacagtggatccattggagtggttggttagaaacatttaaggccctaagataaggattcctactaagtggctctatctattcttcaagagggcagctgtgtacaggatgaatcggaaccacagaggcctctgtgtcattgtcaacaaccacagctttacctccctgaaggacagacaaggaacccataaagatgctggtaagaaagtctggaacagtttatcaaatgcaaattggggatcttaaaattattttttattttcacattttctttctgtgacttttatcttccatatacgtgtaaggatgatatcatgtttctgagcctcttatatatccctggggagtcatcagtctgctaaagagtggcaagaatctttgactattcacaattctgaatagaggagagcatgtactgggggagagcctgctggattggcacgagacaacttgggcgtgagctccagctccaccactaactaggtgtgtgatcatgggagagtcaagagaccttggcttcttcaactgtgaaacaggatgaaacactggccactgccgattctcaggactgttgtgacaacactgggtattacgtgataggagattcattgtaagattttatggttatgaaaataaaaataatccaaagctttaggctatttgctgtgcaaattttgtaactattagcattgtttcagttttttttttctttgagacagagtcttgctctgttgcccaggctggagtgcagtggtgcagtcccagctcactgcaacctctgcctcccaggctcaagccattctcgtgcctcagcctcccgagtagcagggattacaggcgtgagccaccacacctggctattttttgtattttcagtagagatggggttttgccatctggccagactgttctcaaactcctgacctcaagtgatccgcctgcttcggccttccaaagtgctgagattataggtgtgagccactgtgcccggccttgtttcagttcttcattttgttttgcatcattttattatttcccctttctctctctctctctcttttttttttttttttgtttttaaacagagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccatatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggtgagagctcttttttttcttccatttgtaattaattagttttatttattttttattttactctcattcaacacctttggtaagggtgagagttctacgttgttctatccatgtacctgttcaaccatctgcctaccctcctgtttatctatttatccatctatccacccattcatctatccatccatctatccacccattcatctatccatccatccatctgtccatccatccatccatccagcaaccttgtattgagtaccagcctggacctggaaaggaagatacagagttaaaaaaagacagagtccttgccctcaggttgcttacaagctagagggatagacaaacaaatagacggggaagggcatccccagctggtaagtgcacattgtgaagtataggtgttatgggaacatgcagaatgagtaccttgcccagatttgaaggatcagaggaggcttctagaaatgacaaatagatgttaggtaaagaatcaggtgaaagatgtgctgggcagagggaatagcatgaacaaaagcatgggggccttttatttgttcgtttatttatcactcactcttacgtcctgagcacctatgtgctatctttggacttctatttgccactgctctgacagcttcccttctgtctctgccacatgctgtcctcttggcacctttagccatacctagaggccatgggctcctccatgaaaacgtctccaaagttgccatctctggcccactcatctctgaattcctgggggcagagaccctgtttcattcaactttatatcctcagcccctgacctgatatattgtgagcttgttaaacatttgctgggccaatgaatgacttgcttgagcctgtctcattaacatcccgctagatatcctacctctgtttagcccttggacctcacattcagcatgcatgtttctgagctcatcttcccagctctctccaggagctcctactcctgaatttccatttgaaggaatggccatagtgctcttctgggaattcaggattggaaccttgagtcaactttgcttttctctcttctttaccagcccctccattctcatcacagacatcagaggctaatgtctatggcttcaggaacaaggcaatatttattgagagcgtactatgtgcttactgtactgggtaccgaactggggacagggggtgcaactgtgtacaagagagacaaaatctgctctccagggagctaaaagtccagtgaaggaaggacagataataaaaatataagtgaatatttaaattattattattttaaaaattcaacaatattaaaaggagacagtatacatgcatgattaagcaatgtgtggttttttttggtactccagaaatttctgttatttttaattgatacttcataactacatatttcagggttataatttgatgtttcaatacatatatgtgttgtataatgatcaaatcagggtagttagtgtatccatcacctcatgcatttatcatttctttgtggtgagaacctctaaaagcctctcttgtagctattttgtaatatacaacaccttactgattgatcgattgatttaaatatgggatctcaccatgttgccgaggctggccttgaactcctaggctcaagcaatcttcctgccttagccttgtaagtagctaggattatatgctcaaaccacagtgcccagctcagaatgccttactgttaaccatagtcaccccactgtgcagcagaacaccagaggttatttctcctatctaattgtaactttgtacccattgactaacctctcatcttcccttccctccttctctctctcatctttgtaattgctgttctaatcactgcttctatgacatcaactttttaaacaaagattccacatgagtgagaacaagcagattttttctgtgtcttgcttatttcactctgggctcattcatgttgtcagacatgtcaggattttctttttttatggctgaatggtattctgtcacgtataaatatcacattttctttatccatatatccatttttggacccttaggttgattccatatcttggctattgtaaataatgctgcagtaaactgggagtgcagatatctctctgacatattgattgcattttctttgtttatatacttagtatggggattgctggatcatatagtatttttatttttcattttatgaggaactggcatactattttccataatggctgtactaattttcaataccaccaacagtgtgtaagtgttcccttttctccagatctttgccaatatgtgttttcttttgtttcctcgataatagccattctaacttgagtgaagtagcatctcactgtgggttttttatttttatttttatttttttttagacaacatcttgctctgtcaggctggagtgcagtggcgcaatctcagctcactgcagcctctgcctcctaggttcaagcaattcttctgcctcagtctcccgagtagctgggatcacaggcatgtgccaccacgcctggctaatttttgtatttttagtagagacagggttttaccacgttggccaggctggtctggaactcctgatctcaagtgatccacccacctcagcctcccaaagtgctggtattacaggcgtgagccacggcgcccagctgtcactgtggttttgatttgcatttccgtgatgattagtgatgttgaggggtggaagcgggtaagtaggaaaactcccaccacaactatagtgctagagtgaagtagggctgagactggggttgggccttccaaggcggaaggaagtcaggggtggaggccaagttgggctgattttcctgctgctgctaagagaaaaccaattaatggaagaaggttgggggtagggttaaggataagtatttgttgaggctctcatgtattggatgatgagaggaatcatgctatagctaaaataaagccaatgtcaccaatgcgattgtatagaattgcttggagggctgctgtgttagcatctgcttggccatgtcatcagccaattagtagaaaagatataattcctacaccctctcatctgataaagagttggaaaatgttgttggcagtaactagaattaatattgtggtgaggaaaataagtaggtatttgaaaaactgattaatgttcagatctgccttcatatatcatattgagaattctataatagatcaagtgataaatagtgctactagaataaacattatggagaattagtctagtttgaagcttaatgagagttttagggtttggattgttattcaatatcagtttgagatgatggtttcttggtctgtacacataaatgttgtgggaatgaggctaatggtgaaagtgcatgcgacagctatttttacatagtatggatatgagttctttttgtgagggttgataaaggtaataataattggtaaggttaaggagattaaggttattatagtaatggaaaaatacatgattattacttttatttggagttgcaccaatatttttggttcctaagaccaatggataactctcatcctctaaaagttgagaaaactatgttgttaggcatggaggcatgagttagcagttcttgcaaactttatcggtaaataagaagttgcggacttctattattagaccacaatctaacattttgattaaactatatttacaaggtataagtcctataataattttaggatttagagatagtaagagaattggtgaaaggtgtatgagtattagtatgttttctcgtgtaaaggaaggtttaatgctgttaatatagtatgttagtgttccttgttgtgttgtgacaagtatatagagggaataaagggctgtgattaatatattaagtcctataagcatgatggtagtgtttgatcaggagaatgaagccgttgttacaaggagttctcctactagattaatagtggggggtagggcaaggttggtgagatttgctgtaagtcatcaaaaggttactagtggaagtaatgtttgacgtcctcgagagagtaatatgattcagctgtggattcacttgtagtttgaatttgctaggcagaatagtagggacgaagtaagtccatggggaattatgaggataattgcactggtaaaacttcagggggtttgaatgaggatagccacaataacaagtaccatgtggcttacggaggaatgtgcaataagtgactttagatcagtttgtcgtagacagatggagcttgtcataatatgcctcataaggataatatcaggaaaggataggctatatgttctgtcagagggctgaggatgagggtaagtcgcattttgtgtagccgcccaattttaggagcactgctgcaagtactattgagccagccttaggtgcttatacatgggctttgggaagtcataggtgaagtcagtataggggtatttttactatgaaggccattatacatgccaatcacatgagattgttggatcaggagattggtagttcttgatattaaatgttattattatcatgctcagtgagcctaggatattttgggcataaataagtgtaataagtagggggagggatcccactagtgtgtaaaataagagatatgtacctgcattgaggcgttctggttggttaccccatcgggtgataataattaagatagggataagtgtagcttcaaagagaatataaaatataattagttctgtggctgtaaatgctatgattagaaaaatttgtagggaaattaatatggaaatacagggttttttccataggggtgattcactggagaggtggtactggcttgctatagttataagaggtagtagtcaggctgttaagattagaaggggtgatgttagcggatcagaggagaaagttaatgagaagttgaatagattgtcgttgaattagttaaagaataatagggcaatgaagctggtgattaggctgtgggtagccatattgattcaaattgtataatttttagagagtcatgttattggtagtagtataattgtaggaatagttatttttagcattgaagtaaatttaggttatgtatgtagtctaagccatatatgttggaaattgaaagtagcaaagcaaggcctaccctggctttgcaggcagcaaatactggtagagtaatgggtattacatttgctagggtgaagtgtatatttaaagctataagggtatttactatgaataatgataatattattccttctaggcataggagggatgatattaggtgggactgatagactaatacccccagaagtgatatgataaatgctaatatgatacttatgtaaatagagggcatttggtaagtatgttctatcataatctaatgaaatcatttattttgccttaaactacttatttttttcttatacctgtggaccatttgtatgtcttcttttgagaaatgtctgttaaagtcttttgcccatttttaaatggggttatttgtttttttgctgttgagttatttaagttccttatgtattctaaatattaactccttgtgagatgtataatttgcaaatttttttcctattttgtaggttgtctcttccctcggtttttttttttttttttttttttgccgtgcaaaagggttttaatttgatgtaaactcatttgtctatttttgcttttgttgtctgtgcttttgaagtcttgttttaaaaatccttgcccaacccaatgtcatgatatgtttgccctgttttcttgcagcagcttcatagtttcaggttttacatttaagtcttacacattttgagttggtttttgtttatggtgagaggtaagtggttagtctcatttttctgtgtatggatattcaattttcccagcaccgttttttgaagagattctcttttacctattgtgtgttctgggcacctttgtcaaaaatcagttggctgtaggtgtgtgaatttatttctgggctctatattctgttctattgatctatgtgtctgtttttataccactaccatgctgttttggtaactctagatttgtagtatattttgaagtcaggtggtgggatgcctccagttttgttctttttgctcagcattgctttcactatttggggtcttttgtggttccatatacattttagggtttttttccctatttatgtgaagaatgtaatttttttgtttgtttttgttttgttttgttttagagatggggtcttgttatgttgtccaggctagacttgaactcctgggctcaagcaatcctcccacctcagactcctgagtagctaggactacaggcatttgccactgcacttggcttgtcactggtattttgatagggactgcattaaatctgtaggtcaccttgggtagtatggtcattttaacaagattattcttctaacccatgaacacgagatatctttccatttatttgtgtcctcttcactttctttcatcaatgttttatagttttcagtgtttaatatttaagttaatgatattttaattgtttaatatttatttaataattttattattcaattattatttaatattaatttaaataatatttaaattaataagaaaaaattagccaggtgtggtggcatgcacctgtagtcctagctattagggagtctgaagtgggaggattgcttaagcccagaagtttgaggctgtagtgaactacaatcgcattaccgcattctagcctgggcaacagagcgagatcctgtctctaacaaaaagaggcaatttcaggaagtgatccctgccatgaacaaatcaaaacaggataatggtagtttcttggtggaggtaatatttcaggtgagactaaatgataagaaggaaacagacacaggaagatttgggaatagagagcaggtgcaaagcaagatgcagggattgagagcaggtaagggcctgcatcccttccctgaaaaatagtgatagttaaggatgaggggatgagagtagtcatactaatactaaaaatgatggtcagcagaacagtgtagccagtgttctaagtgcttgacccaatatacatcctttaatgctctcggcaacccctaagatggggactgttatggttcctattttagagctgggaaaaccgaggcatggagcagtgagtaaccagcctaagagcacacaatgaatgaatgatggagccacaatttaaaattgaatgtgttttcagaacctgtgcttgcttccagtgatatgtattgcctaccctgagaacgttctgctaaatgctatatgtcctgcaagcccaggctcaaatgctaccatctgcatgaagccttctctctccctcccaaccagaaatgcattctcctctgaacttgcagtggaaccttgacctttcatttggtgttgaccacattctgccttgtgttatgaatattgtgtatatgccatcctcggtaaatgtttcatatctgcattctaagtggttaacttcaggaattgtgtcatgtctatctttgtatctctcccaagactacagatagagagggcattgttggtatctgtggcatctgctgcatatttgttgatctaagacctggtacatggtacctggtgtcttttctaagacctggtgtgtggtttctacctcctgactgaaaaaagtttcttctctgggccaggcacagtggctcatgcctgtaatcccagcactttgggaggccgaggtgggtggatcacctgaggtcaggggttcgagaccagcctgggcaagcaatatggtgaaaccccatctttactaattagccaattgtggtggcaggcacctgtaatcccagctactcgggaggctgaggcatgagaatcacttgaatccaggaggtggaggctgcagtgagctgagatcacaccactgcactccagcctgggcgacagagtgagactccgtaaaaaaaaattttgttttcttctttgttgcagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctagcctcatgcatttcaaggaaatcacttcttttctaacagcgagcagccagaaagagaagagagtaaaatacagataagacagctctggcatagagggaggtgggggggtgggggaagtctcttgggtaactgccaaactttgccttcatacaatgggttccaggaaaacaatgagccttaataagcacattcctttcccttcaggtgcactaagtggggaagctaaaagcagactggaggggggtggggtgtacctacagctgcagaaatattgtatgggaacggacacacaactctccctcccagataagcacagcaaagagacatagaagcaatccaagcctctgataaactctcccaccctaaatccttaaaaactcttagtctgtaagtgagtgggctctgacctaactcggccagaagcccctttcaaatttgttttctctaaaataaacctgtccttggctgtcaagccacctttcatgtttctttcctctttctttaattcttacacatgtgtcaggatgatctcccaaaaccgtgttcataacagtcagggccaaaagctagtggtcacagtccttgtccagttggcagaactgacatgtgaaggcaagtgaaggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcacacaaagcctgtttggttgtctcttcacaaggacgcgagtgaaacctccttcatcaggagcatttggggtttgatgtttaagttttgggcctctggtgtatttcatatttctgttttgctagaacttagtgcttgtgcaaggttaaattctagaatcaggaaacgttgtttttaggggccttcagcaagcacttcggaggtccctggacgtttacagctgtgagtcgtggatctacccagacatcagaacatagtcatccttggctcattcctcctccgtaggaggggtacacagttggtagagtgtgccctccaagatttcgtgaaacattatgcttgtctgtatttgtgtgtgcatgtctgcgtgaattttgagttcaggaataacaggtgatttgatcacagctatttgacagtggtga

SEQ ID NO: 846 - DNA, 8238 bp, Human
tttaaataataataacatagatggtgaattacaatttgcacttttggttttatttgcttaaagatagtgttttactgtctaggttttactgaaagaatacttaactaaacacttgagtcaaatcattccagtgtaacagtcctcacaaggaggaaggcagaagggcaaaagtgccaagctattgcctccagcccttctatttttattgattgactgattgattgattgagacagggcctcgttctgttacccatgctggagtacagtggtgcattcatggttcactgcaactttgaacttctgggctcaagtagtcttcccacctcagcctccaaagtaactaagaccacaggtgcatgccaccatgtttatttctttaattttttaaattttatttggacatgggggtctcactatgttttccaggcaggtctctaactcctagcctcaagcaatcttcctcctcagcctcccaaagtgctgggattacaggcatgagccatcatccctgctctctctagccctttttaaagtctctaatcccattcaggaggcctctgcattcatgacttaatcacctcctaaagggcccaccttttgatactatcacattggtgattaaattgcaacacttgaattttgagtgacattcagaccacagcattttggagaaaatgtcccctttcttctcttttttctcttcagtttctcctttctacagataccttgcacttcacttgcaaccttgttgaagtctctcctgtcttaaaagtttcttttcccaaaacaccagaactcattccttctgtctaactgtaactttgtacttgttaccaacctctacccatttctacccctgactccccagcctctggtaactcctaacgtactctttacttcgatgaggtcaacttttttagattccacatatgagtgaaatcacgtaatatagtccttctgttcttggcttatttcacttaacatagagccctccaggttcacccatgttgttgaaaatgacaggatttcatgcttttttatggcggaatagtattccatcatgtatatatatcacatactaattaccctgatttgatcaatacacaatgtataggtgtgttggaacatcatgctgtaccccataaatatgtacaattattacgtgtcaatttaaaaaacccaagaaaagtattttttcttagtgttgtttttttctaaagtgtatcccattttttcctttgttttcactttcaaaattcttgaaagactgttttaatctgcggcctttgttttcttgtttccaattcattcttttgaaatatggcttctacctttaacactctgctgtcctcttgaaggttattggtgccctactaaccataaaacacaataatgctctcttagattgtatcctggtgagcctttttgcaaaattttattctttgagaattctctttccatgttttcttttcttttctttttttgtggtcattttggcttataggaaatcgtactctccaaatgttctctatgtcttctatttcttctctgataatccctttactaaatcttcttgaggcatatgcttcagaatgcttaatttacatactcttaattccttcttaatttacacactgcctgtcggcaatgtcaacacccaataagaagggagacctattggtcagaacaggccagggaatagaagaatacataataaacagtctgcctagttcttctagggccccataatatgtcaaacatatatttttacttcttctcccagcccatttttagtatacctaaattactgtcagtgattctgcaggcaaacaatggttgagttgtatgacacaactttgtgaaagtatcctacccagtacctgatgatgcaaaactcttctatcttgattggttgtcaatctgaggagtttccaatcctggggaagccagaaaaacagcgatttatactcttaatgggtactttctgactgaattttatgagctcattctgaagaggctgacgattttactatctcatttttttcctttctccagaatgggttctgggtgggtcccctgggtggtggctctgctagtgaatctgacccgactggattcctccatgactcaaggcacagactctccaggtaagaacagagcaattgtttttttccagtgtgtatgcaagaattggcatgggggagtgatgcctttctttgtaagtccaggccacagaccagactggaagtggcttttggtttcaaagaacagtgttcttccctttggcagaaaggtacgccttgcctctttacatgggatggacttcatataccagagccacctattcaaggggtagggaggcaggaagagggaaacattgtgtcttgtttaggatccttattgtgtgtatcaacctcagtcagtgcctgggcgtgttgaaggccttggcttgggttcgagcctgctgggagaaacaacctgcagtaggctgggtcacagaggcaatctgtgattttttggtcaggacacggaaacaaatctcagttggggtatatgtggacaaatgaaactggaaacaaaggttgctccttctgtcatttattaagccactattatattgtcagaattgtactaaacagttttgagaagtaagagaagttgaatagaatacattgtccttgtcctccggctcaccaggtacaagttacttgtaactgttatttttctagcacaggtgacagaatatgcagccatgaagcaatgtgagatgaaagcacatattaatgagcagaaacaggatgtaatgtgctaagaacagaatcccctttgcatgttagtttcattaaatacaaaagaggaacaaacctggccaggagagatcattattcttagagaatagaaaccgccctgagtttataatgtccattaaacaatacaactgaaaaaaaaatcagcacagatgttaaatgatgatgaaaaattcagatttcccccctggtttagactactagaggaaatagagaagagtatacatgctgagaaattacaggctggaacttcatctgaaattagctactgagtgagggataagtggggttcacccaggaaggtcattcttatggctcagttcagagttggaggaggcttctgaacttagaaaggaaagtaaattacaacccaacattaatagcaattatctttcaagtcttgacttagatgcaatgtcttcaggacgtccttcctgacttacctacattattaactccatttgaatttcctttttattgtagttgttgttcttaagtgcataggattggtttaattttacccaatgagttcacagcacattgtaattattggcagtagtgcaagactctctcgtctcttctcttgcctccgttctcattctctcccctccctagagaatccattctaaacgtgtctggtatgtctctaagtatgagagtggcttttagaaatatgtagcattattgctctttatgtgtttttaaaatttaataaatgtcattctctgttgaatcccattctgtttcttttctcacttgacactgtgctttttgagcatactgaggtcaaaggcctcctcttagatccatgtggtctgacgtaatttaccaggcatgggttttcccagaggagggggctggttcatggttttggttttggttttccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaaggtgagctggaagctgaggtctggcggggctcaggaatgtcccccatgtgaacctggccatggctcttctttcttacaagcaattttctgctttaggataaatggttgtctgtgtagatgttctggccccagctgtgatatattatcctcacaagtcagccactgtgatcttggtctcagacccccaaggttctcagggacttcgagggctattgtaccctcaaagagaagcagtaattgtgggagtacctcagaaagtctaaatcctcctgacaggcattgacataccctgttactgatcttgggggctgagacttgcctatactttgtgttcacttgggtgatctgggaaagagattagacatagtgatagtccctaaagaatctcctgtcccagcttggtggttttctttcacggtgtctcatttttcctcccttcctagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagtgagaattagtttctagtactctctgggcctgactcaggactatactgactcaatacagagcctgtgtcacttctgcgtttatcttggtcacaacatgaattattctttcccttgatctgggacagtcacagaaaccagagtccttgggttagggtgggagaaaacatggcagatatctatcctcatatcttccaagaaatgaggagatctaatcacctcattatgtgcttccaaccctatgaactggtgtcctctaattctttggtcttagtatttaggaggcattcttatgggctgtgagaatctgtaaccgatgggtggtaactccatgggtgccaactttggtttcgaagaaccttttctaaatttatttatttttctctagctagcattggatttggtgtctagtacagattctgggattccaagaaagtgctttaaatattgggatatttttactaatttaaagacctgtttcccataggagctcagtctgaatattcttggagaaagatgctgagtggcattgcagccttcctacttgggctaatcttccttctggtgggaatcgtcatccagctaagggctcagaaaggtaatgagcctgtgaggagtgccctgccacctgtcccagaccttccccactcccaccttccctaacgtcaatgatctgaggcaaggaaagctgattgtgcctctcagggatcaccgggataatttttttctgaagctagaaatgggataagcagagagagtgctgaccttgccagccatttgttcttccctcgggataatcatattgggtcctaattggggcaatccattcttttctcgatttctttccaggatatgtgaggacgcagatgtctggtaatgaggtaatgtctctttttccttgtctttgagtggcagatcattctcccggttctttggccagagggagatgacatgggggtagggaggagtaaggttgctgctgtctggatgggactgtcccctgagtctctggaacggctgtggggggtggtgaggctgcctcctgagaccttcatcactgtgcctccaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgtacattttagtgaattatttaagaaaaacccctgtaatcaagtcaaggaacaggactttgccagctccagcagaagtctctgtacgtcaggccaatcaaagcctctccttcccctcgaaagtgaccatatcctgattttattgtaacctctttcatgtctttgtagtctagtcccccaggtatgtgttcctggacgccacagcttagttgtcttttacgtctcttatacttcactggtttctcccccatcagcctttttttcccccttatgattaatctgttgaaaagctcaatccatttgacctgtagagtttcccacactctggattttgctggctgcatacacatggtgcagtgtaacacatcctctgccttctgtgcctcccgcaaattggcatctggatgcagaggctggatcagactctggttcaatcttttcctttggaaaatctatacgtggtgttgtggcctttcaccatgagagacataatttccagctgtttctttttgtgatgttagcaaccattgatactaattgcttaggtttgttaatttattggggattgctaaatggtggtattctgtcattttttcttcattttatgctttattaatgctacaaagagacagttcccttcatttactagtgaagagacacttccctccacttactagtgggctacttagtggtacagtggaaaggcaggatcagtgtttgacccccgtctctactaaaaacacaaaaaattagccttgcgtggtggcgtgcgcctgtagtcccagctactccggaggctgaggcaggagaagcgcttgaacctgggaggcggaggttacagtgagccaagattgtgccactgcactgcggcctggtgacagagcaatactccatcttaaaaaaaaaatcagtcttctctatattacttctgcatctcctttcttttacaccaagaactctggttttcaaggacacagggacagacacaattagaatgtccatacttatttgcttttcctgagttaacatagacagcagtctaaggataataacactaatactacaaccaccaaaatggctactgaaaacggttgaaattctttttacctacattctccctattacctgtgttctccctttttacctatgttctcccccgctttctagttgaactatgtctatattagttgatcctgtatcattgcatagactacttactcccttgttagtcttagttctgtgagtagagatatgtttaatgctcaccatcattccttatgttgatatccctgtcatgtggtggttttcaaggtgtggtccatggatccctgggggtccctgggacccttcaaggggcctatgaagtcaagctatttttgtactaatactaagatgttatttgcctttttcactgtattatttacatagtggtacagaaatctatggtggtcacatgaaactgttagtgcctgagcacaaatcaaggtggtgacaccaagctgtacaggtaggtcatgttcttcactgccataagcttacagttaaaaaaaaaaaaaaaaaaaagcaaaagccagtgactttgatgaagcaataaaatcattagtttactaaattttaaacctcaagcacacatctgtttaatagtcagtgtaagaacataggcagcatttctggtgcatactgatggaaaggcagttgtcctgtggaaaagccattatgtaattgcatgagttgtgagtgaagttaaacattttttttttagtgggtcatcattttccttgaaagaatgactgaaaggcacactgtgattattcagacttgggtatttggtagaaattttctcaaaaataaacaaaatgagcctatcccatcaaagaaaataatattgacagtggaaattggaatttcaagagaaaattaaaattttggaaaacttacgtgtgccacagcttctcactacttaaagatgtttctgatgagattggtggtgatatta

SEQ ID NO: 847 - DNA, 12470 bp, Human
cccaggggcctcagtctagtgttgggggaccagttaccaaggggcagctgctgagatccaagtgtgggactaggctcccccacccccactcctcataaacagaagagagaactctgggaaatcacctagtcggaactacgttttctttttctttttttggagatggagtctcgctctgtcacccaggctggagtgcagtggcacaatctcagctcactgcaacctccaccccctaaattcaagctattctcctgcctcagcctccctagtagctgggattacaggcacccaccaccacgcccggctaatttttgtttttagtggagatagtttcaccatgttggccagatctgtctgttcaccatgttggtcttgaactcctgacctcaagcgatccacccgcctcggcctcccaaagtgctgggattacaggcgtgagccaccacgcccggtcacatattttattttaaaaacatttttagcagtttttttgttttgttgagttttgttatgttgcccaggctggtcttgaactcctaacctcaagcaatcctcctgccttggcccctcaaaggagtgctaggattacaggcatgagccacggtgcccagcccagaactacattctcattgaagagaataagatccagcaaggcctacagagcatgttggaagtgtcctgagagccaaagcccatgattcctccatatcaggggggcactgggtagagccaggaaggaagggggagtccccaaggcccatactgtggaccccattatacagcttccatatactgaggctgcagaggaggtatgggcctccacttacgtgcctctctgactctgaggtccagtcagcaaggccagatcccatcctaagacccttatggccctgggagagcagggcataacacaccttcctctgacaccatcttgtcgctgatagctcaggagaagcacatggaagaatggtcccggccgggcgcggtggcttacgcctgtaatcccaacagtttgggaggctgaggcgggcggatcacctgaggtcaggagtttgagaccagcctggccaacactgtgaatcctgtctctactaaaaatacaaaattagccgggtgtggtggtgcgcgcctgtaatcccagctattcaggaggttgagacaggaggaggttgaggctggagaatcgcttgaacctgggaggcggagtttgcagtgagccgagatcgcgccactgcaatccagcttgggccacagagcaagactccttctcaaaaaaaaaaaaggacagtcctttcccacaaagggtggcgccccataacatctcttgtaagtgccccacatctcccctctggtcttccacacaatcctggtctctgttctccacatggtgggcccccaggccacctctgggcaccagccactgagggtgttgctactaagtgcaaactagttccaccgcaagcaaagagcccagtgtcctgccccccttctcgctgcgaaccagtcggtagtggggggatgggatgggacggctcagactggctcacctctctccaggccacaccatgcacatccacccacaggccgctgagaaaaaggcgccaagacgccaggtgaaggtacaggagccaggcctccaagggccggaagagtcggatgggcggagggcctgggctaggccaagccttcctcgcggccccgcccccacggcccgactccgcccgcccagcccggcgccctcgggtcggctgagcgctaagcgccagtgtacagcggcggctggggcggcaggtgaggcggctggggcgttgctgtcgtgcgtccgcaggcgtcaggtgctcagacccgagggccgggaagggatttgggtttcacaggaacctggggcgggggtccgctatcttggggctgtcgggaccgctgcttaaatttggcccagtccagacctcgagtcgggcccccagccaggcccacgcccaggtccaggcccaggccggtagggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctgccagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcgggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccggtaagctgaaagaaggggcccttacttgtgagctgcatgcacatggctgaacacaggctgcttcccttccatcactgaggggatctgggggcgcggtgggggggcaggcggaaagaagcattctctctcacccagttcctaagtgctggggtggtgtgagaaaccagccagacaaaggctacactggaggcttagctcccaggctggcccttgtggctgcctcattttgctctttcccctacctgcccatcatggcctctggttttttaggtagtttccctggctatgtgaggatagggttacataaccgtgtctctgttagcatagctcctgaatgctgggtagaatgatgggcattccctcctacttgtccaccacccatatcctcagggacacacgcagaaaaatagcactcccccctcccctcccccacccccgccaccaccaccaccaccacgcacaaatacacagggagatgctcacagattcacagactcacagctgcttgccaacagtttcactttcccttgttttgctctgctttccaaagggggtgggacgggagttgtcagagaatctccccttcctccacaccccctccccccacccacccccatccttctgccagccaccacgttccagggagcctcctgggccttggaagttgggagcttgttagggagcctgcatgtcctgggcttcactaacgtttttgccatgattgggggtgattgggggagtacccagaactcatggaatggcagcttggttctagaaggttctgggagcctcactctagtcttgtgcaagcaactataaacatctggggataagtaaaggcctaggaagggctggttggaattggtccatcccagacttttttttttaactgtatttggagccctaccccaggcaggaagtctcaaagcctgtgctgaactgggggctccttccacagactctatctaggttctctccagccatcgtgtaggcaacagcagtaagattggaccaaggaatgggacccacagctactgttcttagattctctagctatcatcctgtggccctgggcctgctgtgacattctcgaaagactcctttccgctcctattgatgcctcggagatgggagaacttacacccaatgtgaggttgggggtctttagcctccctccctctgctgagtacatctgggttgagaggccctagggttggggactccttgtctgggcctgggcaggcctgcctggccccttctccttcccaatggggagtcagaacctctccccagcttgcctagtggtcagtgggtcagaagacacccagcacggctgggcagtgccaggctccaggaagactaatcttggtccctgctcacaggctggccaggcccccaggaggtgtgtgaatcaccccgtgcagtgtttgcccagcaactctgggcatgcagccactagggcagcacccacatagtggttggcctcaggaggcctgagggactcagagctggtgcctgtcctccatgggacattggacacttacgtgttttcaggagctgggggcccctacctaagcctgggaacgtagagctaaggtcctggggctagggacaagcaggctagggtgtgggcctgactaaggtagggctctattccccttcagagccccacctgtccctgagtcatgctagaaacacctggcagccttccggctcgggccaagccaagccgatttcctgcctcaagtgaggacaaaatcccagtccccacccaccccaagctgtaggcacaaggtgtatggggtttcgaggctcagctccacatctacttttgcctccagggctactaatcagtgctgaggtctcaggactgggttaagcctctgtggtctgatggagccttcagaggctcctgcttcgaggagtgccctccgggctggtgagagagagtcctaagcacctagggctggctactgagccccgtctgcacctcgcactcagctccaacaccgcgagttcataccctggtgtactggtttcccagagcttccacagtcctcccctggagcgtgattgcagcccccaaaaacacccccttgctaaaagcaggggagaggttagtaccccctagcttccagaacttagttctggcacccaggctgtaggggtttggtttatcccttttgtaccctgaaggggggtataggaagcagccaggagtacaggcagacctttggagtctagggagaaggaccatgtccccaaccttgtgctggccaattaactccagcattcagccccttatgcaagtggggaaaccgaagcccagaggagacagggtttgctgaagtgcacacagagagtcagagaagagccagcagggggcaggagaagactcttgcggagctgagacttccaactgggctctcctcttgagggtctatgatgccttggaccagagaccaaacctcttgagcctgtttcctcatctgtgagatgtacggggtgggccaggcaccgtggctcatgcctgtaatcccagcactctgggagaccaaggcggactaatcacaaggtcaggagttcgagaccagcctggccaacatcgtgaaacccccatctctactaaaaatacaaaaaattagccaggggtggtggcgagcacctgtaatcccagctactcgggaggctgaggcaggagaatctcttgaacccgggaggtgttgcagtgagctgagatcacaccattgccctccagccccagcaacagtgtgagactccgtctcaaaaaaaaaaaaaaaaaaaaaaaaaaaaaaagatgtacggggtggttgtgaggatggaatgggggtaactcaccatcaggatgggcatggcagggtggggcagggagaatgaggagtggaccttccagcctgggccttctccctgcccttgctacactgagagccctgtgggggcaatgtgggatggtaaccggcaggcccagggccttctccagtcaggccaggtgaggggtgagagtgttgggctgctgtggccactgacaaaggccccagagggtcggggcacaaggctgaaccctgactccttcccttccctgacctttcccagcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtgggtcctcatccccacagtcccctagccctgggtccttgtctccatccccattttgctcacatctgacctgtcctaggtggagctggtcaggtcactaaactacttgctgtatgtgtccaacttctcactgggtgacagtgggcagcccgtgcagcgggatgtcagtcgtcttggggaccacctactctttgcctctggggaccaggtgaggtgggcaggggcagggcctggggccagggttgtgggatcacagactctccatccaatccagggaggcattgacatacaggccctaccaccctagcctactgtgtaccgggagggtctatagggcccaatctctccctccaggcacccctgagtcacctgtctttcacccacaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgaggtatggcttccctggcagggcacaggtaagagtgggacaggctgggcctggggtggtggtcagcaagtcttgatcacaatttttctcaggtctggggggtgtccttcatatctacaaggagggcattcttgtcagaggggatgccacatgcaaagacttggaggcaggaaagtgcttgaatgcaagtgactccaaatggctggagcgtggggaaggcaaggggtatggcaggagactttggggaagcaggtggggctgagagagcccaaccccacatgaggactcaggctgtttcccccatttcagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcaggtacaatctggtccctcccctccctttccctgaagggggaaaccaagcagccccttccccatgagaccctgttctctgcttatcagaggcaaggggggatgggggaagctgcagtggttctgactgctttttgagagtcaaaaaggtctctgtccctttttgagctttcatgtgcccttcctgtctgttcactcatggaccagccaaggttaatctctgccccaccagaaccttccttccatggagggaggcatgggtggagaaatgccattctctggctcagaggagccctgtggcttgtggcaggcatgcatctaggcctgtgtaattcctggctgacctcaggggttcccctggtgccccagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggtgaggctaccttgccctgtctgtgcccttggccagtgcatggtacgggaagggaggggcttggagtggaggacctgcctaagccacctctatgtcctcttaggagccagtgctgatagcagtgcaacccctctttggcccacgggcaggaggcacctgtctcactcttgaaggccagagtctgtctgtaggcaccagccgggctgtgctggtcaatgggactgagtgtctgctagcacggtaagtaccaccaggcaggcatgggaggccgcagggttctatccaggtggggacccggattctgtcaggatggagggaagagtgcttgttacatggtcagtgtggtgtggagagcaggtccaggaagaaaagactactgccctcttcagcccagaggcaagagagcccatcacagagtccaatggctccagccaaggctgtggggaacctgttccctccttaccctcttgggatgtcttcctgggaccaccttattttcagacagaccatggagtggggcaggtgggagagataacagacgaactgggagaggtcaacaggcccctggaagaagtgggcctggccatcacaaagagggtaaccttgagcccaatctcttgttcctgtagggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatgtaagcactgcctctttgcccactctggcctctggggaatgagagagccagctttggagaacacccaaagcctaccaccctaccctcttccacagcaactcccacatcaccatctgtggccagcatctaacttcagcatggcacttagtgctgtcattccatgacgggcttagggcagtggaaagcagggtgagtgagtgctggccaggagggaggaaggctggatgagttccctgagctgcagcccaacctcgtgctgggctgaggcgaggagcaatcacaggtggggttcctggctaatcactctcatattggtcccagcagtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgaggtaagtgtaagggataggggcagggacagttggggatctgaaagtaggggccagcctactggctggtcctcatgaccctctctgcagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtaggcagcccagctggacctccctgggaaacacgggcagagggcctacaggctgggcctgagttgccacctgcccccaggtctgcgtagatggtgaatgtcatatcctgggtagagtgatgcggccagggccagatggggtcccacagagcacgctccttggtatcctgctgcctttgctgctgcttgtggctgcactggcgactgcactggtcttcagctactggtggcggaggaagcagctaggtgagttctctgctcctacctttaatcagcccctacccccaaccaatggcatcttcaagtccctacatcctctctctgcccaggacttagggatctaagtcctccccagaggggtcggcccctaggagcttggaaagccaagccaccaaggattctctttccacagttcttcctcccaacctgaatgacctggcatccctggaccagactgctggagccacacccctgcctattctgtactcgggctctgactacagaagtggccttggtgagatagtggaggcatgagaagctaaagccaccccctgtccctacaagctcctcattccctctccccacagcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggtgtgggggccaggtggggctggggcagagatggagtctcaagatgacataggctaggccaggcgtggtggctcactcctgtaatcccagcactttgggaggccgaggcgggcagatcatgaggtcaggagatcgagaccgtcctggctaacacagtgaaaccccgtctctactaaaaatacaaaaaaatattagccagccatggtggcaggcgcctgtagtcccagctacttgggaggctgaggcaggagaatggcatgaactcgggaggcggagcttgcagtgagccaagattgcaccactgcactccagcctgggcgacagagcgagactccttctcaaaaaaaaaaaaaatgacatgggctaaagggacagttggaacagatactgctctaaccttctcaccaacctgtgtgaccttgggtataccacttaacctctctgagcctccatttgctcatctgtaaaatggggatgagaaaagttctgtcttcagtgggttctggtgtggatcaatcaggcataggaagattgtagcctctgccatcaagtggctgctgtttgtttttggttttatttatggttttgtttttgtttttgtgacagggtctcactctgttacccaggctggagtgcaatggcacaatcatggctcactgcagcctcgacctccccagcctcaggtgatcctcctgcctcagcctcctgagtagctgggattacaatcatgcaccaccatgcctggctaattttttgtttattttttgtagagatgggcctcgaatcatgttgtccaggctggcctcgaactcctggactcaagcaatctgcctgcctaaccttcccaaagtgctgggattacaggcatgagccaccgaacccagcctgttttattatatttattttattttatttttatttttattctattttattattattattttttttgagacagaatttcactcttgttgcccaggctggagtgcaatggcgcgatctcggctcattgcaacctcctcctcccgggttcaagtgattctcctgtctcagcttcctgagtagctaggattacaggcgcctgccacaacacccggctaatttttagtatttttggtagagataggatttcaccatgttggccaggccggtctcgaactcctgacctcaggtgatccgcccgcctcagcctcccaaagtgctaggattacaggcatgagccactgcccccagcctattttattttattttattttatttttttttttgagagggagtctcactctttcacccaggctggagtgcagtggcgcgatctcgactcactgcaagctccgcctcccaggttcatgccattctcctgcctcagcctcccaagtagctgggactacaggcgcctgccaccgtgcccggctaattttttgtatttttagtagagatggggtttcaccgtgttagccaggatggtctcgatctcctgacctcatgatccacccgcctcagcctcccaaagtgctgggattacaggtgtgagccaccgcgcccggcctattttattttttcaagatggagtcttgctctatcacccaggctggagtgcagtggtgcaatcttggctcactgcaacctccccctcccaggttcaagcaattctcctgcctcaccctccctagtagctgggattacaggcgcccgccaccacacctggctaatttttgtatttttagtagagatggggtttcaccatgttggccaggctggtctcaaactcctaacctcaggtgatctgcctgccttgatctcccaaagtgctgggattacaggcgtgagccactgtatccagcctatttatttatttatttatttatttatttatttatttttgagacagaacctcactctgtcacccaggctggagtgcagtggcatgatctcagctcactgcaacctctgcctcccggattcaagtgattctcctgcctcagcctcctaagtagctgg

SEQ ID NO: 848 - DNA, 17557 bp, Human
  misc_feature (1)...(17557): n = A,T,C or G
ggaggtgggaaggctgaggccagctgcctccattcgggggaggaccagggaagggatggggccatgggaggggagcccagggtggccgaggttggttccgaaggggaggttgagggggaggctgaggtcgggcctcctggggctgctctttgcccagcaggtggcctgtccagccccagggctctgctggctctgaggacaggaggccagatcctggccccaaaaggccacagataggttccttcactcatccagtgtgtcccatgagggaagggcccgccaggagaggggccaggagggcatgggcgaaggtgttagaggggtgtggactgatgccaggcgggcaccagatggagcctgggagatgggcaccatggcaacttgcagttccggagagcgctggctgctttggagggcggggcctgttgagtgcctcgtgagcccctgcctgtgttcctgccgttcgggtatgagaacacagcggggcttacccggtgtgcagggtgtccttacacgcatgacacgcacgcccgcacatcctggaaacctcgcctgggatgacatctgttcacggccctacccgttggctcgtctccacatgcggcagagctggtttccttccccggtgacccaggtcttgctttgctggccgccccctgcctccttgtccccacggccctgtctggtcctcactccaagccgtcctggttccctcttcctcgtgtgtggggaacaacctggagacctgagcaggaagcctaggctgccctcactgtcttctagctcacgccacctccaggcagccttcccagatgccccattagcctgcagccctggcagagcatgccaggtgaggtcagctgtgccacctcgggcagccctgcccacactgaccctgtttcttggctcgtccagtggggtagagatgacaacacctttgggggtgtgctgggccaggagatggggtgttgaggggtgttgggagctgagaagttgcaggtgctcagtggcaaaaggcactgggggtggccggaaaatctccagggccaagtggagggcagccggacagaaagctcctagggaagggcatggattggagctgggtgcggtgggacggggcaggcccaggggatagagccagcgggtcagtgtgccctcccctgcccaggggacaccaaggctggcccccaccatgccatcctgtgggcagcagatggaccgagcttcctcaaagcctggctcagctcaggtgtcctgatttggaagccgggctcagctcaatactccgaagttgggagggatgctgtactgtcagttcccctctgggatgaggggctccatggaccagcagctgcagaacggggtttccccatggttcccaggacagaagcagcaccagaggggcctggcagtgggtttggcaaggggacggattcgaggcagcaggtggcacacgggagccctgctgcctggcagaggcagcaccaccttctcagggacagtgaggtccccgcacctcagaggctggaagggccttgagcccccgctgtccagagcctggtgtgtggccagcagatagcagccagcaacatggtctcccgtgtttgacagagtccatgttcccttcccagccccagaggggcaaggtggggtgactgggatctgggagggagatgggggtccccctgtagcccctgagaccctgacctctcaggggtatctgaaccccagaattgggaactgggcaggctctggtcactctgccaaccctatgtccccctggcgaagccagggtggtgtccagtggctggctgcaggactgcaggctctggccacctcctcgccacactgtgaggtgtggggtctggggtgagaggtcagggtgctgaggcccagcctggaatgcagcaagtccaggtggggctgtggagcccagagcaggggcaggggcctggccggccctcagccatggccactctcaccacactgctctcccgcagacggcgccccgctcagcgagctgtcctggccatcctccctcgccgtggtggctgtgtctttctccgggctcttcgccgtcatcgtcctcatgctggcctgcctgtgctgtaagaagggcggtatcgggttcaaggtgaggcctgggggccgcgggagctgccgtgggatcccgcaggcaaggcctgtagcgtccacttgaccctgagcttccctccttcctggggccatcaaggtggctgctgggtggccgtagttgctgtggggccacctggggaccacgtggaccctggcccagggactccatagctcctcctcagggacctgccccagcttcctcgactttgaggccctctgtggggggcgtggtctgacgctcccactccagcctggggttgggcccgagcactcacggaggctgaggacagccttgcagggggcgtcgggggctctggagctggtgtgggagggggcttgcctccctagaggcccgactcctggtggaggagctgcctctgcaaggggctctcacgtccctccgaattcaatctgcaaaggggagtccgggctgcccagacaagcttcccggcacagggaccttcttgccagttggagtcaccttgcgcggggtatcttctgccttctggaggggacgatgtgtgatgctagagcccagcctgctggttagggagccccgccaagggtgaggcctggcctcactaggctgcccctctggaggccaaggcccctggccaaggacaggtgccaagcactgctcctccccctgcaaacccccagcccacctccagctgtaactctgagcagcagggagggccaggcagaaggaaccccggccagcatcgcctccccctcccagagtctccatgggtcccattcctgctgatgagcaaatgacaccctggcctggacctctggtggttcacacgcccacgggggtcagccccacccctgggccagaggtcagattcctacgccaggagaagtcagggagggaggagggtgggaggaggcattctgcagcgcgcacagcaccctgtctgtatctcagggtgccttcctactaagtgacccatgactcagctggcgccacccccatttgggagacagtcccagagtcctccctgcccctggtatgtcatgacgcagaatgggccaaggagctggctctgcccacctgtcccgctggcctggcaggtgacggtgctggatgtggcctttttgccttttctaaaggccacattttccagcccattcaaccttccagagccctctgaagtggccacaggccccatcaaccagtgaggagctgcgtgcctggggggcaaagctgtggccccaggctgtggggtctgcactcctgcccagagcccccaccctgctctgggatgtacccctgacccgctggcaccaggggccaggccaggccgcgcaggcgccttcctggggatcccgaggccagagcctcaaggtcttggcgggagcaggagtggaggtggggcctgggtgggacgagtggggctattgtataagtggcccctccttggggcactgtaagaacaaggccccaaacaagggctggccatagctcctcctcctgcgccctcctcacctccttgggaacatggtgcccggaacattccagcaccagtgtgcccctgggaagtcctgcctccacactgggctccctcctgggatttggggacctgcgctgggctccctggtggggagctgtgctgagggaaggggctgggcaggcccccaatgctgaccctgtgctacctgattgcacgctgtatcggcaggacccggctggcccccgggcagcaggtaatgcctggagcccgggcccgaccccagggagagacagcatctgtgtcctgggcccctctacaaagcccagatgggtggggccaggccggggctgggattggagggcccaagagggggcttctggggtggtcttctgggtcccggggaggggaagttgcccacgcagcacctgcgtcccccatccctgagtggctgtgtgctccgaaagggcaggctgggcctggcctgcgggaataccgacagagccacctgcccctctctttgcagcccagggaagggaggcgtccccagggtcacacgtagtacttgaggagcccaggcctcccctcccactgcacctgcctgtcctcggactcaccagcccgggtgctggccagcatccagctggaagtcccttgactcctctgagcctcagcttccccaccagggcactgggggttgtgaggagggacagaaaggctgtaccaagtgctcagggattggggctgtcattgtgtgcctggagcaattgctttcagctgggcccaggactttggagactttggctctcagcgcaggaatgtgccctggacttgggggtggggtatcccctatacaggtgcggcctctacatttcaaaatagcagcctggcagggagtggcccagccctaggctgcacggggccaggctcttaaggagttctgggagctccggaggtggtgtggccaccaggtgaaggtccaaggctgctggggcagatggcggtggcaggtgggctgcccagggtaaaggtggccggttggctctgggctcccagacatccaggaatgctccttgtcccggcaggggtgggggcacttaattgcttctcccacaggactgtggggcagggggtgatggaattcctgtccccgaagctgcgccatgggagggtgggaccccaggcacagcccggggtgaggggctgctcgggatgtgggtggctgagaggtgctgggggctgattctggatgggcagggccagctggcctgagtgccctcacctctgtcccttggttccctgcctctagaccctcaggccccaaggtggggctcagcctgggctgcccgccagggagggatgggggaactgaggccaggctgaggcgctggtgcctacagctcatcgcgccctttctggagtctgagatgggtcctcttggctctgggatctgcctctggcccctcatggaacaactgagcctctggtcgggggcgtgggggtcagcaagaggagacagatggaagggcagttagcaggggtgctgggccattggcctgcaggggcggtggctccaactctgggccgagcaccccctcctgccctgccctgggagctcggccctggaagaaaggggcctttccaggcccagccacacccttccttgacctgcgagaagccccgctcatgcccggcccggcccgcaggagtttgagaatgcggagggggacgagtacgcagccgacctggcgcagggctccccggccacggcagcacagaacgggcccgacgtgtacgtcctgccactcacggaggtctccttgcccatggccaagcagcctgggcgctcaggtgagggctgggtggggagatggggtggcctccctccggggcccaggtgctgggcgttgggtgtgatctggggagaccggaagactcagctctggagtaggggcagcacagggctgggagtggcctgtggggtagacgcagtgtgcagccctggactccctgtggctgcgtcacaggccgcactgtggggccaaaggtgcatgtacctctttctcctgggcctgggggccggccaggggttggcagggtccaggacagccctcggcctccagcctcccctgcccaaggggctgctatgcacagggacaggggtgggcacggggcaggggtgggcactggggcaggggtgcgggctctctggtcctggacatggccatgtgctgggggcaggggctcttctgcagtccagggatgcttgaccccagattcctgcccccttgagcgccagcccttcagggacacgggttccattgtgcatggcaggaggaggggcgctggtggggcccgtgtgggcgggtggtgaattagcctttcactcaggctgcgaggaggggccgaggggtggggctgacccaggagtgcaggtgcaggcagggcctcagccacagcctcatctgcccccatcctagggtcctaggccgaccactcacatggggcggacgtgctggggagtttgggggtgaatggccaggcttcaggacctcccagttctgtcttggagcctaggtggtgggtgcgggtccctccagagctatcagatctcaagccccctcccaggaagcttccagcctgaggcttcccccatcactgcccacccccagctcctctgggaacacagaggcaggaggggtatcaggccagtgggaggggcccctgccagccctgttggggctctgttggcaccagggcctgttactgcggtgccatgcaggccacctcacctgctctgagccgtgcctggctggaccctgagagctggctatgaactgtgcctggctgggccctgagagcctagccttcatcgtgggctgagaggcccaaggcactggtctgggacctagagagggcccccagcccccagctttggagccaaggcctcaacgcctgtcctactctgccccatctcctggaggacaggttcccagttcggcaggaatcagggctggcacttgagctcgagtacatctgtgggcgggcgcggaggactgcagccacccactcagagcgtgaggccctcggaccttcccggatggctgtgggggtccctgagccctgtgctgaccctgctgggagctgccagggaccatccgagggggtactgcccttgggtccaggggcaggtgtgtgcctggcccccgaagattctcagagccacctctggaggattgctgtggggactggggttggcgaacaggagcccgaaagaaggcactggttacctgtctctctacttttgcagctctggtttcagttttctgggggaggaatgtgcttctagggaggagagagattggggtgaggtcagaaaagtagccccagaggtcagcggggagaaacctgggcaatggccccacccgctggggaccgcagagaaggacggctgcctgctgcctccggcagtgcccagggcctctgaactgtctcagcacccatggtcaggacccccacacttgctcagggacagtgtgggcctgggcgccccagggtgagagagggccgcccagacaggctgggctcaggacacagcacccggtgggcccacacgctcaattctgccctgccccgcctctacattctctgggtctccaggccctggaaggagccccctccccctgggctctcctggcagccaggctcagacccaggcctgtcagccctctgggcagttgacgtgggagcagaattcggggaatccctcggggcgtgggcaggcatgagtgggctctgccagcgctggccccttcgtcccgggcctcactgacccttcctcccgctgacctcacccggcctggccctcggggagaatgggccagtgtgctccgtgcggggccgtgccaagcagcccccaacaaaggagcctttggtgcgcccggcgtgggatgccagcctgcggcagggtgggggtgggccgctccagtgccctctctgtgccgtggccccagcctcttgctcagccacactgcctgcctggtgcagcccatgtgacgggtcgagctccgggccctgctgtccctggccgggctatcccagtggcttcaggcaccttctccagacctacccagaaagatgcccggatggatcctgcagctccgtggcttttctgggaagcagcggcccctgctctcaagagaccctggctcctgatggtggccccaaggttgccagctggtgctagggactcaggacagtttcccagaaaaggccaagcgggcagcccctccaggggccgggtgaggaagctggggggtgcggaggccacactgggtccctgaaccccctgcttggttacagtgcagctcctcaagtccacagacgtgggccggcacagcctcctgtacctgaaggaaatcggccgtggctggttcgggaaggtacgtgtcccgcctgggagggaggactcccgcctgggaggcagaagggacacagggctgcagacctgctcctaggagccaccccagccccgacggtcccttcttcagtctctgggccctgctggacccttccccagggaggtcctcagcatctggctgcatccccttctccctagggggtcctggggtcagaggtacctggggaggggccctgggagggagaggagcagcctcttgctcatggccttcccctgaccttggcctaaacgagacacctgggtccctcttcctcacttcaaacccccagagagagagagagagagggcagcgggggaccttgtggggagagtaacacgaaagactcagaatattacagccagagggttgccgggagggatccggaagccatacctcacgctgcaatgagtggacggggcacaggaggagaagtgtcctgtcctgggggccggcgtggggcgggtgggagaagagtaaggcctggaagccggggccggtggaggcggagcagccgtgggtgatgctgtctgtcccacaggtgttcctgggggaggtgaactctggcatcagcagtgcccaggtggtggtgaaggagctgcaggctagtgccagcgtgcaggagcagatgcagttcctggaggaggtgcagccctacaggtgggaggccaccgggcacaaaggcctgtgctgtgcggccccctcctctccctcccctgctcggcccgactccccctccccacctcctcccaagtcaggggccgcctgtccactcccgcagggccctgaagcacagcaacctgctccagtgcctggcccagtgcgccgaggtgacgccctacctgctggtgatggagttctgcccactggtgagctgctgcccggggggatgctggggtctttgctgagccggggccctcccttgccctgccagtgtctggtgccaccccctccttgggggcctcacatcctccctaaagccaagacccagggaccctgcccccaccaccttccagaggaggcgatggggagacctagcctcaccagggagggactgtgggggctgggcacagaacaggcctgggctggggctccctgcacccctggggagctgccagctgcttggtcacctgcttgtgtgccctgtggttcaggaggaggcatcctgggccaacttggggggggcactggcccacttgggctccacggcctcactcaggcttgcttttgccatggggggctgggcctggccacttccccaggctgcctggagttctgggcctgcccatcaacgccccccgccccggggacctgtccccccctccccctgagacctgcccatcaacgcccccctgccccggggacccgtccccccctcccccgagacctgccccccacccccttccacatatgcagctcctgcactgagccgaggctgtctgtggctgggctggatcccctgctggcttccctcgggacaggggccctcacacactggcgtctggactcctgacgttgaccgtcccggggctgggctttcggcaggtcaggggctgccggccaaccctcgaccaccagccccagactccatcaagcagatccacttgggccctgtgtttctctctctaccacaggccaagggactcctgctgcccggggctggctgaggggcagtggagaggaagccttcagtccagcccagccctgggggacacggcccccctccaagaactgctgggtgctggccactgtgcagggcacgaggctgctctgggcagctgctgtccctcagctgtgggtaggggtggaggagttggggaggtaggtggggacctccccagggtggccagcccccagcctgctggtgactgcgccacaccccctttctgcagggggacctcaagggctacctgcggagctgccgggtggcggagtccatggctcccgacccccggaccctgcagcgcatggcctgtgaggtggcctgtggcgtcctgcaccttcatcgcaacaatttcgtgcacaggtgagggcgggcgcgggccagcggccgggaagccctaggccaggcccctcccctgaaggaagggcatagggcgggtcctgcctcagggggcttgcgaggaccggccaggttcatctcatgcagcatcagacaaccactatgcagagggattttatgacgtttttgaaaaattgggaagacaatggtttgacacccactttgcaggtttagacgaagagatgcgtactgtcaagctggcctgttctctgtccccgaggcagtcagccagcaccctgcagccccgcgccaaccccacactctgctaagccctcgctttggggcttgagggagacagaccctgcttcgaaggaccctggagggagggttctgtcctgcttgggccaggatgcccagcccctggggaccccggggggacatgctggaagaagtggcgaaggacacgtggccccgtcagccccagacgccgcacggctgtcctctccaacaatatcctggtgctgagtgatgactcaggcgactccagcatcagtgattttgttgaagagggcagctgccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaatgagtggacaagcagatggattcggccagcccggcctttatgtgcaggctccacaggtgctgggcttgggcctggcagggtgcacattgcctgctgaaaggaagcgctgtcctcagggaggggcggctggtatggtaccaggccccggtcctgaggcactggcgtgatggcgggagctgccccattcggcgccccggggatcctgcgcggtccttgctgtggcaggctgtgcccagccctggctcacggctgtcgccccacaggtccctgggcgtgaccatctgggagctctttgagctgggcacgcagccctatccccagcactcggaccagcaggtgctggcgtacacggtccgggagcagcagctcaagctgcccaagccccagctgcagctgaccctgtcggaccgctggtgagggccccactgccctgtcccggacagccaggccgagatggggtatcctgatccccaggcagaggcggctcaccctgaccccctggcgttccagccctgcctggtctcccctcccctctggtagggcctccacccgccacctctgcacccctgtgtacagggagggaaggcttaaggatagtgcccagcccacctcctgctcccacgctgctgggcttgccttggcagatttggggtgtcaattaagtgggagatacccttaatgcccccaagacactgggagttaggggaacccccatccctgctccagggacgcgttcctggccagcgttgcctctgacgtggcccccgggggacctcctcgcaggtacgaggtgatgcagttctgctggctgcagcccgagcagcggcccacagccgaggaggtgcacctgctgctgtcctacctgtgtgccaagggcgccaccgaagcagaggaggagtttgaacggcgctggcgctctctgcggcccggcgggggcggcgtggggcccgggcccggtgcggcggggcccatgctgggcggcgtggtggagctcgccgctgcctcgtccttcccgctgctggagcagttcgcgggcgacggcttccacgcggacggcgacgacgtgctgacggtgaccgagaccagccgaggcctcaattttgagtacaagtgggaggcgggccgcggcgcggaggccttcccggccacgctgagccctggccgcaccgcacgcctgcaggagctgtgcgcccccgacggcgcgcccccgggcgtggttccggtgctcagcgcgcacagcccgtcgctgggcagcgagtacttcatccgcctagaggaggccgcacccgccgccggccacgaccctgactgcgccggctgcgcccccagtccacctgccaccgcggaccaggacgacgactctgacggcagcaccgccgcctcgctggccatggagccgctgctgggccacgggccacccgtcgacgtcccctggggccgcggcgaccactaccctcgcagaagcttggcgcgggacccgctctgcccctcacgctctccctcgccctcggcggggcccctgagtctggcggagggaggagcggaggatgcagactggggcgtggccgccttctgtcctgccttcttcgaggacccactgggcacgtcccctttggggagctcaggggcgcccccgctgccgctgactggcgaggatgagctagaggaggtgggagcgcggagggccgcccagcgcgggcactggcgctccaacgtgtcagccaacaacaacagcggcagccgctgtccagagtcctgggaccccgtctctgcgggcggccacgctgagggctgccccagtccaaagcagaccccacgggcctcccccgagccggggtaccctggagagcctctgcttgggctccaggcagcctctgcccaggagccaggctgctgccccggcctccctcatctatgctctgcccagggcctggcacctgctccctgcctggttacaccctcctggacagagacagccagtagtgggggtgaccacccgcaggcagagcccaagcttgccacggaggctgagggcactaccggaccccgcctgccccttccttccgtcccctccccatcccaggagggagccccacttccctcggaggaggccagtgcccccgacgcccctgatgccctgcctgactctcccacgcctgctactggtggcgaggtgtctgccatcaagctggcttctgccctgaatggcagcagcagctctcccgaggtggaggcacccagcagtgaggatgaggacacggctgaggccacctcaggcatcttcaccgacacgtccagcgacggcctgcaggccaggaggccggatgtggtgccagccttccgctctctgcagaagcaggtggggacccccgactccctggactccctggacatcccgtcctcagccagtgatggtggctatgaggtcttcagcccgtcggccactggcccctctggagggcagccgcgagcgctggacagtggctatgacaccgagaactatgagtcccctgagtttgtgctcaaggaggcgcaggaagggtgtgagccccaggcctttgcggagctggcctcagagggtgagggccccgggcccgagacacggctctccacctccctcagtggcctcaacgagaagaatccctaccgagactctgcctacttctcagacctcgaggctgaggccgaggccacctcaggcccagagaagaagtgcggcggggaccgagcccccgggccagagctgggcctgccgagcactgggcagccgtctgagcaggtctgtctcaggcctggggtttccggggaggcacaaggctctggccccggggaggtgctgcccccactgctgcagcttgaagggtcctccccagagcccagcacctgcccctcgggcctggtcccagagcctccggagccccaaggcccagccaaggtgcggcctgggcccagccccagctgctcccagtttttcctgctgaccccggttccgctgagatcagaaggcaacagctctgagttccaggggcccccaggactgttgtcagggccggccccacaaaagcggatggggggcccaggcacccccagagccccactccgcctggctctgcccggcctccctgcggccttggagggccggccggaggaggaggaggaggacagtgaggacagcgacgagtctgacgaggagctccgctgctacagcgtccaggagcctagcgaggacagcgaaagaggaggcgccggcggtgcccgtggtggtggctgagagccagagcgcgcgcaacctgcgcagcctgctcaagatgcccagcctgctgtccgagaccttctgcgaggacctggaacgcaagaagaaggccgtgtccttcttcgacgacgtcaccgtctacctctttgaccaggtgggccgccgccacccggggtctgcccggggctgggggtcgcgctcccgcaggaaggggtgggagcggccgcggctcctggcggccgagctacctggtgctctctgattcctccaggaaagccccacccgggagctcggggagcccttcccgggcgccaaggaatcgccccctacgttccttagggggagccccggctctcccagcgcccccaaccggccgcagcaggctgatggctccccaaatggctccacagcggaagagggtgagcaggggcggggctgggcccgtgacgtcacgggaggcagggcctggtccgtgctgtgtgggaggcggggcctaatgtgtgacatcatgggaggagcacctggtccttgacgcgtgggaggcgggctttggcccgtgtcgtcatgggaggcgggtctggtacgtgacgtcacggaaggcgggaccttgtccgtgctgcatgggaggcggggcctgggcccgtgacatctgggagcggggccgggccgggnnnnnnnnnnnnnnnnnnnnnnnnnnnnnnnnnnnnnnnnnnnnnnnnnnnnnnnnnnggccgggccggggtcccagctgtgagcgcgatgacgccgcgactgggctgcaggtggtgggttcgcgtgggacgacgacttcccgctgatgacggccaaggcagccttcgccatggccctagacccggccgcacccgccccggctgcgcccacgcccacgcccgctcccttctcgcgcttcacggtgtcgcccgcgcccacgtcccgcttctccatcacgcacgtgtctgactcggacgccgagtccaagagaggtgaggcctgggcggggctgtggcagaagggcacgcgagaggtagggcacgcgggaggcagggcacggagctccgagggtggggcccctccgtctaggtcctgggccgggccagccccggctccgctccgctccgctccttcccggccccagacctagcctggaccccgcctggccctcgcctggccctcacctgaccctcacctgaccctcacctgaccctcacctggccctcacctggcccctgcactcggctctcctctgcctgaccctaccccgcagacctgcggcaggccctctcaccggaaccttcccagccagaagtccctgcagacccaggtcccacggtgccccggccccacggtgcccaggtggagccctgctgggggcctgagccaccgctccc

SEQ ID NO: 849 - DNA, 114183 bp, Human
tcccttttatccacattcttgctagcactggcttttgtcttttttttttttttttttttgagacagagtcttgctctgtcacccagggtggagtgcagtggcactatctcggctcactgcagcctccgcctcctgggttcaagtgattctcgtgcctcagcctctcaagtagctgggattaggaggtgcaccaccacacccagctaatttttgtatttttagtagagatggggtttcaccatgttgcccaggctggtctctaatccctgatcttaggtgatccacccacctcggcctcataaagtgctagtattacaggtgcgagccacggtgcctggcccattgctcatttttgtaactgggttatttgctttcttaatattgagttgtttgaattctttatgtatttggatgttaaccacttatcagatgtgtggtttgcaaatattctctcgcatatagtaggttgtttctctgctctgttgattgtttcctttgctgtgcagaagctttttagtttgatagaattccatttgcctattttcatttttgttgcctgtgcttctgggataatattcaaaaagtcattgcctagtctgatgccagagagctttcctcgtgcattttcttttggtagttttacatttcaggtgttatatttaaggttttaaaccatattgagttgattttttaaatatagtgtgagataagggttcagtttcattcttctgtatatggatatctggttgtcctaaaaccatttattgaacagactggcctttccccattgtgtgttcttgacaactttgttgaagatcagttcactgtaaatgcctggatttatttctgggcactttattctgttccattggtctacatgtctgtttttatgccagtactgtgctgttttaattacagttgctttgtagtatattttgaaatcaggtaacacaatgcctccatctttgttcttcttgcttaagattgttttggctatttgggtttcatacaaacttttgtggttttataaaaattttaggattgttttttctatttctgtgaaaaatgacattgggattttgacaaagagtgaattaaatttttagactggatagcatggacattttgacaatattaattcttccaaaccgtgagcacaggatatctttccattttggggatattcttcagtttctttttctttctttctttttttttttttttttttccggcttttgagactgggtctccctctgttgcccaggctggagtgcagtggtacgatcatggctcaaagtgcacactaccacacctggtgaaattttgtttttcttagagacagggaccctatgttgcctaggtcggtttcagactcctaggctcaagcaattctcctgctttcgcctccaaaatgttgggattattataggcatgagccaccatgcctagccttgggttttttttttttttatttgacctattaatagatatattgaatcaatggatttcctctatcttaattcaacattgtattcctgggatacatggcttctttcagtacactgtacattttgatgtgagagtatttgatttagaattttatttttttaaaaaaattcttgaataaaaccaatgtattcttttttcttttcttttttttttgtactatttttgtcattttggatagactaagtgtaaaggggccttgttttctctcagcaagagaggatttgctgagttatggggaaaatgagaatccaagtgggtctagcagaagaaatggaagtcgctaacacaagcgtgcatgcttggtgaatgcttcaaaaactcaatgttcagccttagcaaatgagccttaacctgcaattagcaatggtacctgcaccctttagactcagagaggcctcctgttaaagaaggatgtaattccccctattcaaaggcttgatccatgaagtttatagccaggaactaattagtgcatctttatcttgctttaaaggtctcaacatatgcactagtggaagtgccacctcatgtgaagaatgtctgctaatccacccaaaatgtgcctggtgctccaaagaggtatgtaggtgggggaggggaggaagaagggaaggaatgctgcgagggtgagggtgagaaggaggccaacaccacaacacactaattcactatacataaaaatcctgtgcagattctgtaagctgcctcttccccatcagggcagagtgatgacaaatccaagtttatgagacaataagataaactgggtttcttgatactgtggaatgctaatcctgttttggggaaacaagactttccttcccttttgtttggagaccagttaggattcatctatagttttctgatctttggtataagaactccaaaagacctgagcttgtgaattgagtttgttgcataatgattcaaaacatatctagatggctggcatgttggtggaagccagtcatcttagtgtgtttacttgagaataaatattaggaattagcctttatggaatgattttatttagaaataatggctgccatttctttaagccttttagaaagagatataggtttgggacaatgttaggctattggtatcataaagcaatatgggctgggtactgtggctcatgccagcattgtgggaggccaaggcaggaggattgcttgaggcttgagctcaggagtttgagtccagcctagacaacatagcgagattctatctctactaaataaatcaggaaagaaagaaagagagagggagggaggaaggaaggagggaaggaaatgtaacttggtggactaatcagaaaatgatcgatttctaaatttcctctcttgaaggaaatttctgggtcacaaaccctccctgtaaaagtgccccattaaggttatttgtaaaggaatccaggactttttgactggctcagtctgcaatgcagtgcgtggtccctgtcaggaggaccaagagatggctcacgggaggctggggttagtctccatcatggcagcctcagaggtctagggattcctttaacctatgatggctaaaaatgatcatgtggggactctactagatgtcatacactttgtacatcatacaatatctctgatcctcacaatagctctgtcaggtgggtgtaatacacttgttttattgatgaaaatctcagactcagagcagtaaaataactcactcaaggtcacacaagtgtgccaaagctggggttttaatctgacctctgagcccaagcttttccctccagactatatggcctcttgcttgctatatgaactctctaaaatgccaattttaaaactttgggagttctcaatttactttgagagtggaatcttcccaacatataaacctttaatcatatttgtgattaattgtaccatctttgttatcacccttctttaaaatcttcctttcgttctctatgacctgcagggcagatccaagctctgtggctcttgccttcctcctaccatcatctcttgtctgacctgacatttagccagagggaaccacctgcagatacccagagagcccagcttgagaaaccctgcctgatcttcccggtgtttctcccctccctggagagccttcctggctttttcttcctcctttccttcttttatttatttatttatttattatttatttttatttttatttttattttttgagacaggatcttgctctgtcacccaggctggaatacagtgatgtgatcatagctcactacagcctccatctcctgggctcaagcagtcctcctacctcagccaccaggtagctgggactacaggtgtgggccactgtgctcggctaattgaaaaaaaatcttttagaggtgggatctctctatgtttcccagtcttgtctgaaacacctgacctcaaatgattctcttgccttggcctcccaaagtgctgggattacagatgtgagccaccatgcccggcccctcctttccttgactgataccttgttttatcgtttttaagaatcaattcggccaggcgcggtggctcacgcctgtaatcctagtactttgggaggctgagacgggtggatcacaaggtcaggagttcgagaccagcctggccaatatggtgaaaccccatctgtattaaagatacaaaaaattagccaggcgtggtgtcatgcacctgtaatcccagctacttgggaggctgaggcaggagaattgcttgaacctgggaggtggaggttgcagtgacctgagatcaggccattgcactccagcctgggcaacagggcgagactctgtctcaaaaaaaaagaatcaattcaggcctggtgtgcagtggctcacacctgtaatcccagcactttgggaagctgaggtgagtggattgcttgagctcagaagttcaagaccggcctgggcaacatgacgaaaccccgtctctacaaaaaatacaaaaaattagctgggtgtgctagtgcatgcctgtagtcccagctacttggggggctgaggtgggaggatcacttgagcccgggaggaggagctgtagtgagccaagattgtgccactgcactccagcctgggcgacaaagcaagaccctgtctcaaaaaagaaaaaaaaattaatcagtttaacctcatctactccataacgacctgcatacctgactgtctccatctgtctatccattcatttatccatccatccatctgtctatttatctgtgtatccatttgatatgagaatgtaagctccctccactggggtttttttttttttttttcttttgagatggggtctcattctgtagcccaggttggagtgcagtggcatgatgtcggctcactgccacctccacctcctgggtttaagcaattctctgcctcagcctcctgagtagctgggattacaggcacgtggcaccacacccggctagtttttgtatttttagtagagacggggtttcaccgtcttggccaggctggtcttgaactcctgacctcgtgatccacccaccttggcctcccaaagtgctgggattataggtgtgatccaccatgcccgactggggcaggggttctatctgttttcttcattgctgtattcctgaatggcgcttaccacatagtagctgctcaaaggatttcactggatggctatttattgtgtgtctgctaggtgcaggccatgactacctctttgtctccgtgtactctgtgcttctttagtatttataacctctttttgttttaatttgttttcatgcctgttaccaactaaatcatcatctccttgagaaactaaactgtcttatcttggatacccagtatccagccaagaatctggcaggaatttgtatttgatataagagtactgttaaaaagacatgaagttagaaaaaccaaagtttcaatcagttttgctgtgatttactcttaatttcttgatatgtaaaatgaaggtgattgttcccaccctccagcatgactgggagtgtaaaatgagatccgtgcatgagaggacttgtggacaaggctgattagctgagcctcctgaatggctgccactgtcatccatgagtattttctagtgacatgtggctagaaaatccagaagccaggtccatttttactttaaatagcttctttccttgtgctagtacttccacaagtcagacttcctgatgctgacagtaaatgaaggtgtccctaggagcttgttatcaccccagcccacacttaggttccctgtccagcccactgggctccctctctgctcatcaggagcctcattcttagctgaagaaattcctatgatccctgccctggaatgcagcttcccatcttctttgggggtgacttttccccaggacatgggtgtgttttagagagccaggttaggagagttcaggaatggttatttatttatttattcatttgaggcagggtctcactctcatcatccaggctggagtgcagtgatagaatcatggctcactctagcttcaacctcccagtcccaggtgattctcctacccagcttcctgagtagctgggattacaggcgcgtgccaccatacctggctaatttttgtatttttagtagagacggggtttcaccatgttgtccaggctggtctcaaactcctgggctcaagtgatctgcctgcctctgcctcccaaagtgctgggattacaggcgtgagccaacacgcctggccacaaatggttttgatcaacctgtaccccttagcaagacagagtaagtgtggctgggtgccttcttaaccatatatcccaggacatcatcaaagatgtaataagcatgtgatgtgtgtgtacactgagggttgctgcccagtagacagccggtgagggccaggttcccaacctatgaggatgaatcccatggtacattccatggggattctcctgctccagatcccatgaagacttacccttattgtacttgaagtgggcatgaggattccttatccctgcagttcacattccttgtaacctaattccatgcctgctggccacgtctcctcccacaggtatcatgtatgagtccatcagtgtcctttcccaccactccctgcacggtgctcttgctggttctctcttagttggctctgtgtcacatcagccctggctctcttgcttttgtttactttttttttcatttttaatcatttagttaatttattttcggagacagggtcttactctgttgcccaggctgcagtgcagtggtgtgatcatagctcactgcagcctcaatctctcagactcaagtgatcctcccaccttagcctcccgagtagctgggactatagacctattccacaacatccaggcaagtttttgattttttttttttttttttttttttggtagagaacaggtctcactatgttgcccaggctggtctccaactcctgggctcaagtgatcctctcaccttggcttcccagtgtgctgggattacagacagtgagccactgtgcctggcctcttgccttcattttctcaccatgctttacctgagggtttcagacttactttctgccctcatatccagagtcgccagactctcccctactctgagaccaggatgtatgggtcactgcctgtcttggcctgtccatgctgcccctgcctctctgcagcacactctctaccttgttctagacagccttggccgcctgcttctcagcccttatggtgctgtttgtacagcacagcttaagacacatgtattagtctgttctcacattgctataaggaaatacccaagactgggtaatttataaaggaaaggggttgaattgactcacagttcgccatggctggggaggcctcaggaaacttacaaccgtggtggaaggtgaaggggaagcaatgcaccttcttcacaaggtgtcaggaaggagaagtgctgagcaaagggggaagagccccttatgaaactatcagatctcaggagaactcactcaccatcaagagaacagcataggggaaaccgcccccatgattcagttacctccacttggtttctcccttgatatgtgaggattatgggaattatagggattacaattcaacatgagatttgggtgggaacacaaagcctaaccatatcaacacacaacaaatcccagcagtttatgatctattttgtccatcattttttaaaatggacattttgtttcccctctaacattgtaaattttacaacctagccagttgtcatgaggaatgtgcctggaggagagtgtgcggatgctttcaagcagggcctaggggtagcccacattcttcctactagcactgttgcctaaaacccagccacatggcaatgcctaactgcaatgagaactgggagacttgctctagctttgtgccccagaagaaagggagaatgggcttggtgtactggcagcttatgctcgtgtcactcgcaagaggacagtggtttgggagaagtgggcaaggctgagggatcagtgctccctgtgagaacagaaagcagggttggggaaagcaagagaggaggcaaaggcagacagagagattgcacttagggtttgcagaagttgggaggttgtcagggtgtgaatacgaggctccgtgaaatggtgtggctgtgggcagtaccaggctgctgtgaaatccgggagaaggaccaggttaggcaaggccaccactgtggagctgaattcccacagggagaagaacagtgaggccatggatgcatggaaatggggtcgggcatgggagaagactagtgaaaagaacagtgaggccatggatgcatggaaatggggtcgggcatgggagaagactagtgaagtctgggctggggtgagcggtctttgcctggggaagtggatgtggagaagaagcaatgaagcatcagtaggattggaggtaggagcatgaggagggagacaggtgagaggctgggaagcaagatgggccaactgaaatgaaaagaatcaatattcaatccagctcacataaactatagattctttaaagaacatctccttgtggtcagattcaatgaaagaaataatattggcctgttgtagacacttcataaatatttgttcagtgaattaataagtccattgaaagctggcagagggatttctccatcccccaggcagggagtatacgtggcagtgtgttgctggcacacaacacacatcttggttgtcatcagctaccttcccctcaaatccctgagggttctgccaagttggagctgcaggtgtggctggtcagggggccaggccctgccatatcccagccagaaaggtcggccttagcaagaagccagctccccgcctgtgtccacttctcccctgggctctctgcctttttcccagtttgttttcttccctcttcatcccagggattgggcatgctggcctcctttcttgcttgggttccttttgttcaagggcctacagtttctcaactcttctactctgtttcagaaacaaacaagaatttgtcttttcccccaaaacaatcaccctcacctttttagagttttagccttcagcaatggtaggcaggatggcactcaaataatgtaatgtctggtctggcatagaggaacctgaatgcactggctgtgatgctggacagccaagcacccattgaacactagctttgactgcagggtaagagaccttgattagcaaaaaatatgtagggagctgggcatggtggctcatgcctgtaatcccagcactttgggaggctgaagcgggtggatcacttgaactcaggagttcaagaccagcctggccaacatggtgaaaccccatctctactaaaaatacaaaaattagccaggcatagcagtcccagctattcgggaggctgaggcatgagaatcacttgaccccaggaggcagaagttgcagtgagccgagatcataccactgcactccagcctaggtgacagagcgagattccatctcaaaaacaaacaaacaaaatatatatggagtcaggtgttaacatattataataagtagcagacctcatcttatcctccatgtaacagtgatgatggggtgagtgagcatggtggcttacaataagttgcaaacaccagtgttgtaacaaactaaaaacaatctaaattttaaacacctctcttttctcttttatattattaccacttagtaactaaaagcagcaaaaggccaggcatggtggctcacgcctataatcccagcactttgggaggctgaggcgagaggattgcttgagcccaggagttgtagaccagcctgggcaacatagtgagacctggtctctacaaaaaaagtaaaaaatcagtgggatgtggtggcacctgcctgtagtcccagctacttgggaggctgaggtggggagacagcttgagcctaggaagttgaagctgcagtgagtggtgatcacgtcactgcactccagcctagacgacagagcgagacccagtctctcaaaaaaaaaaaaaaaaaaaaaaaaaagaaaaaagccgcaaaggacacttcaactttctattgccattctgctgcttttcccctttggagagtttgataagggcatttctggagaccagggatcaatgctttgtttgtgtacaggaacctcttccagcatagagcatggggagcatctgcaagcagttgtgttgtggcccattagaagcccatccttcttgcttgggttccttttgttcaaggaacaaaaggttgccatttttgcctgttgagatgaagtctcccctcctcttctataggttgaggctcctctgtacctgtttctctgcaaaaggatatttatccctcatgtttggtaggtaacagatctctgaatttggggcagcaaagaaatgctgccttcagaaggatggaagctttgggcccaaagttagtttcctgctgcagaacttggcagtggccttggctaaaatgggaggcggcacatgctgcaaagagcactggatttgggcccaagaagccagggccagatgaacttcaacttcttgggtgaacttaggtctgtggacctctgattccccacctgtggaagccaggggatggcaccaggtgatgcagtcaagggcccttccccttggaacttgctatgtctgacacctggcagagggtctgagtgtcaggtctctgggatctgaaactgttacgccatcagacatcaggatgtcattcatgtgaggaggactttctttttcttttttttttcaactttcatgttagatacagagggtatatgtgcaggtttgttatatgggtatattgcactctaagtagtgagcgtagtacccattaagtagtttttcgacccataaactctcctgtcccagtagttcacagtatctgttgttcccatgtttatgtctgtgggtgctcaatgtttaggtcccactgataagggaaaacgtggtatttggttttctgttcctgcattaatttgcttaggaaggaggattttcttaaacatcagtctgccttttctctaaggctttatgatatgaggcatccgtattcattgaatatggagcttagaaatataggtattgaggggccggatgtggtggctcacacctgtaatcccagcactttgggaggctgaggcgggtggatcatgaggtcaggagatcgagactattctagcaaacacggtgaaaccctgtctctactaaaaatacaaaaaattagctgggcgtggtggcgggcacctgtagtcccagctactccagaggctgaggcaggagaatggcttgaaccgggaggcggaccttgcagtgagctgagatcgtgtcactgcactccagcctggatgacagagcaagactccatctcaaaaaaaaaaaaaaaaaaaaaaaaaaagaaatataggtcttgagacattttttctttctttctttctttctttttcttttttcttttctttctttctttcttctttctttctcctctctctctctttcttttttttctttttttttctttttttaccttaaactactaagggttaagagacattttccagatttataatgtttgtatacctggaaggtcatagccattactagatatgcccctggtctctgtcattttggttttctctctttaaatatgcatctatccttgttcaaaattaaaatatctaggccaggtgttgtggcttatgcctgtaagcccagcattttgggcggccatggcgatcatctgaggtcaggagttcaagaccagcctggtcaacatggcaaaacactgtctctactaaaaatacaaaaattagccaggcatagtagcacatgcttgtaatcccagctactccggaggctaaggtggcgggatcacttgaacccaggaagcagaggttgcagtgagctgagattacaccactgcactccagcctgggtgacagagtgagactccgtctcaaaaatgaaaataaaaatacttagaaaggaacacatggaatagaggcgaagctcttggcttgtgacctaactccctctgttgagtccgcagcactctcagttccttttcttgggcaacaagaacctatagctacaaatcagttatggcttactctttccttatcgggtcaaaaataaatcaaaagaaattagtcacagcaattgtttggactccgtgccaaaagagatctttacctcttaggggaatttccctgttaaggtagctgccttaccctcaaaagcttcttcagacctgccttgccccgtggtgcctcagctagtggctctgagtccctagagctctgggaaaataatgacaggactcgatatataggtaaagatgcctcaaagttgttgagcacatcaacaaaaccatatggcctgacctagatagcaagaaagcgaactttgacactgatgatagagatgcctggcactgagaagaaatctaactttggtccgcgtggcatatggtgtgtcctttgctgtctataaagctggagttgctgagaataggactccctttgtaccatcatgttgctgacttggtctgtgcttccgaagtcagtgcaaccctgcaagttgcagctttaatgtgattaatggtggtttccacactggcaaccaggtgacagtgcaggagcccatgattcttgttgttggtgcagctaactttagggaagcctcgtatgcactggagctgaggtttatcacaacctcagctgaagaatgtttttaaggagaaacatgggaaaactgctaccagtgaagggcatgaagagggctttgctcctaacatcctagagaataaagaagccccagagctgctacagcatgcacttgggaaagccagcgacactactagggttgtaataggcactgacctgtccgcctcacagttcttcaggtctgggaaatatgatttggactttaagtctcctgatggtcccagcagatacatttggccctgtacaagttcttctgcaatgatgggtagtatccatcaaaaatccctttgagcaggatgttgggaagctcagatgaagttcactgccagtgcaagtatcccagcagtgggggggatcatctcattgaccaaactgaaggaattgtgcacctgcctcctgcttaggtgaagcaggttggctctgtgccctagtctattccagagtgtaagctggtccagaccagtgagagaggtgtcaggggttctcattactctgaaaaaactgaccatgcttccgttgccaccctggtggtggggctgtgcactggactgatcaaaacaggtgcaccttgacaaacagaactgggccaagtatagtcagttcctcagaagcagaggggctggatagcaaggctcagttcgccagtgagaaattcagaaattctctagcagagtaagcactgggcaggcaagcccctgagctcttcaagctctggaaagctaattagacatctacttcagacagctcaagacagcagacccaaactggcagggccctcaggtcgttacccctccttttccagaaccctgtgtttttcttctcactgcttcactagaactgctatatcagagccaagcttgaccacctggaaccccatttagaaagttctgcttttaaatctaaggccagaggccgggtgcactggctcacgcctgtaattccagcattttgggaggccgaggcgggcagatcataaggtcaggagatcgaggccatcctggccaacatggtgaaagcccgtctctactaaaaatacaaaaattagctgggcatggtggtgcgtggctgtaatcccagctactcgggaggctgaggcaggagaattgcttgaaccagggagtcggaggttgcagtgagctgagattgcgccactgtactccagtctggtgacagagcaagactgtgtctaaaaaaaaaaaaaaaaatctaaggccagaataatatatatatgtgtatctctctgtgtgtgtgtgtgtgtgtgtgtgtgtgtgtgtatatatatatatatgttttgttttgtttttttaacaaagtctcactgtcgctcaggctggagtgcagtggcatggatcatagcccactgcagcccggagctcctgggctcgagcgatcctcccgcctcagcctcctaaaatgctggcatgagccaccatggctggctagaaaactcatttttctaaccttgttgcacaacaagtgtttatggagccacttatacctttgatgtagtcctggaggttgttgacaggcaagatcctcggggatttaatgcacaaataaaaaatcgttattaaaaaaaaacaacccagaatataaacaaacataccgtaggcttaggacaatacatctggctttacttatttaaaaacactgcagcgtcttcttgacttcttgttcttttttgtgtttgttttttgtttttctgagacaggctcttgctctgtcgcccaggcaggagtgcagtggcacaatcgcagttcactgcagcgttgaactcccagcccaaatgatcctcctgcctcaagtctctcaaagtgctgggattacaggtgtgagccaccacaccaggctgacttcttgatcttgaattttataaggattctaaagggcattgggtagttccaggacatctgagaccttgagggagggtgcattcctctgatttttgtgcctctgccagcagtctggcttctaacaaagtggtcaagggatgctgactcacatgaggcttctggcaaagtgttccagagggaagaggaagggaccagtgtcctaactcctccagaaagactcataggacagcattggcttccagcctgccagagtggggggaatcttgtttttcacattcaccagggaaaaggtgaaacccctttgccggaaatgaccagggaggcttcatgatttataataaagtatattgtttcattttaaagttaataccttaaccttctggtgtcccaaatgaggttgagttgttctgatgtccagctttctcccaaacccaaagaaagatttttcttatcaatgtgtcgttatcatacaaacaacaaagataaaaacaaaaatgtttttgtcactttactataacacctcatttaaaattgttctttcaaatcctaataaatacaattctatattttgggtttttttttcctccttagtgtaaatattttaaatttcttcttaattcccataattatttgtaatggctgtcatctattgaagtgatatgctatgttattcttatggtttaaggatttaggtttgcaagttttaaagattatattataagtaatactgccgtatatatcacatagagtttctcctttctctttagatgattttcttgtaataagtttcttggagtagagcactgggtcagtggatatgacctgtactgccacattgttctcctgaatgattatccagcatccaatgcctgtgaaagatgataagtgaacaacttaaaggttaactcttgaatgcccaagggaagacttttcagctacttatatgtcatcttatttatttaactatatattatttcatctacttatttatttatttttagagaggaggtctcattatgttgcccaggctggtctcaaactcttgatctcaagcgatcctcccacctcagtctcccaaatagctgggattacaggcatgagccaccatgcccagcaatatataacaacttttaaaaaattttagctatacaacttctgatcatttctgtttctcttgctaatcatgtaggcagttaggagcattttaaccatcaaaataacaacaaaaccgaacatttttattatgtgtttacagtttacaaaatgctgtcatgtccagcagctcagttaatccttacaatacttggtgaagcatctgggatagggattaccatttcctccattttcagacaatgaaaatggaaagtagagaatttaaggtcaaccagatggagacgcagccacgacatgcgatgttttcgggagacaccctgaccacctcctgctctcttcctctttttccctgcctaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgagttgcccacagaaagggctggatgctctgggatcaggaaggcccatgggggaggtgggacttgttaataatgggacaatgagtcaggccaggctgagatcagagccacgagatggtgatggggaggcaaggctcagacctcaggaagcagagtatattcttattgatgtgtctgtggacaggctcctgtggacagaggaagatctttgctatttttaaacaattgtggtgaaatatacataacatttaccatttaagcgttttcaagtgtacagttcagcagcattaaattcacaatattgtataaacatcagcagtatctatttccggaacattttcgtcgtcctaaacagaaaatctatacccattaaacattaactcctcattctctctttcccttggttcctggtaaccggcattctactttattttttatttttcatttatttttgtttttaaattttgtttaaatcagggagcaactgatggcagaaattacagtcattcagggtgtagtggctgcctactctactttccgactctgaacttgactagtccagatacctaccataagtggaatcatccaatatttgtcctttgaagtttgacttgtttcactaagtgtaatgttttcaagtttcacacatattttggcatgtgtcagcacttcattccttttttggctgagtaatatttcattgtatgggtgtatcacattttgtttattcatttgtcagtgaacatttaggttgtcttcaacttttggctcttgtgaataatgctgtggtttattctaggaggatgctggtagatttactccttagtgaatgcaagttgctcaggaaacacgccacttttaggaaaaagtgttttttcctgtcagcaaattccatttgagtctgtagcattctgcaaggacaaacttttagagtggagatattttgttttgtgaccatggggccctgcaagccttagagttgcttaatataaggaaacggtaatataattacttataatgtaatataaagaaacagttttgcacacctactatgtgctaaacacttgacctaactttaaggtagctatcttttttttttttttttttgagatggggtatcgctctgtcacccaggctggagtgcaatggcacagtcttggctcattgcaaccttcacctcccgggttcaagagattctcctgcctcagcctccctaatagctggatgtgtaccaccacgcccagctaatttttttgtgtgtgtgtttttagtagagatggggtttcaccatgttggccaggctggccttgaactcctgacctcaggtgatctaccttcctcggcctcccaaagtgctggggttacaggcgtgaaccaccatgcctggccaggtagctctcattttacacacaaggaaacaacctgctcaaggtctctcagtaagtggtgaatcgattcagccccaggtcttggtaaccacaaacccatggctgtttctagttcaccacttttatcattgaatattctgcatattagaagccttgcaatgtcaaagggttagatgtgcatgtggctaaattggaaagtattacgctattgggaaggggcagattttttcacattttactgattttttgctgttttcttctatcccatggtctaggaaaccattggcagtagctatttgtagatggtttatttagactccagggaagcttgtagcagtggaaagatcatggatctggctggctctcttgggttctagctctggctctgtccctagcttggaggccctgggcaagttactccatctctcagcatcttagggtctttgtcacctttgttcctcatgggcatgttcagaggcttaaatggactttttgtatcagtgaacttttcaaagttaaaatttttattattttcaaagagcagtggccgagggtaccagatggaggtttgaccagggatgctcagtgccttggaaatggattaacacagtgctgcatgtggtaagcactcagtaaagctcgttgttgttgctgtggttatcattgtatggtctgcaccaagagtttttaaagaaagctccaagtcatcatatagttgagaaatgttttattttgtctattttaattgtcttgaaaataagaaacaaaagaagagtgtaagttggccctgctggatagagaagcttaaactattgggttgcctgcccaggaatcagtgttgagattaattgaagttaggatttttgcaaaccttctcactgtaagcaacactcagcctttttgtttagtgagatactgaattgagagagaaaaggaagggaactcttacagagctgtgtgagtgggtagaaaaaagtcagctgagcacttatgtgggcagatggttggtaatgtcctctggggaaagagaaatctcttatgtgaagacagactcagggtccagggtttggaccgaaagggatataggagttgttatagacccttaatatgttggaacatcgtgttgtataagaatagtgtattttcttttttatcatagtaacagtatagcaataacacatgaaattctagaaaaataatccactttaacataaaattatttttcatttttactatgtcctctgtattattcacctttttgtatttttcatatacttatcataatgtatgtataatcgtgctattttcattcaataatctttgaaaattaggaaaaaaattcacacctccaaaagagtttgtagtttcagagccattgtggaggaaggttttaatttacattttctgaactcctcatctagaatagctctcaaagcctgtggtgttctctccaagaagtatcctttatggtggcaagtctctcttcttcaggatagacttaacttagacaagagttgcatcacacaaatccaaagatgtccacactttaataattccagtttttaaaatgagaattaaggtgtgagtgtgagcagagatggttgtctggtttgactatcaactggcttttacagcagtccctgtagaagagttagagagttagagaaggccgggtgtggtggcttatgcctgtaatctcagtggtttgggaggccaaggagagaggatcgattgaggtcagaaatctgagaccagcctgggcaacatagtgagaccccgttgctatgggggagactgaggtggaaggatcccttgaacccaggagtttgaggctccagtctagatgaagatgagactctaaaaaacaaaaacaacaacaacaacaagaacccaaaataaaaaataagtgatttgagtaacggcaggtttgcatacaatccgtatttatgcataaaactcaatatatgctcagttaaggaaaaaaatcattcttatttggtatagttacatctcctgctaagcattatgatatgatttctggtattagaaataaaatggaaaccgtgatcctatgttgatacaaaaccacagtgtggatgctgtgtagctctgtcttgcggaaggtgtcgtggtggagagcccagtgctggtggtgtcaagcagttggaggagctgactgcctcctgaaaacacacccagactatgaagagggttcagtctgaagagatgaagactaggaagagatctgatgaaaatacgagttcctaagacctacaagcattgtgaatatgtttcccaaatgtagaaacacttgaaaccaatgatgcctcttaaaattttgaaaatataattttaacatttacaaagagaagtacaggcaaacctgaagaatttgtggggagagaaaaatggtatgtggcagttagcaaaattttcagtcatgcaaaatgcatatttgcctcagggtatctcccccctgactctagggagggctttcaggtatataggggttggtttttcatatatctatctatatatatgtagagagagacagagtctcgctctgtcgcccaggctggagtgcagtgacgtgatttcagctaactgcagcctccaggttcaagcgattcttatgccttagccttctgagtagctaggactgcaggcacacaccaccacacctggctaatttttgtatttttagtagagacggggtttcaccatgttggccaagctggtctcgaactcctgggctcaagtcatctgcccacctcggcctcccaaagtactgggattacaggtgtgagccactgcgctgggcctccattgtatatttttagaaatgcttttgtgtcttcttccttgccctacccgccatgcctcataatagttattcgttgagtgaaatataagactttgccagacttatcgcagactaatcaaggacaagcctcagcataatatgaaagacacttcatgaaggcaaagtaattgttccaaggtaagtctcaggaaggaaataaaaattaaaaagaatttctgtctactttaagcaggacattttttatttttttaaattgagatataattcacagaccataaaattcactaacttaaggtgtacaattcagtggttcttagtatatttgcaaggttgtacagtcaacaccactgtctgattccagaacattttccaaaaagaagtcccatacccgtgaacagttactgcttaaactaccgtctcccaccctcccctttcagccgctggtatccactcgtctactttctctctatatagttttgcatattctggacatttcctatacgtcataaaatgtgtgggtcttttagctggtttctttcacttagcaacatgtttcaaggttcatccatgttgtagcatgtacttcattcctttttatggccaaataatattccattgtggaggtatagatatactatattttagtttatggacatttgggctgtttctactttgggacaattcttttttcttttaataactccacagttaacaccctatactttggggcaattatgactaatgctgctatgaacgttcatgtacacactattgtggggacatatgttttcaataatcttgggtctatagctaggagtggaattgctgggtcatatggtaattctatgtttaactttttgaaggactgccaagctttaagcaggattttgtgtaaatataggatcatgttttccattttatttcagtactggaaactacatgtcaggataagaaccttagaaaaaatcattaacaaagagcataaaatccttaagaaaggacataaacttgaaagtaaagcttattgagaaccgtcaaaagctaaaggtggttttgaaacactgagcaattaagaatagtttattaaagtcattattggcctcagtcctttaacctcttaaaaaatgacccttgattggtagctttcttacattttgaaataattttagactcacaagaagttgcaaaagtaacacagagatgttctatgtacccttctccgctgccctcaatgatagcatcttaatataacaaaagtacattctcaaaaccaggaaaccaacatggttacaatactattaactaaactacaggtaattggttgcttttgggtttcctgccagcccctatttttttcctcccttctccttccaggttctacttggaagaaccagtttttaggtattgcttctgcaataaagttgccaccctgggtgacagtgtacatagcttaaatagacgaagaaagtcttttgatgatggctggataaggggttattttaaaggaaaccagaagtatcgagccctgggcttggaggcagacactgtggaggacaactgtgtcttcaggtgacttgttccttggttccataggtcaacagtcacaattctgaggtggagagggggtgcagtacagcctggcatccttgttctaaaccagtgaggcaataatttggttctagatctggatttaatcctgggatactaagtgccttctgctgtagtgactggaagagctgtctgctcatttataatgtgtgcaccagggccttaattttctgttcagttgtagtcctgttataatagagttgatttttatgtttcccttctttctttcagtttccagcacagaatagtacttctagggaatcaaaaaccatttgcatttattttgggatggcaaaggtctttatttgctgaggtactactttgtcttaacactttgaacaaaatcagtcttaagagtttttgactcaaaggcaggaaacctgagggaaaagaagaaagaagaaaaaataaataaaaattaaaaaaagtttttgaggctgggcatgtggctcacacctataatcccagcactttgggaggctgaaggggaggatcacttgagctcaggagtttgaggccagcctgggcaacatggcaggactttgtctctactaataattttaaaattagccaggcatgatggcacatgcttatagtcccagctacttgggaggctgaggtgggaggattgcttgagcctgggaggttgaggctgcagtgagctgtggttgtgccactgtactctagcctgggtgacagaacaagaccgtgtctcaaaaaacaaaaaagtttttgctggaattctcaactcattctctagaagtgtttgtcatttgatatatatccctaaggaaaatgccaacttttcactttttattaaagggaaggcaaagagaagaaagctttaaaaatacatttcagatagaatgctagttgatacccgattacagtggaagaacctgtacttacaaactgagcagtgcagaaattctgtgcaaaatgcagttggagctggctactctggaaccaggaacaagcagaaggacatgaggggggctgcctggggtagcatttcacaggtgccaggtgatcagcttctgttttgagtttgccatttctctggtcctgcccctggtcctgaggctggcaggaattacgtggaacagccccagagagaagggatatagctacagggatacatgagcctgtagagaccctaagtggagagggaaggagcagagaaggatgaatcctgacacatgggccgggatggtgtcaccagagacgggcacagaccaagacaggcaaattaaaggcgagaagcgcttcccactctgccgggcagcgggaggtggcgattggcttaaagtctcgggtgtttttaaaggaaagcagcgtggccgggaaggagttggaagggaggagagtgcttaagcgtgcatggttctggaagtgtacccaaagttggaaaacatacccaagaccttctctcagcagaaagtgcacttcacatgcattaatggcttcaccttcaggctgttaacgttagaggcctccctttttggggagttgttggtacactggaagcttaatgcccacaccatggatctgaccaggaatgtcagtccctccaggatctgctgacagaacattctgtcattgccacggcctattcaggagtctgtggcatttaaaatcaagtatattagaggcagcaataaaccctcattctgaacatcagtggtgttaccatctttcttacatccctctctttctggaaaaatggcacactatttctttttaacaactgcagccttcctttgggaagggatgtgtgcgtgtgtgtgtgtgtgtgtgtgtgtgtgtgtgtgtgttttcttactgatcaatttctcttagaatgtaatgccaagaagtttcttgcttcagaatagatagcctcttaggatacaaagggacctatatatcatgccttctttccctcagccctcatgtctggaaaatttagggttaaatttgtatgcccaaggctgtagctgttgaaattcaagttgctggcaggattttctgtctctctttttatcctcacaggaaattgcttcagtaattgacttttgggaaaaccgaggccaaagttttctttgtgtaggaacatttgtgtggtgtttatctcttttaatccctataatagttaatatcctccccacttgactgatgcagaaaccgagcagtgagttgaagagagcctgagttctccctagtccttggtgacagggtctggattcaaacccagctttcctgcttccaagcctctatcccatagatgcctctcagcctcccggaatccaagccaattatttgtttcctggttttaaagtgcccatctgttaatttcttataattcgtaaaaaagtagaagtagattttggataaaataagttgtaggtgggaacttggggggacaggtggcagaaaatgcagaagacctgtgaaaagatcatggcatcaggcagaggaaataggattgcaggctctgtccatttggggtctgttgtctgcccatgcaagggccaaggagggagctcccttcccccaactcccccctcttccctgcccctccctcactgtgatgtggcacccaaggagccctctggcgggacaagctgtgtctgtctgaccaaaggcagacactgcagcagcctggaattcattctggaagaaaaccttgaacattcctctgtttgagtcagactctgatggtttttttttttgtttttttaaattattattattatactttaattttagggtacatgggcacaatgtgcgggttagttacatatgtatacatgtgccatgctggtgcgctgcacccactaactcgtcatctagcattaggtatatctcccaatgctatccctcccccctccccccaccccatggttttaaaaaataggcttataccaataggcaactcaaactccatcaatcctgaggcgcctagaacagtacacgcaaagacaagtcaggggaagcaggctcagagctgccactctgactgcaagcagtaatgatcataatcatacttcatccgtgcaagcctgtactgctcataaaacactgctctccctcatgagcgcatcataggcttaattgatgctgtgagcattgttacttccattttatatttcaagaaaccgtggcccaggttgcactcctattcaagggacagagctggaacttgaactaaaatcttttgatcattggattcttcgtgatctagttagtgaaatatgccttgttgtcacggtgggaggaggagaggaagcatagaggattgagttccctgcaagttaaagaagccttcagcttgctagttgtcagcttgagatgaaagactggttgctctgagatgtggctgccggcaagtcaggtgtagacccgctgggcaggagtgaggccacctttgctgttgtgcctctacacacacaaagaatctatccaaatttcaagtatgtatagacagttctactgcaggataaatagggcatctcttggcactcctgaaaggttaataagcccaaggcagatagaatgatctggtatgagttgagccttaaagttggttctaagtgatttgtttttagaaattatgaagccgggcgcggtggctcacgcctgtaatcccagcactttgggaggccgaggcgggtggatcatgaggttaggagatcgagaccatcctggctaacaaggtgaaaccccgtctctactaaaaaatacaaaaaaaaattagccgggcgtggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaatagaaattatgaaatgatttcaagatcattatcgtggcctgggtcttccagttattgccctgacttgagcctctctttgaactctatagggtgagacagaaaaggccacacctgccagacactagcttttctctttgttcttttcctctgaattaattccccttttctctgcctgttggctatcttattgtagctggtagacaaatctagtgctgtcttttctctttcttcttgttttcttttttcgatagagctaaaatttggaatctgtcttcctgtatttatatatgtagtttccaatgataatgagttgtgcctgtgatgtcccaaaacatcaaatatgccccccaaataaatactagtctggtaaatggcgagagaaatagaaacaaacacaggtgatgtggcataagcatgcatatttttgcccattggggtattttaaacaacgatctttgtttctctgccctcccttgccttgcacatctctctccccaacttggttcttccccactcaggcccacacccctcttttgttcatttcttccctgctttttgtttcaaacgcacattcccatcgtgactgggtctttctctggagttggtatgtggttggtgggctactctccacccagtttgtgttcatgaaattgtctggttcactgtccactgattactcaagggtctttgttgctgagaagacagaacactaccaaggagcctggttgttaaggagtttccttagaaatgctaagcccaggccaggcgtggtggctcacacctgtaatcccagcactttgggaggctgaggtaggtggatcacttgaggccaggagttggataccagcctggtcaacatagtgaaaccccgtctctactaaaaatgcaaaaattagccaggcatggtggtgggcacctgtaatcccagctactcaggaggctgaggcatgagaatcgcttgaacctggtaggcagaggttgcagtgagccaagatcgcaccactgcactccagcctgggcgacagagcaacactgtctcaaaaaaataaaataaaataaaaaaagaagtgctaagccgaatgtttaggaaggagaacccaggcctccattctcagcaccgtattcccttcaggcactttacttccaagaaaaatcttctgtgaggcacacaatcactaaagaaaagtaagaggcaaactagctttgaaagcaaatcccatccctcagccctcagcaggttgcacaacctctaacacacgtggcctctctgttggtgcaggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattgggtaagtgaccagttgcccttctgttgggtacttaagggtgggagaatggagaagcaggaaaatttagctcaaagaaagaattaaggaaggcatggttaggaggggtggccaggcttaggcgtttaatttgattaatgataagcatacattctctcctttcctgacgtgtgaagaagtgagtgaactgtcacaaggttgtaaagataaaatgatcacaaccccttgattttcctgcctgccatgcacagcaccatttgctcacattaatagaattcagaaaatgtcctcagggagtgatggatccagattatcagggaggcagcaggcagggcaacttaaactttccccttgcttgtagtaactgaggtgctttgggagaaatgaattcaaaatttgtccctgttgtttttctataaataactataacttattttcacataattagattaaaatcctattttaaatgtaagaatttttttttcaacataaacacctgaactagaaaagatttgacatattattagaaaacaggtgtctctaactgctgccagattctataataacaaagtgtataatggctcaaacttgctggaagtttatttcctgctcctcaagtccaactgggtctcttcatccatggaacttctcctgcaagcagtgactcagggactcaggtgctttccatcttccaggctttaccatcttccacacatggctcctaaggtcatgctgcctagagggtcatgcataggaggataggcctttgccatgcccgctcccacatgctattagacggaacaggactgagccaggaggctgggaactagtgtagctgtaggcccaggaatcagaagaaataggattagtgagcaggtctctgccatgggacgtttgtatgcatgctggggtgggtggttgtatgaggggattgcattcttcagcccatgcaacacaacctctactaggttggtttcttttctttttagtctttcaggagtttctttaaatgtcaagattatgcaagtgactgcagtgagtggtaacttccaactcttgctttcctcatctccacatttaactttagtgagggtttgtgttgtaaggtccaaaactagtcatgagataggaaataactaagacttaagtttttactaagtgtcaagccccatactaaatattttctgtggattatctcatttaaatctcataacaatctgttgaggtctctaaggtaagtgtaagccagattttagagatgcagaaactgaggcctagagagaataacttacccaatattatacaaacagcaaggggtagagctggaatatgaatacagacaaactacttttagagtctgcatttgcatttttttttgagacggagtcttgctctgttgcccaggctggagtgcagtggtgcaatctcggctccctgcaacctccgcctcccgggttcaagccgattctcctgccccagtctcctgagtagctgagattataggtgcctgccaccacacctggctgatttttgtatttttagtagagatggggtttcaccatgttggccaggctggtcttgaactcctgacgtcaagcgacccatccacctcagcctcccaaagtgctgggattacaggcatgagccactgcatccggcctgcgtttgcgtttaatataatgtcttcttccccattcaaatcacactacaacacagacactttaccttaggctgagtaataatacctgtccctaaaccaccctacccccatgtcctaggggcttacctgaggatcatggtaggttatgctgcagtaacgtagagtctccaaatctcagtggctcaacacaatgaacgttttttttttgttggttttttttttttttgcttgtgcaacatctgatgagggctgagctgctttccttggcagctctccatgcagtaactcagggatccagctccttccatcttgtgatgccattctcaattcttggtcttccagctgccaccaaggggagagagctgttcttaaatccctgagccctcccctctccacaagtcctctttggtagccttcagagctcctagctccaagttgggctgggtgataggagcaagttagtgtgctggtggcataggctcttctgaatccctccagatccttctgtatactctcccagaagctgacttagatcttttcaggtattgggaactgacactggtggaaaaacagacaagaaaaagttttaaatacaaatgaactctaaattctttaaccacgaagaggcactaggcatcatcatttgctgggtttagcttcctcctggcgacaggtggccacagggactattactactttgattctgtctccaaggcccttttcagctaagtctgggtgtcaaatgtttttgttgaaattttgctgcttaccaggagcaacagcatcttaactgcaagccttaagccttttttcaattcatctgaaatagtgattttatttgcttcttttcacctctgtcctaattgggccctgtctccagacagatagggtgtgtccccactttcattcttccaaggcccttccactgaccgagacactagattggaagctggcagagaatcaagggctggctctaggcgctcagcatttaaatattcaaagttatgacacatcattacttattcagagctcactctctaagtcctctaaggcagagcctgttgcagacagtaaaactcctgacagtgagtacaaggcacactgaaaagctacttgtaaggcaggaagtccagtgaagaatgagaatgtggaaggaaacctcgggcctgagttatgtgaagctctcttctctgagctggggaggcacacgcagcgtgggggcacactgtggcttggtgagcaggccgagctttgtctccccacgtccaggcagcacggcatcctgtgtctcctgggttcaagtgattctcctgcctcagcctcctgagtagctggtattacaggcacgtgccaccacacccagctaatttttgtattttttagtagagatggggtttcaccatgttggccaggctggtcttgagctcctgacctcaggtgatccacccacctcagcttcccaaagtgctgagattacaggggtgggccaccacgcccagcctaaagtattttaaattattctgtttctgtttcttgaattgtggatccttcaggtggatccacagccagtcagtgtattggacctgctgacatgccttcatgaattgtttttcatgcaatttataagcttttcattagctcttccttggaggttgtgggggcatccctgcagagcagttttatgtttgccgttgtcgagaatctccaggttcaccgtgggactagtttttctgttaatttttcaattggagatgtcttcaccataaaagcagtgtattccaattgctcaggcctggagttacagtttttatgggtaattcatctcattcatggtagatggtcagcttccgtgctgctttcctagaccagtagctggagtttttctgtttctggttttagtagcacagcagctcattgtgctgttcggctttatgcagacagccctattccagtgttcagccctctgcaggactgaggctcagcatctattcctggtagaccctgctccaagcctgtagggcctcagtcaaggcctgacccattgcgggggtccttggcatgagtgcctgcccatttcctaccttttttttttgagaccgagtcttgctctgttactcaggctggagtgcagtggcgggatctcagctcactgcaacctccacctcctgggttcaagtgattatcctgactcagcctcctgagtagctgggattacaggtgcccaccaccatgcccagctaatttttgtatttttagtagagatggcgtttcaccacgttggccaggctggtcttgaactcctgacctcaggtgatctgcctgcctcagcctcctaaagtgctgagattacaggcgtgagccactgcacccagcccccacctattcttttaagtccattcatttgttttttggtgttttctttttttttttttttttttttttttgccaaaaccaaatacttctgaaaggtccattcatttattgaatggtttcctcttcgtttctgggatttactttctaagcttccagcctaggctatatattaaaaaattttaaattacattttatccagcagttgtatatgtttagagttagaagaagcagataagatgttttcattcctgttccatgacatggagagcctttccatgtcagcttgatccatgatattctcctgaggcattagattgttttctggatttgcctaggtctggtgtcttcaaattggattcactttttatacatacagacactcccttggctctttaaccatatatattttattttttatctcccttgttaataatccttaatttagtaactctgtatgcatggcgcttatttggggtctcacagcacagacacatgagaggggtaggatagtctcctggcatgaccccagaacgtccggatcttcaggccactcagacagctgctctggggttaagtcagataactcatcacaggtgacatcctattccagtgtcagtggagactctcctagcgtctgtgtgacaaagctcttttcctaagtgactctgacttggttatagtaaattctctacaatgaaggcttctctctggcaaacacatcttctaattcctaactacttaacagtcattctttgcagtaaaaatgtatctgctcattgctgtttgcgggagtgaaagggaggaggtaaaacatgctgagctgtagctgagtttgtcacagctttcctggttaaacagcaatcattattcagtttcttttctccctgtccgcaaccaaccggaccaagtgtaaaaaaaccacacacctgaagtcctaaatcatgggccagagccacataggccagggcaggatcttggaggaagagagagggggagagtttggatagacttacttccttctgggcctatgatccacttgccaaatagctacagatgggacctcagttccttcttccagctgggaatgtaatttccatgattgttcttttcatgacaaaatgaggaggtaatggaaagtttgggtggcccgaggctgaggttaaaagagagttccacctgtccaagtacaaggtgttcatgaagacttcgggaaaggagaagggagaaacacaaaggaaagccaggcagggagatcccatcgctgccgccggccccgagagggagagcgcgactatcacaggagtggggctgattgattctgtgcagggtgggcctgttgctggggactctgtgctgtgctgttgtgactgtgtggatggagaagggactgtagccctgagagggaatggaatagccccttagagaaccaaagattgcccctttacagaagggagcctgcccagacctgccctggtgagtctgctttttgacagcatttaaggcagggtcctcctagctgttgctaaggctgttttctttcccatgtatgcagcttgaattagattataaagcctttccctcaggcctgttagtgctcgttttccatcatttatcctgaaagagcgacttccttaacatggctggagaccctgcacagtctggcccagcctgcctcccaggctcctcctcgcccatcctcacccgttactctgcaccacagccccccgacctccctctgtccttgggctctgtgctcccttctgccacaggactcttgcacatgctcttctctggctgggacactctcccctcttccctttactttgtgaacccattggtaaaacaatataagctctctcttccaactttattagttctagatcaagctgaaactcttagagctgtaatggaaagtaactcccttcaggaatagggccacttggagtctccacaggagactgaaaaggagatcaccccatatttcaggagaaaggcttggtattaacctattattgatgtgtaatacttccttcttttgtaatttccagacataactttccatttgaagatgcttagtttctaaataatttttattgcatttagcagaattgatagtttgttggtacaatatttagaaacgaatgaagaagcagataagatgttttcattcctgttccattcagcatttgtccatgtgcctgcacatcctggtcactgagtggattgacatgacgagattatgtgatcctgtgatcctttgttgcgtggcagcaacattgatgtagaagctggttgcatggagtaactgcacttacattgccctcactgggcatcatccatgttccttagcccagaggacacttcctctccactctgcctaggctggcccacaccccgggtcccacatacctttcaatgcctatgtcaagtcttcctccaaccacagtagcctactattatctctgtttcctttgaacaatttgtccataccattcatttataacttggcatatactgccttgcctgcagtttagggctgatgtttggagaacaggaactatgttatttatctttgctctctctgctgtgcctgtcctggggcatgtggtaggtgctgggtaaatagttattggtgcctctcaaggcactcagtgaatgctcagaacacttggttaagatttacagacaatgatggaaaagtgactcttctcttcttcctctctagttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggtaactttcctttctggtcctgtccctgcatggggaggtcaaggtagagagcgtcagtgggtgttggtacttcctgcaggagtctttgagtgccccagcatgtggctcctgaccactctgaagtcagagggtgagctcagtggaacttctgggaaatctacagcagtcaaatcagccggagctcgggaatggattgggctggtctgtgtctctgtgtcagggtgtggttgtgtgcaatggagtactgtctgctagaagacagctgtctgcatttatacattggctttttggtttattttcaggggaaaaaagtaaaggtcaagtcataggcatagaagcttgtagagctttctggaccaattttggcaaaccttagagattgctctcttgggaaacccagttgaaaaagaattgtgtgaggccgggcgtggtggctcacgcctgtaatcccagcactttgggaggccgaggcaggtggatcacgaggtcaggagttcaaggccagcctggccaacatagtgaaaccctgtctctactgaaaatacaaaaaaattagccgggcatggtgacgggtgcctgtaatcccagctactcgggaggctgaggcaggagaatcgcttgaaccaggaggcggaggttgcagtgagtggagattgtgccactgcactccagcctgggcgacagtgtgagactctgtctcaaatttaaaaaaaaaaaaaaagaaagaaaaagaattgtgtggcatctttggttgcaattctagttgttttcctcctgcttctctgtgatatatgaatccagagggagggcctagacttagatcagaaatgaactcatgcttcgagaggttccaatcttagcaaaatatataaatggaatgttggtgataacatagtcttaaaataattttctactgttgaaacaacccaataacaataacaaaaaaaaaacactcttaaattcactatcataacacatactttaaaaatctgtgagtctcttcttagtctttgtgcatacatttcatattttttcaaagtggtcatcaatagagtgtgaataattggtaatactttcttgaaaattcaggcagattcctcaataggtggggactcttccatttggtgagggcagggtcagaggctagaactcagtctagagagcctgcatatggcagctgctattcacttattaagtgataagcacttaattgctcacttacacagtttctgacctcagagcctgaatctggtgtgtcacacagactcctgtttcctctccactcaatccttgacaagatgggaagaaaaccccagttgtcctttctgaaataaaaaaccaaaatggcagaaggaaatggataaggagaaggtaaaatgtaaagaaagcagcaacagccatctgccattctcttgatcccactgtggttctgcccatcacagagtctgtgggcccctcctggagaagaaggtagcagtggcttcctatccaggaaggctgcagtgtggcctcttcccagctactggccagagccaaattgtttgattcagaagtccctggtgtctcttagcagtctgagagagacacatggaaacatggttagaatgtattcagtcctgaacctttcaaatgtttcacaaaatagtttatgaatttgattcagaaagaaaaattatatttttgactgactttcagatattgactataggaggcgttttctccacagacattcagccaaattctgcttcttggtagggaaaaaaatagtgcagagaagacataggatccccctcatctccccaccttgaggattttatggattttctttttttggagagagaaattcatctttctctggagaaagaacccaattacaggcctaagcagtgtctgagtatattttattcaattagatgaattgaaagggcatgattgatcacttggaccacagtggtctttgagaagccatttgatccagtctatgtctatggaaccttcctgtgccatccctgatggatgaaatcttcaaccctttgaaaacacagtatttcaagactcaagcatttcagaggcgatgctagcagattttctcagttcattgtctggacctggtgaattattgttgacggagaggcactttgtgagcaagtttcaggcttatacctgttgaaatttgctctttattcctcaccacgacctttgcaaaagggaatacctggaaagttaatgattgctcagaattatgcagccaatgtgcctccagcatctctctttgccttttcttttccattgtgctgtcagtttatgttcaggtgcatactaagcaatttatttctcacttgacatcacctacttataaaacatgtcatccttcctggctcaccacagccttatggtgacaaaaaattggaagtagtttatggactacttttggatgaaagactacgcaacagtcatactacttaaaatatttaatgacttgaggctgggcgcggtggctcacgcctgtaatcctagcactttgagaggctgaggcgggcagatcatgaggtcaggagatcgagaccatcctggctaacgcggtgaaaccccgtctctactaaaaatacaaaaaattagccgggcgtggtggcaggcgcctgtagtcccagctactcgggaggctgaggcaggagaatggtgtgaaccccggaggcggagctttcagtgaaccgagatcatgccactgcactccagcctgggcaacagagcaagactctgtctcaaaaaaaaaaaaattttaatgacttgaataatatgtaaggtattagtatcagatggctttaatagtaactttgctctctcttggctccctcttctaggaaaaattgtccttagggaagatacaacccaatgttttatgttttaagaatttccagaataatatgtaagataaattaagattggcatgggaagcaggttataaaacaatatggacagtatacttctgttttgcaaacaaaagaaagaaaaaatgtggaaaagattggaaatggaacaaaatggtaacagtggttgtctcaggtgacaagattatatttttctgataggtgataggcttattttcttctttggctttttgtttaatatttacctaaatttccacagtgaataagtatgatttctttttttttttttttattctggaacagtttcagaataaagaatagtgaaatgaaaccccatgtactcattgttcgtctttaatgattactaactcatgaccagtcttgttgcatttgtattcccaaccacacccatatttgaagcagatcttggctatcatttgtaagtcctaagtatcccttactttgtttactgaatgctgtgtctcctcctgatctggccagattaaaggcccttccactgaatcctgcaaacagtggaacagagggagaaggcctggaatcttgtgcagttggctctgtgcgtcataggggctggagttggccaggcaattccccggcagcgctgcacgctctacttcccctgaccctgtgccctggagatggagctgataacaggcctatctcccagcgccacagggagctctttgtcctggttttattctcactctggttttattctcattcttgtttccctgaatggactgttagttatcaacttgtgggatttaggggtatggaatattcacatgtctgactttaaatccacctctgtggcctgctcttgaaagatgttctttgcaaaaagaaggaaactacctgtttctatttaggattcattccatttatgataaggaccctgtttctatgaatggaggttttgagttgctttatttatcccctgcaggtcacattgctgtgagaggccatctaacagcatccacagctaagggatgcttctgtcgtcaaggcgggcattttttctaatgcactgttcctggctgggttggagttggagaatgccactgcctgtaatttcttatctttacccagagcctatgattgaacctgtttatacttttttatggtcagaataatggtttctctgccaggaccttctagaagttgactctaagttgtttgttctgaaattgtgcaggcggaagtgtgatgtgtggttcagactggaaatatggctgctttcctcttctctcaaaacagggcacgcccttggcctagggaggacagagggtgagcagttgcctggaagctctgggtcccaagttgtcagttatcactttgctcttcttcatggctctcaggttaaagaagttacttgtacatttgagcttggctgggtacatgctggctgcacagtattctatgtgctgctttttttcgtcagccagaaaataaatcagtgcaacccaatgcgtttccctgtttgtctccactgctagagccctggcacttatcctttgtattctttagacagagtttctgttttaatcctgattcttttaattttgcctgtgttcaatttttaaagcatttatttcctctcaaaaatagttggatgagtaagtcttaaagcaaacaaggtaaatttatgtattgaataaaatttttttggcaggaattgagacctttattcttccctggccagaatatcttatctaaaatgaagaccacagcctcagaggagccgtgattcttgttggaggatccttaccagaatcctacagtatattggtaggactctgataagggttgttcccattttacaggggtggaaactgagtatcacagggactaattgcatttagtaaggagtagaaccagaatgtgaaccagttctgttgatttgaaattctgtgccctttttattactcagtgactgtgtgctctgggaagtaacaataatgcactattgagtaaggggcactgcatttatttatttaaaacaatttttttttctttttcttttttttttgaaaggagatctcattctatcgcccaggctggagtgctgtggtgttatcatggctcactgcaaccttgcccagctaatttttttgtatttttagtaaagacatggtttgtccatgttggccaggctggtcttgaacttctgggctcaagtgatctgcccacctcagcctcccaaaatgctgggattataggtgtgagccactgcacacagcctgttgaattttttttttttttaataatacattccaaacctaggaaggcactgaatttagagtcatgttttccttactcaagctctgcctcttctgttatcggctgcctccatggaagccagttgacttctccaggcctcagagagcacatctgggagatgcagggaggcatgggactggagggaggtgctccaggttgccttccatctgtgccagccagtgccacttctcgcagaggacttggtcacagccctgtctcctttgctcaaggcctttgattttgcttttttgtctcttctggctcaggcttaagcctcagacccagtagaggctgctgcagacacctgtaaaatgtggaaaattccccagtcccagagtcaggcacaactttgtcagggtttcctcttgctccctcccagctcccagttcctgcagaattgactcgctttcttttgacttattgcctgatttcttttagacctcagacttgtgtcacttttccaagcatgagttgagaaatacaggaaattgcctttctttcctcaaggaaggcatccccccactcctcaaacctctgcaccacctgaagagagggacccgccacatgttctgcttcccagctgtctgcgttgtctgtctcagcatgtgtgagctgcttctgctagcagatcgcaccacaggtttccggggcttgatccagcgccaggctgcctgctcttcctgtgctgccgtgtctttggggaagcaccattaaagtattggatttctctgggcattgcgcatgcaggtgtgcagaccctctgccctgtagggttgttgtcagacaggtgtggcgcagcttccccttggctttctatgtggcagacggcagtggtttcatgtgcacttctgaatccttctactgttttggtctctgaggcgacatcccaagtgcaggactccgtggtttccttgctctgccttctgctgtgagctgtgttgtgggctccgcagccccaccgacagctgctgttctgggttgagcggtgggaactggctgagtcataactcagtatcgtgaacagggcacgtgggagagtttgcgtttctttttgccctctagtgtaaacaagtcacgtgcctgccttgcacctgtgcttaggaggtgtctacacgtgctggtggctcccttcactgaccaaggcagggaataatcatcctggggaaagggtaggaggcccctttgatggctggggctctgttttcataccaggtgagaatgtcaattttttattttaagtcagaggctccttcttgcttggaatgtccactgagcaaagatgaaaggagacaggaatttgctcttgggctcctgttgcaaggctctctgcctgtggcctctacctgtggcctctgcattccagccacagtgacctggagtgcgttactctgactcaggcaaggcctttgcatgtgttgtttcctctgtttggatactccattcctgtattcctggttttctttgatactacttccctgtattcctggtttgcttgcttgcttccttccttccttctttcctccctcccctccctccccttcctcctgtccgtccttccctccctccctccctccccatccttcccttctctctctctctttccttccttctttccttccttccttcctccctccctccccccgctccctcccctccctccccttcctcgcctccctccttccttccctcctctccctccctcccttcccatccttcccttctttctctctctctttccttccttccttccttctttctttctttgtttccttctttctttctttctttcagtagattttattttttatagcagttttaggttcatagcaaaaatgaatagaaaataaagaattcccacaacttccctctgaccactgcgcacacaacctcccccaccatcagcattccacatcagtgtggtatatttgttacaatcagtgacccagtcagtgttgacacatcattatcaaccagagtccatagttcacattagggttcactcttggtttgtacagttctgtgggttttaacaaatgtacgacaacaggtagccaccattaaatatcacacagagtagcttccctgccccggaagtccctgtgctccacttgtccattcctgcttcctcccccggaatctgttttccttttaatgtctaacctgtgcctgtttgtgtttcagatttcagcttcactgtctgtttgtcagagaagccctccctggtggacttccctgagtaggtcaggatgccctggctccaggcaagcccttaatcacttctgtcctagttatcatcttatttttatttatttgaagcattcctggaatgcctgcctccctttgagatagtaaactccctgaaggcagggactatgtcttttttcttatgactatattcccagcaccagacactgctgggcacataacagatgcttgttaaacatctgggaacaaaggcttcattctcacaggtgcctttatgcttctgaagttcaggaataccaggttcttctggccccaagcttgtcccgtcctggatgggacttccaccctcccatccaccaggctgcctccatggaatttacagtgcttcatgcaaattcattaaagcagaaccagaagtactattacttggtaatacttttccattcagaaagcatttattggctgtccaataaatgctcagtggcaggtatggtggagaaaattaaagatagatgagaagtctctatcctctgggatttgatttgagcctgcagatccattagaagggaaataaaacaacctgtttggaaacattagattgaaccatataaaattattgatatttattgatgatatttgttatttgcctattgatgtttttcctgcaaaaatggaaaattcatatggttcaaccttcttcattccaaaatgttctataattcagattggactgtgtcacagagtacagattagaaatgtcatcctgcacattgctgggatttgagctcaagaggaatgtctgtatcctgagtcataggccaagatttctttttcccaaggaaagaaatgctacacttttggcctcattaaatttagccacagaacagatttttttaaaaaagatatttcattgcaaacagtggatggaagtaggaaaaacaaactaaaaagaatgtgtatattgttttaaagggatggaaatatgcctgaatgtcaacatgattcgggaaaccaatcacagagaccctctaaccttgttttcccttatgtgctgtggagactcctctgtccccaagctcagatctactgtgggagctgcccactggctgcccaggtcagtcccctttccttcctcattcctgccttgaaacctgtcccctcttcctcagtgcttgcctgaaaggttaatggacagtgttttgttattacatttgaaaacgtcttgagtacttactgtgtacaagacgtcctgttaggtgctgtggggaatgcagagttgaagtagccgtgatgcctgtctccatgagcatcactctagttgtaggactgatgtatgtgtaggatctaaggcacagccagagaacagactctgtggaaggactggctccttcagacccgtggttcagttagagtattcttctctctcaaggggtcatcctggtctcttgcttcctggtgaggtgctggtgctaatgatgctgttgatcaccactggctgagtgcttttgagagccaggctctgtaccaggcatttaacagggtttctttcacatactcctttgaaggtggctttactatctcctttgatgaggaaacaagcctagaaaggtgaagtaacttccccaaagttttacagccacaaaaggcagcaccagaattggaaaccttatctacctgctggtatggcttaaccttgacattagagtatctgccatcttttgaagtcacacaggaacacagaagtgggaagagtgtgcttccaaagagagcacagtcccagtctatggaaccatcacaatttacccacatgacccagtttgccaactgtagaatggtactgaaacagtcccaggggaagaaagttgcatgtgccactcttttctggagctaagagtttcctctctatcagaaacagttatcatgtgactctatcagccctcaggattttccagggaggccactggtactgtcccaaggttagcatgctgatggatatgtgaaatgcttatctttgcctctggcttccctgtctgtaaaatggaaactctgatatctgccttctcattcctaatttggagggtgtctcagacccatcggctcttctcccttgggcttgctcagatagcactgaggcacaatgctgcttttcacgtggtggatcttttccagcagagagagtacatgtgcctggtgactcttctgtgataactggggcccctgggctgcgttgataacagtcttgagggcctcttcatttggacaattgttaattttaattaggcagattgacctcgggatcagagaacctagaaatttaaagctacagtctctgggatggcatctttattccagaactcccttgtgtttgaactagcaagccaagctcagtgagccagcccatgttcaggcaggccccacttgtgttttccgacagctgagtgggacgttggctttcctcagattcccaagaattgatggtctgggccttcccctgcaccttcccacggggcgtccttgaatctgcctgtctcacttgtcatgctctgccattgtccatttgcgtaaataagttactatgaaatggacctggggatccccaggcttaacatgagccagtaggaagattcagctgccaaacacaggcctcatgctccaggtccaattcagagcccacaggccacttttccagcctagttcctctgtgcaggtcagaccacatccagggaaccatgcctggcctgcctctgggagctgtgtttaagacagacattgacagcgagagagcagaggggataagtgggtggtgccgggcatgggaaccacatcctcagaggagagacaccataggaagtagcatggtaactgacctcagatatcattataaaagagggaatagacccttttggctattccaggggatgtactagggtagccacaggaaagcaggttggagtccaatgtaaggaagaattttcttgtttttttgttgttgttgttgttgttcgtttgagatggagttgtgctctgtcacccaggctggagttcagtggtgtgatctcagctcactgcaacctctgcctcctgggttcaagcaattctcttgcctcagcctcccaagtagctaggattacaggcacgtgccaccacgcctggctaacttttgtgtttttagtagagacgggatttcatcatgttggccaggccggtctcaaactcctgacctcaggtaatgcatctgccttggcctcccaaagggctaggattacaggcatgagccaccgtgcccggccaaggaagaattttctatcaaggagagctgcttagcagtgtggcagtgagtatgtgtgtgggccccatacccaggtggcagatgctggaggaaagatccctgcactggatgggaggctgtacaagaacctctgaggttccttccagaattcaggtgctacatgttttctctgtttttctacacagtcatccattggtgcttttgtcctgttgtagccccttggagcctgtcttctctggttctcagcagtgcaccctctaagctgcccctgtatttggccacagtgaccatgaactctgctatacatgttcattttatttgccaagtgcagctgactttgagctgacttcttcctggctcctgttggcttcccatggagccaccttaccatatgggtgaaagtcaggtgggacagagaccagggaaaaactgtggagggtggggcagagaaggatggaagctgttcttggttctctgtgtgagcttccttttttgtcagacctgtagccagagtgtgactcctttcagccttaagaagccaaattgctccacaggctggaagcttgcgtcctcaaactagtgaaaccaggtcctttactccctaaccatttgtttctctctctgccagtccctgttctctggggccagatgttggaagtgaacaagccagcgagtctgtcttcactcctgggaggagtccatttttgttaattttctcagtgactgggaagggctggtcttccatctcattcctgcttccccttttcatggatgactgagagtgaggtcagattttaaggaactgagaggaggaaataggtctgctggtcttaaaagagagaggcgagtgatgagagtttggtggcgtcgcagggtgaagagaaggcttgttattagtgggccatgaacatatttgtaggcacatggaagggaccagaggagacagtgacaatggaataaattctccaaagagggtggggtttgcagggctgtgtttcctcaaggagggaggagcacttcttcccttgggatggtgagatcagagcgaggctgggaggacatgccagtttgtttcagacggagaggagagcactggctgaaaggcatcctagggcctaggaccagaactgtgagatcctgggaataggtgaagggagaagtccttttacctatctctgtgggtgacgaaacaagtgaggtcgttccctcgcatgagtgtggaagcaggagttggaaatagacctcgtggtgaatttgacagtgaacaaagaaaagtgacaggactcgcagccctgaccggatgcctggcttcatgcatctgcgtccagtgcgtttccgccccacgcgctcctaacgctttcatctgaggctgacctctgtcatgtttagcgaaattggttttgtttacattttggctttacttaaagacatagagaaaagttcagctaaataaataggtcttctccttcttttaaaaactatttataaaaagagaatatattcaacataaaaaattagaaaatgtagataagcagaaaggaaataagcatcacccataattctattaatataaagataagatgatgtttttctgaattatagatataagtgacagtttttcaactccgtggaaatactatgatgataactattaattactattgatcccataccagatactgaatggggtgctcaatgtgtatcatcttctttaattctctcaacaaccctattttatcaatactattattacctccctcttataaacaaggaagctgagatagggaaagattaagtaagttgtctaagatcacaaaaacaagataagggagacatgggaccgaaatcagattagccagatacctgagcccatgcacctaaattctgtgtgaatactgctattaaataaaaaagtatttgggcccagtgtggtggcgcatgcgtgtaatcccagcactttgggaggccagcactgcgatggcttgagcctaggagttcaagaccagcctgagcatcgaagtataattgatgtacaatgagctacacatattgaaagtgtacagtttaacaaattttgacatttatgtacactcacgaaagcaactctgcgatcaaggtaacaaacatatccttcacccctaaaagtgtatttgtgcccctttatcatcatttcttcctcttctccctcctgcctcccttaccccaggcaatgaatttgctttctgtcactacacactagactgcatttactcaaatttcatatgcctagtatacactctttttttgcctgccttatttcccttagcagttattttgagattcattcacgccgttagtgtatccattcattccttttgttgctgagtagtattccatcgcatagatatgcaacagtttatgtatccattcatctgttaatggacattagtttttgcctgttatgagagagctgctgtaaatgttcatgttcatgtctttgtatggacgtatgctttcatttcccttgggtcagtacccaggagtgggatggttgggtcatatggtaggtctttaactttttaagaaactgccaaactgttttccaaagtttcacgcacgtccctgtgaagagaccaccaaacaggctttgcgcgaacaataaagctttttaatcacctgggtgcaggcaggctgagtctgaaaagagagtcagcgaagggagctggcggcgggggcgttgggggggtgctgttttataagatttgggtaggtagtggaaaattacagtcaaagggggttgttctctggctggcaggggtgggggtcacaaggtgctcagtgggggagcttttgagccaggatgagcgaggagaaggaatttcacaaggtaatgtcatcagttaaggcagggaccggccattttcacttttgtggtggaatgtcatcagttcaggcaggaacaggccattttcacttcttttgtgattcttcacttgctgcgggccatctggatgtatacgtgcaggtcacaggggatacgatggcttagcttgggctcagaggcctgacacaaagaacatttatcattttacattcctaccagcagggcgtgagggttccggtctctacatatctttatcaacatttgatgtggtcagtcttaaattttagatactgtaaaggcatgtggtaggatcttattgtagttttgaattaatacaaggcttttaaattgtttagcatgcaataatttatattccctgtaacagttatatagcttcacatatcaattagtaaaaggagaagagaagaaatgtaaaaattattactggtcctggaataataattacaagttccctttatagtcccttttgtgtgttaactataatactttttaatacatcctgtctaaacctagcagcagctctgcaaagcaggcttatttccattttacagatgaagaactgaggctgaggaggtgaagtgactgactgaggggcccacagttagaacagagcaaagatttgacctcagaatctgttccaaagctgatgtactctggccctcatgctatattccatttgtagttcattgtttttttttgttttgttttgttgttttgtgtttcaatccactttcccacttttgcttccttccccaaacgtggaatacagaactcaagccttcaaaacagctagctctgccagccaacccaacaataagggaaattatttttaatgtaaatactctgtggagtcaccacttgtaaagcctccaagcctgaaagcctgggtgatgaacgagcatgtcctgactcattcgcagcagcccaacctctgggccaagtttgttaacaccatttacataacaagagcccacttcacagaaaacagaattattattcttatgctgagccatccttcacttgtggagctatttccattttagatgcaaccttccattcaacaaacatttattttggatccagcagccacaagttgagagcccatcatgaaccaggcacgtttatgaattatcccatttattacatgcacagttcttctctgtatacgaatgtgggcaagagtttggtcatctgaatctggcttctctggcccttgctagttgatgggctggtcacttcatctctctgaacaccagtttccttacctatgagattgcaatatattacctatgtcacaaaggttgcagtgaagattaagtggaataatggaagtgcacaatacatgttttatattattattcctgttctactgataagaaaaaagcttttgaggtgttgaatagttggctgaaactgcacaggtaagtaggggcagcaagaaaattcacatgctcatcagaaggcacccgaattccacattgttctgtcttcttactgccaccccactttgtgtccccacaagaccctcaagaagctggcgtggaggaactggagactgaagaagttaaatgacagagccacattcagagcccagttttgcagaagttgtgcccgcctattaaagacaacttggaaaataatgggaaaacaaaaaattgtctataactttaaccccagtcccaaccacaaccacattatggggtattttgttctcttaatggagagttatgcttgtttcttaagtagtttgtaatcacactataactatagtgctgaattctttgttttcatcttatattgtagatatttacatataattttatcctttctatgaataatttctgatggctgtagaggagatatctgagtttatttaccttttccagcacagtaggatattcatgcctttccctttttctcactattaataaaaatactgttgcatatatttcagaatacttcttgtggatagattcccctgaagtagaatcactgagtcaaggataatttacacagagtaaaattgaccctttttaggtataaagtcttatagccacccccacaattgagatatggattatttccatcaccccggaaagtttcccagcatgcctttgtcatccatctcctcccatgaccctaagccactttggcgactactgatctgttttctgtacctgtatttttttctttttctggataccatatgaatggaattagccttttgagtctggctttttgcccttaacgtaatgctttgagattcatccatgttgtggtgtgttatcagtagtttgttcctttttattgcagtgtagtatttaattgtatggatgtattatgatgtgtctgttgattactgatggacatttgggttgtttctagtttatgatgattgcaaataacatttttataaatacttgcatataggtttttatttgagcataaagtttaatttcttttgggtaaataccaaagagtggaattgctggattgatagtaagtgtatatgtaactttgtaagaatctgtcaaactgttttccagagttggtgaaacattttgtattctcttaggcaattatgagagttctaatctttccactttttttttttttttttttgagacggagtctcgctctgttgcccaggctggagtgcagtggcatgatcttggctcactgcaaactgtgcctcccaggttcacgccattctcctgccttagcctcccgagtagctgggattacaggcacccaccaccacgcccagctaattttttgtattttagtagagacggggtttcaccgtgttagccaggatggtctcgatcttctgacctcgtgatccacccacctcggcctcccaaagtgctgggattacaggcatgagccaccgcgccaggcctcgttccacatttttatcagcacttgatactgtcagagtttgtttgttggtttgctattcaaatacggatctaatggctatctcgctgtggttcaaatttgcatttccttaatgactaatgatgttgagaacccttttgtgtgcttgtttccacccatatctcttctttggtgaattgtctgtgcaaatcttttgaccactttttaaattcagttgtttgggttttttcttagtgactaatgacagttctttatatattctgtaaacaaatcctttatcagattttaattttttcaaatattttctcccagtctgtgccctgtcatttcattttctccacagtatttttcaaagaaggttttgaacaaataagtttttgttttgatgaagcccagttcatcaactttttatcctatgaatcatcttatctaagaaatctttgcctatgtcacagtcacaaagattttctcctaggtttccttcagaagttttatagctttaggtctacgtttaggtcaatgatccactttgagttaatttttgtgtgtgatgagacatatgggttgaacttcattttttttgcatatgaatatccagttccagtatttgctgctgaattgactagatatgtgtggatctatttttgctctatctatcccagtccactgatctatgcattctgtcattgcatatattttgtcatgaccatagccttgattactgtagctttgtaataagtcttgacctaagatacgaagtcctccaactttgttctttttcaaaattgttttgctagtttccattgcttacaatttcatataaatattataatcagcttgtcattttctcaaaaaggccttctaggcttttgattgtgattgtgtcaaatctataaaccaatttgcagagagatggcgtctcaacaccatcggctcttccaatcctgaaatgatatctctgtccatttatttaggtttctgattttccttaaggttcttaatacaatttgtcaaattaaaagttggttttctgcttccttgctagggtgttgagcacatggctgtgcccttttggataacagattcacatgtttcctgcaaaaaactctactagtttatactttctctctattgtattttatttcccaagcatctggctccctcttttccacaatccatggcttataatgcattgccttatttatttaataggttttaactctttatcaaaatgtacacatcaaaaactatagttatatatatagtttatatatatttatatatagtttatatatatactatacatctcgataaatgctcataaggtcaagaaacagaacatcaccagcaccttgaaagcctctttgtgaccccttccaatcctgacagcaaggagaaccactattccaactcctacccataagtagttttgttatggcttagcatttcattgcagtaagggaccttctaggcttctcactccaggttcctaaaatgtgtctggcctcttcactgtgctcctttcccctctgagcttctgttagcgcctagaatgcccacttcctcttctgccttctcccttcttattccttctttcagcttcctttaatttttttaaaattatttgtttttatttttatttatttatttttttacagacaggatcttgctctgttgcccaggctggagcacagtggcatgatcatagctcactgcagtctcaaactcctgggctcaagtgatcctcctgccttggccacctgaatagttgggatgacaggtgcacatctccatggctggctaattttttaatattttttgtagagatggggtctccctatgttgcctaggctggtcttgaactcctggcctcatgccgtcctctcacctcagcctcccaaagtgttgggattctaggtgtgagccatcccaccctctttcagcttccttgaagtgtcctcctcattttttccagctcagtttaagtttcgtctgcgctgggaagcctctccctcctcctcctctccctggcttccattagcattggactttccttcattaacactcctgtcatggtgtattgaagttgctgtttccatttgactataagctctttgaggtctggaactagcttttctgtggacccagtgccttctgtggggcctggcatgcagtaagagatcagtgattgaatgctggatgaatattgagtgtctaggaaactgattctccaaaaggctaatccctttgttcactgtaggtctcctggctgtcagtcctcactggcttcttttcaaacttcttttcctcctcatgttggcgggctcttttgtgatttatttattttttatttccatgccgcctctggagcaagtgagaaaatatcatagctcttttggctgttttatccaccattatgatgataagtaagagaggatgataccctctactcttcatctgtcgtaagagagcaatagcttttaacctgtaaggtctgtgaatccagtctcctatttcagtagcaagtgtgcaggtatagaagactctcagcagtgtttaaatccttcatttattcatgctgctaccgacgcatttggggatgcccgttcaccattactatgaaggcgaccatatcccagtgtttcttgctctgtatcaaggtctagctgctcctaaaaatgatgactgggagtgtttttgtgtagagttggcaccacagtggcagagtatgaaaaatgtagagtccttcctttccaatacagactgtattcagctgtgcctccatctgaattctggataaatttcagatagtggagcagaaagggagaaaagggatctgattgactttaactaccaatgtggctcaaataacaattggaatggtttatatctaccagaatagacggcaggttttacaaaccctcaaaagacagacccatctattggtcatttgagtgctctgttctgattgactcaggtctaatggggggacttaacaatcttaaccatcatcttagactagctagcccagccaaccaggggatgttgttgggggaaaggttaaaagttgttctggggaaggaagaatagctgaggccaaaaggggaagcatccaggaggagcagctctcaggggtcatcagtgaaaggagcagagaagagtatgatgagctggagggagggggtttcaggtgcattggccaaagtgggcaaagacttggacatttgtctgtgtgcatctgggcttccccagtccaggctgcgtctcttcggagcctctgtggaatccctccccagtggttttgtgagtgtgccccaggtacacatggcaaggggaatgcctctgattcaggccgtgactcctggagaggggccagtgccctgcatgaccagggcaggactgggcagaaagactggtgtacccatccaccttctgtccttcaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggtgagtgccgggaaccagatcccccctccctgttgcctctcttgtgaccctgcccgtggtcttagtacttgcccagccttgaaaccttcctctggccctcagtattcactggctttctgatcccttcttggggttgggtttcattattcagtcttctccaactgggtttccggaactcctaattgacttacaacatttctcagggatttctgtagctggttcatctttctgtcaatgtgcgtctaaatgggaagtgtttggttgggatacgggtggcccaggggaaacaggatagatctcatagtggggagggtgtcttaaaggagggtgggtgctgtgcccctgcagaagtcacaactggtatagaagttatggggcaggacttcctgacttctagacgtgggctcccagaggtggtgagttgcctgtcagtgttagtggtggtgggcagaagtgttctgcatggaatgagaggtcccaaggaccatctactcccaacagtctataaccacaactatgcaatttgaaagaatttgtgcaaaatttcaaagatatataataatagaccagtaaaatgaaccctacatgcccatcacccagacccaacaatgatcaagatcttgcatactcactgtgcaattttcctgccaaaatctgcatccttttctttctcaaatccattctggtggccaaagaggaattcttcccaattttcttccttagagaagcccattttctccagtttcaagaggtggtcagtgcccaagccttccatcttgtttaagaataatggaatctgaaaaaaggactataactgtaggacctcaccagatgcgggcccctgtacccatcattagtcctcaaaatccctcaggacactgttaaactgcctcttagcttcctctcttcttcctctttctgcacccctgccccatggcccaacttttagtccagagctcggcaccctcctctgcccgtctgagccacaagcaggatgaagcaggacctgtgggggatgttggcagacctaagctttaggcataggagaaggaaaatagggcaaggaggcagggaggaaaagtcttagaggagagaggacaggtaagaggcactgatgacagagggtaggatgtggtggctgttctctagggcgtccccactagtccccctccctgctgaaaggatggagacacagacaagatatggaaaacctccactcatcacctctccactctggggtgagaggagtgaatctagtttggtgaatgccagagggtcctttccttgagggtctcctctactcagttccttagttcaggagctaccaagaaggcttagttattaagggactctaaggggccacctaaggaaaaggtgcttccctggcaaatgctggctgctgactgtgcattggagccaggtgctggtatctacacctgttaggaatgtcatagccttgacttttgccttggccctaggactatccatcccttgccttgcttggagagaaattggcagagaacaacatcaacctcatctttgcagtgacaaaaaaccattatatgctgtacaaggtatgctgggagggagggaggctagtgatttgtggggtgaagtgggtggtgaggagtgtttacaactctgcctatctgggggaaattcaaaggaggggtggaatatagcccagtcttgatctaatggaaaataataggaggaaacaattaagcattcgcatagcagtgaataccttacaagaaatttgaacatatagtatctaatttgattctgagaaaaaccttgaaaatagcatgaattcccatttttttgggtgatgaattggaaacagagaggcacactctactagagaaggaaaatataaaatgaaatgaagatacacacaaagaaaagtaaggcatctcatcaggctacgtcactaatctctgtattccagagctttatgcctgagcctgcagactataggagaccagtgggctagtctggcgcagaaattcccaaagaaaccaataaatgtcctgagtgaatacagcagtctgcatatggatctgttccatttaaagaaactgttcctgggtcaccctggactgccgcatttagtctggggcaggaattcccaaagaaaccaataagtgtcctgagtgaatagagcagtctgggtatggatctgttccgtctaaagaaactgttcctgggtcaccctggaccatcttcaaaaactccccacatgaacgtgctccttctcacaatcacagatgagccaagtttgaattacagatctcctcggtgtgctcatgtaagctaaatgtaaactcgtctctgagattcttttacgtgatgaagcaatgagaacttaatctggaatccctctccaccctccacccccagaacagctggccatagttccctctccttcttgctcttgaatgtccacaaaagaacctttgtctgattgtgtttttctattgctcctgcctgagattatcactgataaaatgccacttatattttcttgagttctttatcctcctttagttcaaatcaatgttagaagatgaaacaagggaaaaggattgtttttctttttttgtttagtggaagatagcaggataaagcctattcagggcgtggtggtgtgtgcctacaatcccagctaccggggaggctgaggcaggagaatctcttgaacccagggggcagaggttgccgtgaaccaagattgcacaattgcactccagcctgggggacagagtgagattctgtcgcaaaaaaaaaaaaaaaaaaaaaaaaaaagcctatgcacttacaaataacgttttatgtttttagagggctcaattgcacagactgtattgggtttccagatatttccagagggaagaagtccatactggcttaagcatccttcctcagagctaaatacaccttgcttgggggaggaagcccatccagtcccaaggcaggcagagggtgggagatgtctctgtcactgttagaagtggaagactcaggagttagtacagatgaaagaggaaaggtgggtacttcaaggctgcccctttgccacaggacctcagaggtccgtgggagggcgccattcgttctctcagcttcctattaaagaaagggtctatacttgagacccttggaaaagttgcccttttcacgccttctgaacagattgagcagatcctgaaagctgaacctgtgaatacctcagagaccgggggagaaatggcaagaaactgtcaggagctgtcgaccttagaagatgggcttttacagagctgtctgttaccgtgggaggggcggggtctcaagacattatcttttagagaaagatcttgtgagcccctttcctatggatctatagggctggatattccacggcgtactgtagcaactcttcttctgtgccatttcttcttgcttttccctgtgggatcttctttagttcatggtgggagaaggtggcaggatatggttctaggagcctttactgttctagcccagtatagcaatgctcactctgatggttggcagggcaaaatgaacttatttcttttctttactttttttcccaagaattttacagccctgatacctggaacaacggtggagattttagatggagactccaaaaatattattcaactgattattaatgcatacaatgtaagtcatcagtttcttcccccactgccacctcccttccaccctctcccactgaggccctgcagctgccgcgggctcaggtgggcagttctccgtgctgctcttcttggctctgctcccccatccccttgagtttggtatcttcttcctgcttcactcagggtcagggtggagaaacccatccttgcttgatgagtctccctctcacctctgccatcttgactctcatctgcagatctcagtgagccaaggagtggctcagactcaggctggtggcctgggaagtgcttaggttctgacacctcgcataggcaggcagtggtattctccacctacccagtgcccaggctaacgctgccaccgtattctctgcctgagggagcagagcatccaccagccacaggaccacactgcaagaagtgaaaagttcgcatgctgagctcacctcacagtggcagggcgggaatccctcaggctcatggagctcagggtagagctgcagactaacatgggagaatcgacaatccatttttttatttttgtttttaatttaaaaatatatatagagagatgaggtctcactatgttgccctggttggtctgatcttgaactcctggaagcagtcctcccacctcagcttcccaaagtgctggctttacaggcatgagccatcatgcctggccaaagaatcaatgtttttgcctacctacttaagatgtgattgtaatgaagtcctttcagagggttcgtgaatggggctattaaattctgtgctattgtaacatatcatgtgaaattggccctaatataataagtgtaagttcttatagaggtggtttaggaatcactttcacattccaagccacgcatccacagactcacctcccaagcctttctctttcctaccctcctttccctcgattcataacaccccaaaagtacttgactcagacctaccttctgtcaggcaaacggcaggcagagctcttgtgttgggaagtgtggaccttctgctatcccttctcttgtgggtcccaagatggttatggcatccattgcctacccacctgctcaaggcgccaggtaatttctaaattggcattcagagtgcatcttcctgttaaaactaagttatacacagactaagtgtggcttaagtaacattattaatcctaaacttaggtaaaacaggtttttctggctaacctgggaacctaacgaatcagtacggcatcacacatctgtgagaaaagtcatcttgccttcccagcagtgactgattacaaatgagtgtttggagctgggcctttcccaatgttggccttgtccatcttccaatgtggccctgttttgagttgcaaagtactgcccagctagggggaaccctggggcttggggtgtagccagccctgcgcttagttccctggagcctcagtgtcctgaaggcaaccgggtgggcagcagtgaggatttttggcttgtttttaccccctttcttcccccttcccactgctcccatctcctgttgtagccaagggtcctcttgctctcacagattcagatactcctggaacttcctattgtgagaaactgaagacttccttctctcctaccccattgcccacatactaacatcctcttttctgttctctggcccttagagcctcaccagatcccataggcacttcagaacccagagtgcagtgagacagggtttcctaattaactttacaccgtagtgcctttcagattccacggtgagtgatttgctttacacttcaggaagagggggaacacgtaagctggttatgtgggcacaataggtctgctgaagtgcgacacccagagagggtttgggatgtgagcctgcatgggaaggaggggcaggcctgtgaatgtcaccctctttcctggggtgagctggtgtgagctgtgagccgcttgggtctcaatctctggacactgaactaagagaaccaaatcaagagccagaacccctgccttgccactctccccttccctctgaggatgccagagctgggagaccccacagggcagaaggtgcactgctgctggacccactctcacaggcagggaggccaccgcttgcctcctgctgagtcagggcctttgggaagaaatggctgaagagcagctcatctgggctctgttgagtggggtgaggtccctctttaaggcttctgcggaggggccacttgtcagcatttcattgtcagccacctcctgaattcagagctctggagctccccaagagcattggctggtgaaggcccaggccccctgctcctggcggctttgatatcagagggcatcatggcgcacagctccatagacctggctgggcagccttgcagcagcagggaaggcacactggtcagccagcttctatgtgactggtgggttctgcgtgtctgtgcttctgctgggaccgctgaaaaccagggagcaggaggctttcttattggttccatgcatgggatctcataagtgcttagccctgagcaggatttctcatatatctacattcattttcctagtggaaatccaggtacccagggtcaaggagtgacaagggaaagcattccctgtgtggtaggcagaggccaggagaggagtgtggatccctccctgctgatggggagtggggagcaggggtgagtacagggaacagttgttctgggctggagctgcttttggaacctggcacgaattcccagaggaactgtgggaacctagcactgtcgcttgattctgcgagttaaactggttcctgtaagtaaacatgttgtgaaatgaagctgatgacttatgaatgaactttgaaactcagcacttttaaaaatgagtgattatgaccaggcgtggtggctcacacctgtaattccggtgctttgggaggctaagctgggaggatcacttgaggccaggagtttgaaatcagcttggtcaacatagcgagaccaaaaattttgtgaaaattagctgggcatgctacttgggaggctggggcaggaggatcgcctgagcccgggagttcaaggctgcagtgagctatgattgtatcactgtgctctagcctgggtgacagagtgagactctgtctcttttttttttttttttaaattggaaaagaattgtaaagccttattgacatataattaacatacagcaaactgtactgatttaaagtgtataatatgagtgttggcacaggtatacacctgtgaaaccgtcgccaccatagagatactgaacatgttcattactccaaaaagtgacccttgataattcccttcttccacccctcccttcaggtgaaatttaaaatatatatattaaatatagaaatgtaaaactgcaagatatttgaagcaagttcagttggtcaaagccatgtcaggggtatgttggtttcctgtgttgattagaacctgtgatactgtggtacgataagatatatatataggtctctgcccctagttcctaatataaagcccctaaaacctttatagataaggacactaggagaatcttttgttattatatttggtctttaacgctggttcccgacacagagtttccaagaccattgtagtttcctgggtaataggaacatcttttgttctaatgaggtgactcttggggggtgctcctggacagcctcaggatggtggctggttgccaggggaaccagccatgtgattagagggttggaactttcagccccactccatgacctctggggaggtagagaggggctgaaggttgagtggatcaccagtagccagagatgtgaccagtcatgcccatgtaacaatgcctccatgaaaacccagaaggcctggatttggagggccttgggaaagctgtgggacaggttcctggagagtggcaccagagaggacagggaagttctgcaccctcctcacacaccttgccctgtttctcttcatctagctgttcatctgcagcctttatctcttattcatatgtgggtaagtgtaaacaaactgtgtccctgagttctgtgagccattctagcaaattgatgaaagaaggagaggggtcatgggaatttgaatttatagccgatcagttggaagtatagatgacaacctagtacttgtgattggcatctgcggtgggggcagtcttgtgggctgagcccttcacctgtgggacctgacactatgtccaggtagatagtgtcagaattgtgctgaattagaagataaccaaccagtgtccagtagagaattgcatggtgtgtgggggaaaaatcctcacatctggtgtcagaagtgttgtgttgagtggtgtgtgagagtagagtaggaaaaacagtttgggtttttccttccaagtactcatcttacttgctcctgtcctggccaacgggaaaggctgggctgggcttcaagctccttgcacttggacttttcccaactttgagccccagcacgggcccctggtccatgtggggtgtgccggggcagcaggagaggttttcgtcagctctgctctcctttcacctgctccgcatccggccagagtccagtcacagctctctccagaccgcttgtgtttttgtcacctcaccgtccgagtggtttgtgttggatttcatgagtcatgcaacacatgactaagtgtgggtgttggcttttacctcccctagagtgctggcagaccatctgtggggacattctgagcagatttgggttggaacatatgtaacagatgcaatggctgtggtatttggccaggctgaggagggagcaaaatggaaagggtatgtttaatttcatgtcttgtagaatcaagtctggtgtacacatctctccgagtgtgaaatcaagttggatttatacattttttcttgctgtgccaaattcttcactgtgagaaatcaccaagtcttcccaagggagtttggcaatgtggtgctttgctctgtaataagtgctggtgagagaatcccctcctgagctcagccgtggagccctgggtccacacgtgcagagggggctggcctcatgttgcacccagaaaggcctcttttcagtgtgggagcgaacagaatgagttggaaagcactggagctgcatgtggagggtgacttcagaagctgtggtgtatttttctctagcagagcacatgtttctctttttgttgttgccataaagtctgctcccacccactccacagctggcccgacttaaagcaattgcagatgtgacctaacctgaccgagtatttaatagcctttacacttctgacattcccaacatcatcttgtttcctactggagaactaaggagtgcaccttgaggggcgaatctggtaggagttaatggaattttaggagtcacacataaaagtcttcatgtgtaagaactgcactttgactccatccattcacttattcaacagatatataccaacagcctaatgtgtgacagggatcatgctgcaccttggaaataaaatagtgagcaaaacacagtcctgccctccagcactcatagttttgggggcagagacccttacaaccacgatacaacctgatgatctctttccaaagtcacagagccaaattcctttttatttttttatttttgttttttaccttatctgtggacagagagccaatttccaaagaaagaagtgcatatcaggtgtggggattagaaagagccctggggtgggtcaagaaagcctgcacccggtcctgtgcagcagagtggtcccaggccaccttttccttgccctgacctccagcttccatacatgagaggtttgggctgcatcatctccacggttcctgctgcctgaaatgtcttaagagtttctgattccagagactctgtgggtagcaggaataatacaaactttatatcagaacatggggcttatggcctgagtagaacataagagtccatttccatctaattcttagttgctgactcacagagtaggagtccaagtccctcttgctttttcccagatcctcccttggggctttcgagtggcggcttgggcagatcttgctggggagcactggtgtttccttccaaagttttatttgtgaacgacagggcccccatatttcaagttatcgttcccaagtaatttttttacatgccttcactcttcagctcttttacaatactgttttatttcctccactacttattcacggttataaatttattttttaatatttgtcttaagaaatattttcatctacttggcctgagaccttagcatagctgttaaatcattcatctgtctacccatccatgcgtttattcattcaacgacagattgtactaagtcacagagagatctatgatacagcccttggacttcacaacatggtagggaagacagatctgcaaatagctaatcacaggcagcaggagagtgctctgtgtattgagtggcgcttttgtgacccttggccagttaaggctggcaagttgcaaagggaagtggatttaagacggatcatatttttagagttgtagaagcacttagataatttgttgcaaagggagagactattttttacagaaagtattttcaacaagctgttaatttgctggaaaactacatatttcacttattcaactttagcactatatgctcagcaaaaaagagaaagaaagaaagaaagaaagaaagaaaacccacaagagcaagaggcaagtctgtctgctgttctctccaacagccacactccctagagtgtacccgaggagggagagggaatccgcagggccgtctgcggatgttggggtccttgtctctcatatgggtacatcatgctatactctgtgttgagtgtataaacagacagttgttttaaattttctggtaaaatatgacctctgaataaaagctacttacttcatttggcctcagtctccaaagtggaatcttccttagagattttcaaagaaattattattattattattattattcttaatttttttaagaaacaatctcactctgtctcccaggctggagtgcactggcatgatcatagctcattgcagccttgaactcctgggctcaagcgatcctcctgcctcagccccctgagtagctacaggcatgtgtcacaaggacaattttttaaactaacagacgtatagaaaatttcacacacttttcacaaattaaataaacctgagtatccagcaccaaggccaaacacacagaacattagccaggcccagaagtccctattctgccctcttccatcgcaatccctcaagggcaaccattaattttgcctgtttttgaatttcatataaatagagttatacaatatatatgcctttgtctctgccttctttctagtaatgttatatttgtcagatttatccatattattacatgtagtcatattttattatttctcattactgtatggtattccactatatgaacatactacaattttaaaaaatccattctactcttgctaggcacctgaggaatttccagtttctagctattacaagcagtattgctgtaaacattcttgtccatgtctttttggtgacgcatacacttctgttggatataatcctgggtgaatgctaggtctgaggttggcctaagctttagtagatatagcctaatggctttctataggattgcacgaattttcactcccaccagcagggttggggagccctagttgctctacatcctttcccaacacttgatgttcttagtgttgggaaataatagaaaaaaactttactttttttctattctgataggtaattttgacttgatttttgtttgattcactgtcttaagaatataatccacacataagattggagtctctcattatgtagtttcaaactcaggcatatggacctcatctgatggggataggtatggatgtgaatgacagggtgtattcctggagaaagtgcctgctgagctgattttgaaggatgataaggagccagccaggaggaggagagagaggagccattgtgcaaaggatcattgccctgggcacatggaaaggctcaaagcctggagtacacactgcaagattgaggaactgcgtgtctgaagccgaggatggggatgagaggtggctctggagaagcaagcaggggatggggcataacccgtttgaagcagataatatcatatggcaggtcaaccactatcaacttctccaaactcacagagggagacctcaggctgggtctagcaagatgttgtgtgagtgcagagagaagggaaaggatgagggagggccagggaaccaagctcactggctcttcctttggcttgggattcctgagttagaggaagccacgtgggcctcagaaaaccagtgtgggagcacctcagccacagcctttattaaatggttgggcttcattttctctctccattcagagtatccggtctaaagtggagttgtcagtctgggatcagcctgaggatcttaatctcttctttactgctacctgccaagatggggtatcctatcctggtcagaggaagtgtgagggtctgaagattggggacacggtaagtctcaccccaagtttgtatgaactcttgttagcattggtcatcagtctttgggttctaataacttttgtgacttattaagagtcctttcggaatttatattctgttttccaattcagcatcccagaggagtctcctaagcctgttttgcatgatgtgttcagagtctcaggtgaacttgttaaagagcccagtcaatagacagccctcagcgcattgctacctgaggctttcttaagttggcatcgtgactttggtgttttaaaccattatcctcttagcttgacacagttgtaatcaggagaaagagtacaggtaggaatccaggagacctgtctttcattcctagtcttctgcaaatagctctgttccttggataatctgaccctcacttttccgttctgtgaaatgtaaagaaagccactccccccattctgttttggtgaaatagaatggatgactctacagcagtggaggacacagatgccttgtccagattaagtttattcaaatgatgtgtgaagatgtgtgcctctgcgctaaaccaaggacttgcgtgagggagcagggaggaggatatgtgggcaacaagaacacagacacagacacgggcacagaggccgcgagtggtgatggagagctagccacacatcttctggaggtcctgctgctagaagcagatcatgagctccattcctgacttgctttgttgacaggtccagtgctcagaaaacagaaagccagtgagggataattctcttctacacttaaaagaatctagttagaaacaaaaaaattatagagaccttacaaataggtggctatatcctcttggcattcatagcactcatgacggccaaggcggatataagctgactcatccccctggcttcagggaaagagcttgcggagacagggacagtctcgtggctggtagcagtggtctcctcgggtttctccatattccactgtagatcctctcccatccctgccttcacacttgtccctcacccacttcacaacacacagacatacctcttttttttttttttttttttttttttttttttggagatgaagtctcgctctgtcgcccaggctggagtgcagtggcacgatctcggctcactgcaagctctgcctcccgggttcacgccattctcctgcctcagcctcctgagtagctgggactacaggcgcccgccagcccggctaatttttttgtatttttagtagagacggggtttcaccatggtagccaggatggtctcgatctcctgacctcatgatccacccgcctcggcctccgaaagtgctgggattacaggcatgagccaccgtgcccagccacagacatacctcttacccttctcaaatctttctgcagtgcctcgctcccccaaataaagggacagttcaaaatatcatatggaagttgagaaaatgaaagcctcttatgactggctaccaaggccttttctaagacacgttgtttccaagtttcttttgcttttaacaagattgaaagaaggcctaatcaagctgtctgatgataagtcattacaaatgataatttatttatttatttatttatttggagagagagtcttgctctgtcacccaggctggagtgccgtggcacgatctcggctcactgcaacctccgcttcccaggttcgaacgattctcatgcctccgcctcccaagtagctgggattataggcatgcaccaccacacctggctaatttatgtatttttagtagagacggagtttcaccatgttgctcaggctggtcttgaacttctgggctcaagggatccttccactgcagcctcccaaagtgctggcattataggtgtgagccaccatgcctgcccacaaatgattatttatggcttttaactcagaagacattcatagaacaaggtgacattgctgttacaaaactcttgttcccatcttcctatttatgtgaactttttttgtgcttaaatctctacaaatgaaaaatagaaatataattgatgtggatccctgtcttgtttagcaataattaatattattttacatcggggggaaagcctcatctcattaaagaggtacttccaataacattttactgtttatttttaataattgtaggaagttgcaatgtatttatgttgttttcatccattataatgattgctcaatccagatgattaaaaaaaaaaacactaatgctttacagtgacaggacaggatttaaagagatagttataaaaaatggaatgaggccaggcgcagtggcttacacctgtaatcccagcactttggaaggcctaggcgggtggatcatgaagttaggagatcgagaccatcctggctaacacggtgaaaccccgtctctactaaaaaatacaaaaaaaaattagctgggagtgatggcgggtacctgtagtcccagctactcgggaggctgaggcaggagaatggcatgaacccgggaggcggagcttgcagtgagccgagatcgcgccactgcactccagcctgggcgacagagtgagactcagtctcaaaaaaaaaaaaaaaaaaaaaaaaaaatggaatgaggcagaaataccaaaaaaccccaacaacatgtaagtgaattctatagatctgtgggtggaatgtttggtgtagcatgtcaggaaagctgaaggataatgtgggaaatatacccaaacaaggaaccctttacttggagaaataggtatgatggaaaagagatgggagagggatggactgtctaatctagcatatgccaggtttcaggaaggctcttgacaatttctaatgacatccttataaataaggcaaatatttaataatatgggttgacaacagcacagtcatgcggatttgtagctgggtgaacatgttttctgagagtgttgataatgcagccagagggaggacttgactgaggttccaatgtctcttgtctgttgtgtttatcattggcttgggttgaactcataggagaccttatcaaatgtgggaaggctgcagagctggagaaaacagcttatgttataaagcaggaaagccaagatttaaaaatatttttcgaaattgagatggattgaaatcatgaagattaatgtcttatgttttagttcagaatgttactaggatataggaaacttggtttgatagtaaaagaaaaacatctggcagactataatggctcaaaggctcaatgcaaataaacagtgattaaaaaaaaaaagtccgccaggcgcagtggctcatgcctgtaatctcaatactttgggaactcaaggcgggaggatcacttgaagccaggagtttaaaaccagcctggacaatgaaatgagacccccatctctacagaaaataaaaaattagccgggcatggtagcgcacacctgtggtcccagctgctcaggaggctgaggccagaggatggcttaagcctagaagttcaaggcagcagtgagctatgatcacaccactgtattctagcatagataacagagtgagacctcgtctcttaaaaaaaaaaagtaatggcagtaatggctaggcacagtgactcacacctataatcctagcattttgggagactgagacttgttaattgcttgagctcaggagttcgagaccagcctgggcaacatggcaaaacccagtctcccccaaaaatacaaaaatcatctgggcgtggtggagagcacctgtggtcccacctagttgagaagctgaggtgggaggatcgctggagtgtgagaagttgaggctgcagtgagccatgactgggacactgcactccagcctgggtgacagagtgagaccctgtcagaaagaaagaaagagagagagagagagaaagggagaaaggaagggaaaggaaggagagagagagagagaaagaaagaaacggaaaggaagggcagggcagggcagggagggagggcagggcagggcagggcaaaagaaaggaaggaaggaagaagaaagaaaaagaaagaaggaaggaaggaaggaaagaaagaaaggcgggcacggtggctcacgcctgtaattccagcactttgggaggctgagacgggtggatcacctgaggtcaggagttcgagaccaacctggccaacatggtgaaaccctgtctctactaaaaatacaaaaattagcggggcgtggtgatgtgcacctgtattcccagctactcaggaggctgaggcaggagaatcgctcaaacctggaaggcagaggttgcagtgagccaagattgcaccactgcactctagcctgggtgacagaacaagactccttctcaaaaacaaacaaacaaaaaagataagtgaataaaaagtaatgccagttgaagctgtgtttaatagagatattttgaaacctcacacctggagttctgtattttgttctttattttattttattttattttatttttagagacagggtcttgctcttgttaccaggctgcagtacagtggcttgatcatagtggactgtaacctctaactccaaggctcaggcaatcctcccgcctcagcctcccaagtagctgggaccacagacctgcaccaccatgcccagctaatttctttgtggttgttttttttgttttgttttgttttttaagaaacagagtcttgctatgttgcccagaatggttttgaactcctggcctcaagtgatcctcctgcctcgacctcccaaactactgggactacaggcatgagccactgtgcccagcccggttcttttttgaaaaagaaaagtgacaagcaactatcatgatgaattgtttagaagctagaaaggtcaaaggaactaatgtttgtcagcagaaagattgtaaagtcagaactctttccagatgcaaaaaaaactgaagccactttatgctgcccaaagtgaaaaggagagtcattctaaatatattggggttccttatggaaagcaggaatacagttagtcttgggaaggaccagaaacaacctagacaatgagtggtctgtggtcactaattgcctgtgaggaagacattgtttttcatgctgacagatggggaagactgaggcacaaagcatacaggtacatagcctgaagtgtcgacatgaaaattcaaagccagggctttctgttctgaagccagctccctcaccacctttatccggcttcttggtgcccacgattctattctaccaaacctatttcaaaggactctaccagcacaaagtacaatcctgaggaacaggagcctccacgggagagtgccgctgactgagcccccctgcaccatgtggggagcccagcgctcgcgcactgctgacaggcagcctgggatttgaggatgagcgtgacttgccccagctcacccagctaagagacagtgaactcacaagccaaaccaaggccgttccccctccacaccaggtcatctcgctcatcactgcctccccattacagagcaaattgtatttgtttgcatggaatggggacatccaatgtgccgtgtccaacgtgccccttactgtggtgggggcattactgctgctgtctgcctcttacagcagctttataagggagctgttccttcgccattttatgtatgaaaaactgagactcaaagtggggcctgagaagcgtgccagaagcctcaagcatcgggagccaagttgggggctgcttccgaggccacagtgcatgcgtttcccacacactttggggagtaacagcttttaggaagcatacagtggtgtcatggccacttatggatggacaccctagtgtacagattttgatttttgctgggatacctcagaaaaatggggaaattgtccagaacttgaaaaagattttacatgatttttcaaatgctctgaaaatctcagaggtattgaagtggtttttagagcattcgaagcgacactaaagaggaggggaacttctgctcaggccggcacctttgacagctcttcctgtgggattggatgggccgcagccctgtgggaacagcaggggtcctaggcaactgacccgagctggccctttgtttctactcactgtcccagtgttgttgtcttgctgtccgagggccatggtcacatggcccctgactccactgcgagggctgtggggtttttgttttctgtggatgaagacaggctggcacagggcagtggccactctgctcttcagagccagacatgattctgttcacaagagccacaccaggccatgcaggccaggagaggcagctctcttgagggccttggaggccatcgggggcagaactggctccatcatttgtaggtcccagtgcaaaatgaaaatatggggtccatgttcaaaaatcattaagaattccaacacagcaaccacagagcattagagtaagcgtgggcccttctgagtgggggcccttgtgactgcacaggcatacaccagggagccggccctggcacggggagttgaggggctttccctcttcgttgaaggagaggggtctgtcagttcctctgatccccaagacagaaggggtgcacttacagctgggaccagtctggttttcttaaccctggcccaagaaggcaaactttccatcccttctctcaggctgaactgtctccaaagcattgacagttgggctttggcaagcaggggtgctactgagtgtgtgagtatttccctctggacgtgtgtccccaagccatacatttcagaacttgccagtgactgtgctgacatccactcgtactcagtaagtgtttatgtaccaaatcccgtgctcactcaagatggacaaatgaggccacagatcaggggctcagagtctggtggaggaaataacatgcagaggagtcagccccgtagagggtgatgagtgctgtgggaaagccaggtgtggcactgcaggagcccaaggaagaagggcccagcactgcagagggagctgttggagctgaggctcagagcaccagtaggagtttcccagacagagaaagccggggtgggctggtcccatcagtgggcctcccatgtgcatattggcaagatgtgtctgctagggtgtgaagagcatcatcctttggccagtggaaagcagctgatggtgacggccatggaggcaagaggagtgggctggggagggaggggagagtggctggcttgggccacagtggtgaaatatacctgccaacctaaggggtctggccattctggccattgtttggcaagtgggttccattctttggtggcaggagttgggagggctatgggcaagtcagggaatggtggtgggggtagacaagagtatcaagcatagctggagggtctggggactcccctggagaagagggattaggaaaagcagacacagttcaggtgtcatcagggatctcagggtctggcctgtggacaaggacacggcccgtatgaggggcagccagatggacctcgcctcctcattatcacagcttcctgcagaggtggaagaggtgcaggctgtggttctgtgacaaccctgtgtgctctgggtcaagacagatgtctagcaagaagcaggagaggtggcagggcaggggctgaggggcagggatgtcctcaaagagaaatacggcttaaatcaaaccttgaaagccccaaatccagtgagattctctttcccagtgatttcaattgtttccctaattttcctccctttatcctacaccaaccatcgggagtcagtttactcaggaactggcttcaacaaatcagtatgcaagtggctggctgtgaggctagcacagacgcccagcacaaagcagccagtgaaccccgtcatgggcttcccacagcaccccctccccgctcccgtccactcctcgggactctgtagcctgtgcccatcccagctccttttttgttgagatctgagcagacttggcatctgcataggatagccctggatttggtgggttcagggtgggggctgggcagcccttttgaaagggtgcatcaggccagtcagctccacaggggaaccaggagaatcccaatgaagttctaataacaagaccgagtgggagggctgctgtgtctgtgaccttcctctggaatctcagagcgaatgaatggaaagtgtccaggaactggggagccttcagtatcagttgaagttctcaggaatcaggggagggactcgaagaggcctcattccagctgccttccagcctttctggattctttccaaatccagtagggaaaatggaccctctgaaaggaggggtaagcaaacagatttccttgctggtcctgaagtgctttttatagcacttcccgtgcccagcaggagctgagacccagtggctgaaatagacagaacattctctggttatcaggcatctggctacactccaggctgcacagggccagacagatagcacctcacttggaccgaaggcttggctggggaaggcctcaggacctgcttgaaagctgggccctccttgcttgcccagctgggcagacagtgcccaagtgtttctacatgctggtgattgagtgccagaactttaggggtgccctaacctcccactttctcccagacacatcagcaagattctggagacttaactctcactttcattgctttaaccccaaggcaggcaagtttccatgagacaaggttatactcacaggtgtgtactccccacagtctttcaataattaaatgcctttggctcttggtccaggtcattcctctgtagtttattcagtttctgacccgcagatgcctctgtggagcacaagtccagcaagttgtagccctagaagtacagggtttcagctgtaacttgaagcaagctacaggtagcttcaagcatgtcactgttgtgggagcttcaagcaaatagtaataggagatgcaagcaagtttctctctgggcctcagaagggagggatggcatctgcccctcaaagctccattcacctctgcattcttgatggccccacgggtggcttcgggcaggcatagtccccactcttatcctatctgcaggctcaaatcgttcccagcccacggcagaaagatgtggagatgcctctggccaccactttggggatcaccatcaaggggtccctttagtaagccaggctggctctccctgcgcaccccgatgaggtagacctcattcccccgtctaggaggtggatatgctaaggagagcgcgggccctgctctaggcctggccccactcatcagctgtgtgagcatgactaaatccaccaaccccgccaaccctgttttctctctggtaaaatgaggacacttccttctagggcatttaaaagagatgcttgtggaaaagtccagcacagtgcctggtacatagtaggcacttggcaactaataattattagtgttttgttttgctttttttttctttttgagacaagatctcactctgtcgtccaggctggagtgcagtgacacgatcacggctcactgcaacctccccctcccgggctcaagccatcctcccacctcagccttctgagtagctgggaccactggcatgtgccaaaatgcccggctaattttttgtacttttggtagagatggggttttgccatgttgtccaggttggtctcgaactcctggcctcaagtgatcctcccagtctgcccacctcagcctcccaaagggctggaattacaggtgtgagccactacgcccatcctattcgtgttatcctttaaccaatttcagtgtccaagtggattgaatctttactcaccttgagagactccctgtacctcgagaccttggaacttagccttggagttgtttttgtcaatctctcccctttgtctcttcctactcttcctaccccacagagatggaaggtaaggtggagctagcccaagctgtctgcagctggcctggtcccccgagtgtcttctgatcctgctcccctagctatcctcagctcacctatccagaagcctctcctgttgagcctcttggctaatgctgagtcctgggtgtctgttgtcaagtcctttgaaacagcagtttgctgccacgcaggactttctgcaggacttatagagcaggatctatcctcctgctcagtcccataccctctcccctctccccgtgtccctagatgtcacagcatctgaggggaggccttttagaaccagtaaaaatctcaaagtaatagggatctgtatgtttagaaacagatatttataatgttctcaaaaaatgaacatcgtgggccgggcgcagtggctcacgcctgtaatcccaacattttgggaagccaaggcgggtggatcacttcaggtcagcagtttgagaccagcctggccaacacagtgaaaccccatctccgtctctaccaaaactacaaaaattagccaggcatggtgacaggcacctgtaatcccagctatttgagaggctgagatgggaaaatcgcttgcacctgggaggcagaggctgcagtgagccgagatggtgccactgcactccagcctgggtgacagagagactctgtctcaaacaacaacaacaacaacaaaaacattgttacctgaagattgtccagtaaatcaagtgaatgatgacattttaaaaattagctttaatgactgggcgcagtagctcacacctgtaatcccagcactttgggaggccgaagtgggcagatcacgaggtcaggagatggagaccatcctggccaacatggtgaaaccccatctctactaaaaatacaaaaattagctgcgtgtggtggcgcgcacctgtaatcccagctactctggaggctgaggcaggagaatggcttgaacccgggaggtggagattgcagtgagctgagtgcatgccaccgcactccagcctggcaacagagcgagactccacctcaaaaaaaaaaaaaaaagctttattctagccgaaagaatagaattaagaatagtaatagctgaaagtggtttttaacccattctgagcttcagaatgatctgaggagccttttgaaaaataaagacatttggacccagatccagtgagtctgtttgtggggtgggccgggcctctgtctgttcagggagtaagggagaacccacccctgagtaaaactttacaacggcatttcatcagggcacactggccacctgtctgtgcgttttcatagaatccacagtgacttgctctcagggccctgatgggtgattcagaccccacatggctctcctcaggggggtgaggaggagagggtgggggagtcaggctctagttcctgaatcagaccaagcctcattcttgctttccttccatcccagccctgtgggcagctgacaggcatccctcccgcaccatctgccacccatccaggcccaccttgagcctgttttcaaggcaatctgtgagaagctcctgagtgagaaacacttccttacatattctgtttaaaaagaaaaggtctgtccatgtgcatggtgcatttcatcagttggagactcttctttaagacctcaggggcatggggggattgtgaaagatgcagctatgacaagcactcacagaggaggaattggggcacgggggactcgggggtgtctggagagcaagctctggagtcagctgagccctttgccagcaggcacagagccctctctatggcgggccaggtgggtgcccttcacccggcaccctgtgagagtgccattgtgcctggcacagaggcagcgcccaggaaatgtttttccaccaaatgactttttaagtgagcagagaagaggcatctgcagcggggctgggaagaggataggacagaagagaaaagaaagggagaataagaactgtgtgaactcaaggaagccctatagctttccgcaggggcccatttcctcagggtcatggggatgcaaagagataatgaatgttaaagaattcacctgtcaaatgtgagctcacctgtgcattctcttctccatgaagcatgggagcttgctggttctgaggtctcttcctactccggccatcttggtggttctacctgagtgcgtggagagggctggagttcgcagctgctcttcatcaagggccctgcccctgggtgaatgggagaccctggcttgccgcagccatgatatcccttctcttccttctgcccaggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggtaagtgtccccagcaagcactttagctctgagccaggccaagatgccgttaggacaccctcccaaagcctgccttttactcagtggtggtagaaagtgtcactaccatggctctccttggagaagacagtgggcaagccttgctacccgtaggcaggaggtggggatctgtgtgcagaatacgaaagcagaaggtattgccataaattgtggactctcagaattcgaggggcctgcgtgggtcatccaccttacttcccaattcatgcaggactggcctgcacagcattcctgacaggtagagatgttcagcctcttcttgattgcctcctgggacggggaactcactggggctggcagtggccatctgtcccttagccaatgaactcatatcttattgctgctcccataactcaccacaaacctgttggcttaaaataatacacatttaatccattacagttctggaggccagaagtctgaaatggatcttatttggctagaatcaaggtgccagcagggctgcatacctcctagaagctccaggggagaatctgtgtcccggccttttccagttcctagaggccacctgtattctttggcttgcagctccttcttccattttcaaaaccagcagagtaacatcctcagatctctctgactctgacctctgcttctgttgtcaaatccttctccctctcctacagacccttgtggttacaagggaccctcagtcgaaccctggaaagtctccccatccccaggtcctcagcttactcacatctgcacagtccctttcaccacgtaaggccacacagtcacaggttccagggattaggatgtggacatctctgggggctcttatttttcctgccagaattcctcttttttttttttctgagatggagtctcactctgttgcccaggctggagtgcaatggcaggatctcgactcactgcaacctctgcctcccaggttcaagcaattctcctgcctcagactcccgagtagctgggattataggcgcccgccaccacactcggctaatttttgtatttttagtagagacggggtttcaccatgttggccaggctggtcttgaactcgtgatctcaagtgatccatccacctcagcctcccaaagtactgggattatagacgtgagccactgtgcccggcccagaattcctctttatactgaagagaaacttgtttctcaataacttcctcccaatggttaacattctagagtcccccttccacgtgacaacctgtcaaacatctaaaagctgctttatgtttctctgttctctcttctgatctaggctagacaccccaagtctcttccttgtccgagggtgctatcatttgtgaagcatgcttcacataatcaagtgcgttacttgtcatgctggatgatgagggcttggtccagggttcagtgaagcatgcgtttcctgtgatttggacattctgcttacatggatgcaccctgacaatacattcacctttttttattttcttcttcttcttctccttctcctcctccttctcctcccttctcccttcctctctctctctctttctttcttgtttctttttttttttgagatgaagtctcgctctgttgcctaggctggagtgcagtggcacaatctcagctcactgcaacctgtgcctcctgggttcaagtgattctcctgtctcagcctcctgactggctgggattacaagcacccaccaccacgcctggcaaatttttttttttttaaatagatatggggtttccccatgttggccaggctggtctcgaagtcctgacctcaggtgatccacccacctcagcctcccaatgtgctgggattacaggtgtgagccactgcgcccagcccaccttttcgttctgttaaacagtcacagtatactcttgagctggtttttaacttcactaccaaaagtttgaggcttttaatttattttattttttagaactgtggttcagaaggagaggtacttttttagtgtgttgtgttggagcccttaattttctgaatctaaacacaggagtttacactgattccagttaaatgacaagttggcagttcccactctggtattgcgttctgattaaatgcttcaaaattgtatctcaaagtttatctaacaccatgccacctgtaaaggtagtaagtaaaacagttttaggcagggctgtggtttcttctacacatcatgtattctgtggtttccagggctccctccttaagaatggtcttccaattgggatgggtggatttgaaaggaactaagggatcagctgggaaagaaagcacaaggtgcatctgaagcaaaccaggaacgtgcagatactccgtcctatgggaggaggaattgtactgccacacagggttgcacagacgtgggttaacaagggaagcttcctggagcggaccttgccgtgacacaagcgtgagtacacccatgggcgtcgtgggaccagcatgtctaaaactggagttgccctggagagtgcaggacttagcagtgtcattgcagagtaaagtaggtggaaaaatcaggattcaacatgccaagcatgcaacagggatcaacgctttcctcagcagagtgatgataggttggtgttagctagatggttctgtctggttagtagaaaaagtttgggctccatagcaggaggcctgggcctaagtcccatcataccatatctgctagtgtgacttgggcatagagttgttatgaggaataagagatgtgtgtgaagcacccagtattttgcctggcacaaaaggaaaacacacccaatgctggctcctctatgagtcagtgccacacccctctgggggggccacacctggttccccatgtgcaggagggccccgccttcccccagacagtccccaggctttgcctaaaaaattccagggtggtggaatggagtttccattcctcttagtagccataataaaagctctaagcagcctggcaggctttttagcagtttttcttttaaagagatattagcaaacgtgacagaaccatccctccttccccttcaggatcctgaaataaccctctggtatgtcttcaccctagaagcctgcgtgtgtccatgcagcctgggagcaagggcgtttgagtcagatgctgtgtgcacgtttcatctccacagttcatcaggctgtgaccttggttgtcttggactttggcttttcctgtctcctaagatgggccaacaccatttgtttctgcattattttgagaattgaaggagaagacagagatgaaggccctggcctggtactcggtagggaacaggacccagtggatgttagatgcctcctctgtcttgctgagactgggcatttctctgagtacagagcctgggagacagggcaagtgggagatggggtatgagaggccctcagtggggaatactggtcattttggaaacaggaatattccatagctgcgtgaaaatgcagctttttttttgcttaatcatcagaacccacaatcctaagttaatcctgcattacagaattctgccagacttcatatccaaaaacccctggtgctctatctctttctcttcccttcaccccatacaatcctgcgggatcgggaaatgctcatgtcatggggtagagaaaccggaggtttgccaagcccttgaggctcctagatcaacgatgcctaaagtcactaacttccctgaggttgcagaatgaatgtcttttttcttccccactggaaaagccatagacaaccattaaagaaaacttgaaaaatacagggaagttgatggatgtgtggccagttggtgctgtctgtcttcttggtgaccaggagtaatttggaccatctgggaaaccagacctcttttcacccaggctgtttcgtgtgcatcacttctgaggctgtgtgctcagtcaagaccttgccagagagttgggggattagccttaggtcgagaatattctgagcagtagtaagaaatttaaaaatcatccataatttcatcactcttattttaagagattagtttatttccttctaaaccttcctctaagttagtgtatgtgtgtttatagctgcatacaattttgtatgatgctttttttcctataatattatatcctaaggagcacttgaagtcgaatgactttagtaaatcattgatgagaacattttgagtgtctttccattgcactcccaactagccttctccacctcttcactttaaaagcaacaactagttgaaacgtgacgctatccaagtctttccggagaaaatagtttctggagtgagatcattgttgtttgacaatttgggaaggacttaaactgagtccagctccaggcaggacttgataacatgttcatgcagtggcttctttcacagcgttatagcaccagcccttccttgtctctcaaaccttacagctcaggaggggctgtgaatggatgggtaaggaattccagtccctgggtccttggcacctgtggtcagcatggggctcccactccagaattgcgtgcggtggttttgagctcttgggtcacggctacatctggagttgttgtggcagagaagcctggttcccagccaccactctgctcttgaaggtgctgactcagagactcccaagcagctgacttcagcattctctcacagctttacaccccctcttccctgcagcctgtcttggaaggaaatcgtgtggttgtggtctgtcttcagagtggggttgaggggtgcacttgaagaagtggctgaggcagagccagggccagaataggtagggtcaccccagagaaactccttccacttcactggactctctatcagtaggaggcttacagtccttgtccctgccaagacagggctaggggcaaagcgcaagacattacaggtttgcaatatgttatccatcatcaaaatgagcagtgaacaaatccgactaaggtctggaagcaattgaacaactctgttattacttttgtgacacattgtcatgggaatgtgtgtgagcttggggctcttgtgtctctctgcggtttctagaggcagcttgacttagagaatggttctgtccacagactgtttctgtgtgtgcgaggggagcttcctggggccatcatgaggatttcttttcttttgagtcttgtaaagtattgacccatagaatatgagaagcaggacatgttctgttcagttgtttttcatgtaataaaagattcttgctcaaactttgagtttctttgttagtttctgtgtccaaacggtgcattttctgggatttgagctactcccttgtggtacattgctgaggtcagtttcaacccagatgctttcaaccttctctacacttaaaatgactgcactggagtacattgaatcctttgctaatggtcagcctcattcttggattccacataatgaggaaatttaaatcaaataggatatagaattttgaacacagcccttttggtctcgtggctgtaagatctcaaaagcacctctgagtaaggtctcatgtatacgtctcacctttattttacccaaagtttgagcaagaatcttttattactatgtggcaggcaattagaagtcaaggggcatcctccgttctctcccaaacaaaaaaaaaaagaacaagaagaagcatggtactagtagcatcattcctagcaggccagggccagcatccaagcatgggttctgggtctgggctaacagttcccggccgatttagcaaagttctgataaccctgtctagttaaaggcaattctgttaaccctgtctagtcaaaggcagttctgttaaccatgtctagtcaaaggcggttctgataaccctgtctagtcaaaggcggttctgataaccctgtctagtcaaaggcggttctgataaccctgtctagtcaaaggcggttctgataaccctgtctagtcaaaggcggttctgataaccctgtctagtcagaggcggttctgataaccctgtctagtcagaggcggttctgataaccctgtctagtcagaggcggttctgataaccctgtctagtcagaggcggttctgataaccctgtctagtcagaggcggttctgataaccctgtctagtcagaggcggttctgataaccctgtctagtcagaggcggttctgataaccctgtctagtcagaggcggttctgataaccctgtctagtcagaggcggttctgataaccctgtctagtcagaggcggttctgttaaccctgtctagttaaaggcagttctgataaccctgtctagttaaagccactcctgagattaaggccacatcctaggcttcttgactcttgtcaaacaaaacacctgccatggcaacagttatccagatacagttttaaaagtgtttctcaccatatttatattgttttctttagtaatgtaattttcacactcagaatcagtagcctggcagccgtccttggggctcaggttgctgctgtatctctgtcattgcaattggcatatttcacaaatggcttgttacagtactgtcttgaaggtgacttccatgacagaggtctccaaaagtaccttttgtttgttttacaatagagacagggtctccctatgtttcccaggctggtcttgaactcctgggctcaagggatcctcccacctcagcatcccaaagtgctaggattacaggtctgagctaaaagtaccttttgaatgaacctaggctggacatatttaatctccaggaaagggacctcttggcaggatcaccaccactgtgtgcttctggtaggagcacctagaaattcttcgggttttttcacatacattaatctctgctcagtttgatgttcacccagatgcttctagcaaatacaaggatgcaaaatatatcttccacaggaaggacccctctctcccaaaggaagcccccaggcagagcttcagaaaccagtgtagcaatttcccttacctggtatcatagaaatcctaaatatgtacatgacagtgagggccaggagagtccggttccattttggaacaggtggctctgagaacagaatttgttacaggattcttcagtaactcatcataaggaatgagacacctgtgagtggtagtaatacttctgcaggctaccacgtacagggtggctaaggacaatgcatgttccttaggcaatgataacacaggcagagctgccagaaaccatggcagtaaccagcacagagatgtttctccttgtcccctgccaggaatactgcaaaagcctttagaggcctccttatataatggaaaggaaatggctctggaatttcctaccccagaagggagttgtgaggaaccaacaggacagtgtctataaagctccttgcaggggccctaccaccaggggcactgagtatatttttctcccccggggctgggtgcagtggctcacacctgtaaccctagcactttgggaggccaaggtggtgggtggattgcttgagctcaggagttcaaaaccagcctgggtaacatagcaaggccccgtctctacaaaaaattatccaggcatggtggcgtgtgcctgtggtcccagctacttgggaggctgaggtaggaggaccactggagcccagaaggtggaggttgcagtgagcagagatcatgccactgcactccagcctgggcaacagagcaagaccctatctcaaaaaaaaaaaaaaaagagctatctgtttctagccactactcaagttcacttgaaaagcaaaaaggtaccaaattgtagggcttgtgatcctataatgaaataatacatcttttaaactagtcacatgagccagctgggctgctcatctctggagtcagccagcctcttgcagcttgtggttggagaaaccagagctttggaaaaaccagagcttagtaagtatctgatctgagacaatgcagctacaaatatagaaacaacaatctctcattgaaggtcattttgtgttaggcaggttgctgcattcatctcattcaacaaaagttcattgagcgttcttcataagccaagtgttgtactggctgccagggatatacagctggagtttcagtcttgaattaatttctaaatttttattgcccctggaattttccacttctttcttgaaactttctggaaataaggaatgggaacatgaatcatcttatgcttctacctttaccattaagacttctttgagatcttgaaagacaaaaaacagagtgttgggaagcattttgagaacctgccttctcggtgctctgagcttagctcagtaaatggagctttttcactgcttttgcttaccgctcagatcctgtgtccagaaacatcttaagcaacaattcacctgtgattctgaaaatctaagcgttgggcctcccctcaccgtcccactccctctacttaggaagagaagtttgccaacagaaccccgtggcgaggattctgtgtgtgcctttgaacttcaggcctggtgcttaaggtcacgaggtttggcttgtgaaggaaataatgacatttaaaaagcaaaggaaagtactaggaagacctaagaatgccaaagataagatcttagtcatgtaggcttgaggtgtgcgtggtattagccttttgatattataggataacatgctggaaacttttccatgtttaaatttaaaactgtgagagacctctggtggctgaaatggttattcttaaggattcttttgttccatttcttaggggttgagctgacactttgagtttggtcttggttttagatacttcaacatagttggttatttacaggcttctgctgctcagtgcctctggtgaggtggggcaggtctggatggagctatgttgatctttggggtgagtgtctgtcatgctcagaacactgacctaagagctccacccagatccaaaagctcccttgagtctggaagttgctccaagtctgatctgctcaaaggtttccttcctctttccagggctccctcctgggctctgactgttgttctctgacccagaggagggaacctgctgtcactccaccccatagccaccactcccaaagtctatcaggtgagtccagatgtccctaagctaaagaaatatgcaacccaggttggtatgttatttgacgtcatgaagttggcctttagcaacaggcaaaactatagtaacacaaggagaatcttttttttttttttaagagacagggtcttgccctgttgactaggctggagtgcagtggtacactcagtagcctactgcagcctcaaactcctgggctcaagcaatcctcccttctcagccttccaaagtgttgggattacagatgtgagccactgcacccagctgagaatctgttttaatggccttttcactatattgagatcatttccttggaaacaaacaggctcgtttgttagtgttttgcactcatcatgagcaagccctaactgggaggatttttttgcatctcatgcctttcctagcagagcctgtcacacacggtgtgtctacagtgcattgcctgcttcgactatttacattggggaaaattgaagcccagaatctgaactagggctccttgtgatttttgattatagagtcagacagggagaaccttgcactgccttttgcaggtaaacaattagctcatttctacctaaatttactttttttggttaacttaagacccttcccaccaccctggcacttagcctacattttccaagtcctaccttataagcgttctttatctctgtcaaaattttaggaaatatttagcccgttttcctaagtgagtttctctaggttacataaggatatgtcagacacagtgaaccaggcctggaggatacacatggaccaagcaactgcctgaggtactcatcgtttcgtgactataatttgatgaaagacatagagctcttcttagtattcagtgggtatctggctgttgttattggtgatgctgaacctacaagtgcacctttgtttttttggggttttttttttttttttgagatggagtctcgttctgttccccaggctggagtgcagtggcacgatcttggctcactgcaacctctgcctcccgggttcacgcaattctcctgcatcagccacctgagtagctgggattacaggcgcctgccaccacacctggctaattttttgtgtatttttagtagagacagagtttcactatgttggccagactggtctcgaactcctgacctcgtgatctgcccaccttggcctcccaaagtgctgggattataggcgtgagccaccgcgcccggacacaagtgcacctttgttagtctcttctaatttataaaacgcccttgacgtgaatgatctcatttacttgttattactgtgccaggagattggtgtgctgtcactcaccctgcccttgtgggaggctacggctgagaagactggcatgtaggccacactccccactgaaattttgggccaaaagtcttgacccaaacaacgtctacctcccctaaccctagggggctgctcttctgctgagcagctgcttccctgccgcctcatggcttgactggggtcccggcagccaggcttcagtgtggcctacacatgggacattccaaaccacctccgtcctttgagaaggcagctagtctctgaacagtggccagcctggggtggaatatgggaactgttaaccaaccacaacaccatgacagtttccagtttgaaaatagtaaccctcgcatcctgttgcggtgaccaagagggtggcgagttcacactttccagatgtgattggcatttccccagaagtgcctgccaggcggattgggcaggttaagccaaacctaaggtgttgacctgaagtacctctgtttcttttggctacagccttctgtttttctttctgaatcagcattctcagggtcctagaagaggactatggttgatttcactcagctggttttagacttctttgaaactggaaaggtgaattcattaaagaacacaggatttgtccatcttccctccactgccttaatctccctgtgacatggcagctgggcatcggcattgattttgtttgttgttgttgttgtttgagatagggtctcactgtctctcctagactggcgtgtgaatcacagctcattgcaggcttgaactcctgggctcaagctatcctcccacctcagccttccaagtagctgggactacaggcatgtgccaccatgcctggctaatttttaattttttcgtagagatggggtctcactgttttgcccaggctggtctacaactcaagggatcctcccacctcagcctcccaaactgctgggattacaggcataagccactgcacccagctggcatcagcattgagaaatcaggtggctaagaccagaaaggcaaagatagcctttgagacggttctgttgctttttacaatggagtcttagatttctagccagtaccatcatctcagaaagttaatgctgaggtttggagaaccttggcttaaagcaatatcaccttatttttttttatagcagtggtattttgctactcagatacagaatgccccatgtagtccagccgatgaaggacaaagggtgaggggcttgtcagggcattgcctgttgggaaacaccatcagctgactgatggggctggtttgttaacaatatgccgcggacagaggagcagctgtccctgagactaaagatgtgtcattgtttgtatctctaaagagctttttgctggagaaacccaaacaatgtgcaagaaaagtgggagatgcaaggctgcgatttcagtgtgaccacaaccatgttcttccagagaaaagagaattcttaattgtctttttctcatgttactctgaagtctctgggtttcttggacatttgttaagaatctgaaatatctcaagaatcacatttaagttcttcaggtatcaataatacttctgttccttttcttatgtccagcattggatgtcttcccccagggtttgaggtttgtcctggtgatattgtcaaccacaaccaaaggacagcatgttctgagcatcttctacacgcctgacaccatgctaggtgtggggcacagaaacataaaacagaggctttgattgcgtgtgggtttgtaggctaatgagatgaggcagaccagcaaacaaacaagtccatcagtgtgccaagtgattctatacctacgtctcttaactaagtcttctggtcagcttttgaacatgctcaggtctgtttaatctctctctctctctttttttttttttttttttttttgagacggagtctcgctctgttgcccagggtggagtgcagtggtgcaatcttggcccattgcaacctccgcctgcctggttcaagcaattatcatgtctcagcctctggagtagctggaattacaggcgcctgccaccacgcccggctaatttttgtatttttagtagagatggggttttatcatgttgcccaggtttgtctcgaactcctgacctcaagtgatccacccacctcagcctcccagagtgttgggattacaggcgtgagccaccatgcccggcctgtttaatcttaaaatattaaaaaagaaaaaaaagaaagaaagggaaaataatagaaaataaaaaccctgtcatcagtctgcaccacactcactgcaagctcccctttcctccatattcacaaccacattttttttttcttttttttgagacggagtttcactcttgtcgcccaagctagagtgcaatggcacaatctcagctcactgcaacctcctccacctcctgggttcaagcaatttttctgcctcagccttctgagtagctgggattacaagcgtgtgccaccacacccagctaatttttgtatttttagtggagacagggtttcaccatgttggtcaggctggtctcaaattcctgacctcaggtgattctcccgcctcggcctcccaaagtgctgggattacagccgtgagccaccgtgcccagcccacaaccacatccttaaaacagttgtctacacttgctgccttccttcactgactccctctcagtccttaactcagtctaatttggattcagtcctgtgactccactaaaatagtcttcccatgtccccagtgaccttgtcttgataaatctatgggctctcagccctcatcgtacttgacttctcggctgtagtggactctgttggccatgccctccttgaaatgctctcttcccatagtggtaaggagtatgggcttctggtcaaacagatatgggtgaaattccagccctgccacctacctgctgtgtggttttggatcagttacttggcttctctgtgcctcatttccatatctgtaaaaattagagtaataattgtaccacaacatagggttattattgggaggactaatgaatgagataatccatgtaaaatgcttagaaccatgcctcgcctattgtaagaattccataaagttttactattattaagagattttaatggcttgttatctcagtggaattacaacttcccagaaggcagtaaacattgaagtacaacatacatttctctattgcacattgactaagaatatcccatgtcctataagatagacaaggcactattcctctcctactggtgaggaacctggaccgctgcccacagccagcaggtaggtgggtgaggttgcacggcagcactgctcagagaggacttccccagcaagtctgaggagttgcacagtggagggacagggataggacctaggagagcaggggagacgttccaccaaagctgagttctaggggtggttttaagcaagggagagctgtgctttctttgtgaaagaaacagcccttagttggcaagttctccaatgcataactcccccaggcatggtaatgctgtttacaagcgcaggaaacccatggtgagaacaaaacttttcaagagcaacttctctcttgcccttggagatttatttagttgctactgaggtgcctggacccaagctgagatcccttgtgaggaagttgggaacacgtcctgtgcgtttcagaaatctctgttctttactttttctacaatcaacaccagcacatggaggggagagggaaaatagtgggatgggcatattgctgtggggaccaggcttggagacaccctgagaacaccaggcagcacaggtcaggtggggacacacgagggcatgggaggacaaggggtctgttacgtaatcccaacctgcttgtcagcagagccaggaatagcgcttcttaggagggatttccccccaggaaatcttcaaagccccagacagaggccgcagtccttggaagcttatgtatgtgtttggccacagtgagcccatcccgggtctggctctggtgctccagagaggactgtggttggcccagcatgtgagcgccaagcaggtctgtcaccgagctctccccagccactgcgcattccgcactttgtaatctcatcccaggctgccctggctcggcagtgtcacacggccctcagccacacagacaccagcgaactgaagcacacagctgctgacttggcttcctgctctgcctacgacagttgatggagagttccagaaactgggcccagagtctcacacagagctggctagaacacacatgaaatctgactttgggtgatgatagggaaattacctcccatgtgtaaaggcttccagccacactccctctatgtctttgagccacttcctgtttacatggccaccttttcggaggagaggggaagagggaggaggaggggacactgccggggagaggggagggttccctgggggatgtgaggaaagtggggaaacacggggggggggacactaaggcagaactgagatgagacgatgagaggaggtgagtgtatgtgcaggagacactgaccgtgggcatgggggtgggggacagggccgtgagaagagagaaggggacggccctcctgtctcaggcgctgagcccagtcctccctcttcagccttctgtgagccagaatggactcccggaggggatggagctgtgctgagggaagccaaggaagccacagtgcattccagagctagtggaaactatttttgagccagctatggagagatgatttgtaccctgagggcctgacgtctgcctggttataacactgagctgggtgaggatgggaagaagagaacccctcctcatttctgccccatcccaagctggctccttccttcctgcagccccactgcggtcctgctagccctctgcggtcacccatggctgccttgggcctctgcagacccagagtggcgtttgggggtgaatggagcagtggctttgttcctgggccagagttgagggtccccgtgccctgcctcagaggccctgctgagggtccccatggtccctgtgccctgcctcagaggcctccctgagggtccccgtgccctgcctcagaggcctcgctgagggccactgtgccctgctctggcatgcctcagggagctccccacgcagggcagaagggggcctctgtggtgtgagcctccccgccaaggctcagactggccgagcagctccctcaggctctgggtgttgtcagtcctggctgttcttgcttccgactgggcatggcctcggtcacctcatgaggccctttaactgtggaagtctgtgatttaagctgacaaaaagggtacccctgaacatcctccaaaaagacctgtgccaagctccccccacaccccgccatgataaggcagtgatgtttaatgagccaacactattctaagtggtttatagaggttaagcgagctaactcacacaacaaccctacccgcaaggcatttttactggccccatttaaatatacaaaggggtgaaacggcagccactgctggtaaatagcagattcaggaggccagcccgggcagcctgattccagaatccctgtgttaaccaccgcactccactgcccccttttccaggtggttcttcatagcccagctctgttctccactgcccatgtttcatggtgaacaggctcctcttcatcctcagccttatgcacaacttcccacctgctccttctcctgggtctgttggtgcctgagaccacagggtagggggaggttggggaggctggtggtgggaggcctcccacacccaggtcacacgtttctcgccccccagtactgcctttggctcattgccttccatcccctttgctccctcttttgagattgtctcatccctccacttttcctgtcacatacctcctggttaccccctacattccccaaagacctgatcctgcctcacactctcgccctctgccccgagttctgctgttctgggtgccttgcctttccctgtggacaagctgtactacacgtgggtctccgagttcctagagtgtcaactccagtggcacccacggcaatgccagctcccgtgtcctgatgccccatgtgtcagagatcacttggaagagcactgatgtttctgacagcattcctgcaagggaggcattatcctcatcaacacaggaggaaacggatcatcagagaagtttagggacctgcccaaggtgacccagggatctgaactgagctccagcccacaccctcagcttgtcacacagctggtcaccctgtttccctgaactcctctgctgttggaacttaaggcttcagcatctccccatggccacaccctcgccctcagcccagcctctccttcctcccactccatctctactgtgatctcttcagagtttgccattcccttgattccttcatttccccatcctgcacgactttcttctgaatggttctctttaatctgaagaatgctcaaatgtatcccatctgcaaaatcccccatcctccttgtcccccatctccgcctgtccccacacaactaggttacctgtgggagtcccctacgctcactgtcaccacctccttacaccctgcaggctggattctgtcctcactgctttgtggtgcagcctggtagctgctttaggatttgcctgccttgacctccacagagcgtcgatgctggggcttcctctcacgtcttcctgggctgacagggccactggctccccttctgcctcccagcctgccccttcctctgaatagccaggattcaattttataagaggaggcaagaggctgtgtcttggcccatagcccacacaagcacttttgctgatggaaagctgttgaattctatacagctgaaaatctgtataaatagacacatttacaacttcctgtccatttggctatcaatcattgtaacaaaggtactaataataacaacttgcatgtgtagcagttcacagcttgcacagggatttcacatgtccttcagtatccctatctatgtgtaatgaaaatattttttccgcaggcactattaaattcaactcactttgccaaggtagcattagatgttagctttgttttgatgaagagtcctgacttaggtcctctgagcactgtccgccaggatgttgttcccaatccccatgatggtgattgataggttattgatccttgggacagggccaaatgacgctggtccttttgatgacatgtgttcctcctagggcagtaggagggtctggggctgaccagaagatgcaggcaatctctgagcacgcaggctgagggaaaggcaggttgaggctcaactgcaggagctgagacatttggattgggataaaatgtgaccaggcctatgtagcttttgactgtctgtgtgggtcacgctttctgaaggagtcttggaagtcttggtttcaaccaaggtggcccagtagttgtgacttgtgtgccagctcccaccacttggtagaacctacttggaggactgcattgaggattctgagggcaagcccaggccccttggagaagactcctatgaggagacagcgatgcctgccacaagtgtggagaaggagatgtgcagcgtctgctgtcactgctttaggctgtctctgaaaggcagggaactacccaaggtaaactcaactgggactattatcagagtcacaaaggacaagcattctggtggcttcagtgatttcatcaagtgtgaagcctggggcttattttctggtttggctggctagggctttgctttgaagtcatcaaatattggaggccaaaaagccatgcagatgaaggttttctgatgtcccacagcccctccgtggctcccactggctcacccccagaaacgggctgggctccacacaccactgctttcctggcagcttctggctgggctcaagggtggtaggaagcttttaggaatggccagcagctctggccttgggtcttgtccctctccaaggaacggtggtgacctctggtgagccaccagctctcaccctctcctacccttgactcctgactcctcttcttataccctaggtcaggggcacactcaaccgccctgaccttgggctaggctgtggaactctcgggcctgcaaggtatcagacatacttaaagcagctaggcttccctgccccccagccatcccaggggaaatgaagagcagcaggcaccttgcctggctcccctctgcagcgaacaggccttttcacaaggaaggcccgttcccttaacacacatgcctcaccccaagcccaggcccttcagcaaaagaataggctacctccaaacctttgacacttcggcatattgtgccacattgtatttggataattttatggtgcagccagcaacaattagagtaggaaagaaaacaacacccgcctggcctctgtgccatctttgttgcttagcgctgagcatgccttttactttttatatgtttgtgttgtggggatcgtgtgatggacaagccatcagagagtgccagagccgtattaagtctacccttggagtgcatcagtgtctgcaactcactttgtaatgcatctttaaaaatacgggttgatggaagggcagacaggtggatagataagcagtcaagcagcatgtcacatgtgaaggtaggatctgggtggggaggatatgtatgtgcactgcacaatcctttcaactttgctgcaggtttggaagttttcctaacaaaatgttgggggggtggggaataatcccctcacagtgagccattttaattgaaaccaggctcttgaccagtgtgctccctgaggccagagggtgagggagttgtgtggattggatccatttcacctgtgaaggctccccgtggggagttcctgctgccaaggctcaaaagtggtgctggtcccagactggtggagaggaggggcaggaccgccctctcccttccagggatgagctcatgctgcccattgccccagcctctgctatggaacccttgagctgcgagacactgccctttccagtggcttacccctcacacgcccgcatctacacagttaagactgcattccacagcggactccgggcccgagtctggctttccttccctctcctggagggcttgccatctgcttcagcgctgcctgtgacatgggagggcacctgctcagcacacatttgctgtggctctgagacccctgggtaagcagagaggctgtctgagcacaggagggttgggaggcttggctgtccagatggtccccctgccgcctacaggttctgggcaccagagagtggacggagccaggggaagcaggggcaggaagttaagtggcgggtgaagaggctttctggagttgagttctgacctatattatattgtgggtcacacacattggtcgtccagggaaggtgctgggatccagttaacaagccaggtaactgactcagatgtggaagtaaaatgaaaggtctccccaccctgcctctccagtcacccactagttgatgagtggtgctcagcaaatgaaactcttggttgtattaatatcagccttcacataatggcattagggaaaaaaataatacaaagttgattttttaaaaaataccaattgtagcactgcgttctgcctctgattgtgtagaaaatggagactccactgtcaggcccttggtccccttggaagacggtgctatctagtcttttcacagtccagcacgctcacactccagaacaaacactcacactccaacacaccctcacacacacactccaacacacacagatgctcgcactcacacacatcctccctcacacttgcactccaacacacatacactcacacttgtacacactcatgcacacttgcacccactcacaaacatacacttaaatacttcctcacacacacttgcactcacacactcatacacactcacactcgctttctcacaagcacacacattcctctgagccgagtgatattcctgcccctcacacctgctgagtgggggcagcccccgcctctccacccttgcaggcgatggagaggaccccctgcaaggaagggccagggcatccccctgcaggttctagtcctggctgcctgtgctcataggaggcagtagactttggcactgagatcatggactctggagccagactctctgggtttgagtcctggctctgctgccactagctgtgtgaccatcaaccattgcttcacctttctgggtcttggtttcaccccttatataacaaggacaataatgcctgccccataagtcactgtgcggattcatcccatttctacgtgtaaggtgctcatataggaagcactggtgagtgttagctgctgctgctgctgctgctgttctcagcatctgctcctaaatcatccatttctgggtttcgggtccctgggcaggaattcagcttctaactaggactcagggagaacaaccgtgttttctgctatggctgtaacagatgaccgcagatttagtgacataaagcaacacggatttattttcttacagctctggaggtcagaagcctgaaatcattttcactgggctaacatggaggtgtcggcagggctgcattccctctgaggctcccagggagcatcggcttcctggcctttccagcctccagagctgcattcctcgcattccttggctcttggcatcctccccatcttcagagcagcagccagcatcctggcttctgttgtcccactgccaccttcctctgtagtccagtctcccttgctccctctcagaagaaccttggtgattacatttagggcccacagagacaatccaggagaatccctcatctcaaaatccttaacttaatctcatctgtgaaagctcttttgctgtagaaagtaacagtgatactctggggattggagtgggaacatatttgggggccattattcacacaactgaagcaggaggaagcttccctgggtcctggccctgtggcccaacttggccaagttctggaccaacttggagcaccagtctagacccaacccagccacacccgctgccagggtcccctgctgtcccttcatgctggctctaggccctctgtctatctccccaaacaggctctgagggcagagttggtgttccattctctgctgaatcccagtcctggcatgtggggcaccagatggttatgtgctcatgtgtaaaggtgagcaggtgctgatgtgccacatgtatccttttaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagaggtactggttccactgacagccccaccttacttctcacccaggccaggcctgtggtccagccaggcagccctcagggccggctagcctccactcctcacctcctgcatctcccacccagcaagcctcgctggggagccgcattcttaccaaccgtaactgaaactgtggctttcaaatgctggttccataagggttttgtaagaaaacaaaaacagaacaagaaatacaaaactgctactctgttcctaaacacgtttagaaatcacgaaatcacagagttaaatgaaattaaattggtgttggtaccaaaaatagcaccttctcagagccttgagtgtactattgtgtgctttcacaggagaatacagtgtgcatcttttttcaaatgaattaaatcccccacactgatatctcccaaacagtgtttcacagaacccttatgggaaatgctgacaaacatcatcagaaggtaaattggaaagaggccgggcatggtggctcacacctgtaatcccagctctttgggaggccaagacgggtggatcacttgaggtcaggagtttgagaccagcctggccaacatggtgaaacacccgtctctactaaaaatacaaaaattagcggggtgtggtggcacgtgcctgtaatctcagctgctccggaggctgaggcaggagaatggcttgaacctgggaggcggagattgcaagatcgcaccactgcaccccagcctgggcaacaaagtgagactccgtctcaaaaaaaaaaaaaaaaaaaagtaaattggagagaaaggcacccgacctagataaggcatgccagaaaccactgcaaatggcttttgaattttctgctccatttatacagataatagaacacgggctctgtgctgctgctgaatgcagagattgtctagacctgggccccagccttcgctgactcggccatggcctcccatagccgtgctgacctcctcctgctcagccccgcatgctccaccagagtgcaaatgagagggaattacagaatgatgcccctggaaagcaggagtgacatttgctcttggagtttgctggagaaacagctgtgtcatcattacccatgctaaggaggaagggacacagaggatcagaaacaaatcataatacaaacgtcgcttctctttggctgaggaacgcatctgtgattttctcttggcagatttcccttccaaatgtctggctcgggctgataatgaaatgagttcatgctccctgcgcctgcagcggctgctggtcagtctgtgctcggaaacgttctgggtggcagaacccctggttggacatttgccataaataacccaggcgtgggtaattgaaagctggctgcagatggagagacaagatagacagggctgggttttaatgtgtttaattggaggagatgggggagagtaaggaagaagaaaaacagattcactttagacctgctaagagcagagaaaaaacagatccaagtagaaacagcccggggaaggttaggatcctggatctggagcccagatagctgtggccatcccagcacagagtcagccattatccacgttttgtatccgagggaggtgcccccaacctccagctcccagcagcagaacctttttgagcctatgcttctagtccttggggcacactaggtaaatggggagttggggtcaagctaggacaatacacatggagctcatcaaatgagtcttgccttcctatggagcagcaggcaatggaggattggctttaagtcaaaggcccaggggaaaacagctctagctttaaatgtttaaagcatttatttcttagaagacatagacttaataatttattattcattacacaatatgaagggagcaaggagagcaaagagatgccacaagggaatatcacgattcctttttttttttttttttttgagacagggtctcactcccgccacccaggctggagtgcaatggcaccatcacagctcactgcagccttgaactcctgggctcaagtgatcctcctgcctcagcctcccaggtagctaggactattggcttgtaccaccacacctggctaatttttatttttttgtagagacagggtcttgctatgttgaccaggctggtctcaaacgtctgaactcaagcaattctcccacctcagcctcccaaagtgttgggattacaggtgtgagccattacacccagcccactattccttcttatttgtctctgggccacactgaccctctgtctctttcacagcctaggtggaacttttttttctttttaaacgaagtccttttgatggtgacttacatcagagtctgttttttctacttgctgcttgttaggaggcaccaggttttgaatgtcctacatccttttttttctgggggtttcagggcagccagtcttcgttttctggatctaactaaccacacttttcactttgggtgagttcacactcaacacccagctgatttcagttaacaggctctcaagagcaaagtgtctctaaacaacttaatttttttaaaaggcagacttattttagtacatgactacaatatattacaagtttcaaccagtacatggggcatatgagttagactgatatgtccacatggatacttagggagtgtttcctggaagcagcctggagctatggtttaacaacagagaatcagatggcagggacagagaatcctggccgggagagaaagcagccctcttagccctgtgctaatctgggaggctggtgcagggggagggtgggggatcgggggcagctgggtcagcatgaatgactgaagctggaaccaccccttcctggcccccagccaggtctcagctgcccgccttccggggctgtgactgtggggagagttaccatcttgtttctaacttcagaatatttccataaagtcagtcccaggagagtgggattttgtagccatttcagggatggttgagctcctaagcatgttagaacctcttaggaagcctagtctgagaggtggggcacctggctgcagaacctcaagttctcctccgtaaaataaaggggacttagtgaaatggtctcagagctcccgtccagttctgctcctccacttcgcagtttctgcactggaaatgttttagtagctggcctcttaatcccgaggagttaagaaacagatgatgataaaggctctacattgcagttgcacatccctctgtatttttgccagagagctttctggacacccagcccctttggtccccacaggcctgtgggggcacagcggctgtccctcgtgtagctgaggtcaccccctgcactctgatggcctccctggcacacctggctcttgagtcctgacccggtttcctaggggcctctcctggtgtctcaccctcctcgaaggccaccaggcagcactgcatcacaaagtccctgagagcaacatgccccagcccactcctccctggagcttcgagctcaccatcttatagccccatcccccagccaccagaggagcctgggacctctccccttgaacatcagctttacagcccggcagccagagcttagctccccaccctgtgacctcaggaatcctgttctcccagatgtctccgaagacagacaaagaatgtgtgcaacttggttttgatgatataaagtataataatgaccatttaattgaacgttgtagttaagcattttcacccactatctgagccaccacctgctgttagcctgaggtgggaggagagaggctcaaggtgtcactttttggctgctcatccattttctagaggaggcccctgttaaagaacaagggttccctgggaggagccatcaccctagagcctgtgccagagcctagtgtagactgattcgtgggtaagtgggcagcaggccacgggggacctggcagatgggctctatctgagagggagaagggggctggagcccgagattctccgggacagtggatctcagccctcgacatgcatcagaattgcccaggaagcccagtccccggaggtgtggttgggcccaggtactgggagtttctcttgaaagctccctggagagttgaacgtgcaggagggttgagatccccgccctgggtgatgaccagggcgtgatgtggggaactaggacaatgttggggcattgagctctgaccatgggagtgtgaggagctctgggaggccaggaatactgttttatcacccagaaacctctggcttggagcagactcctcaccaggcattagatggaccagagtgcagatggatttgtctcctggtgtcagaatttgaaaggtctgcaacctgacatgtagacaagacatgccactaaactcacacaggctcctccaagaacccttgggcttcctcccataacaagaagaaaggcagagcagaaacattccctgaggctgaacatctgcagctggaaagaagtgaaagccttcccaggtcctgcactgtcaggagctcagggacaggtgtgggactgttctacattatctgacacccacctttatctcctcttttccaaagagattgcgtcgagtgcctgctgctccactctgggaaacctgacaaccagacctgccacagcctatgcagggatgaggtgatcacatgggtggacaccatcggtgagtgtgctgccaccacccgggcagtcacggtttttctccttcctggggaggagggtagttttagccttgagtcaggaggcactgcccaggcttcctgggcataactgtgggctccccatgaggacccggtgctggaaccatcatccacagctgatgggaatgtagaatggtacggactttggaaagcagcttggcagtttcctaaaaagtcaaacgtagaatcaccatacaatgtgccaattccactcccaggtatacagcctagaggattaggtccatatgtccatgtaaaaatacgtacaaaaatgttcacagcagcattattcgctatagccaaaggtggaaatgaaccacatgtccatcaacggataaatagaaaagaaaacaaagtgtggtccatctatacagtggacactattgagccactaagaggtgtgaagcactgaaacacgctacggcacggtgaggcctgaccacagtgcggagcaaaagaagccatgtattatatggttctgttcatatgaaatgtccaacacagagaaagccatggagacagaaagtacattagtggtgtcctgatgctagggagaagggaaaattggcattgactactaacaggtgtggatttctttctgtggtgatggaaatattcagaattagtgggaatggttacacaacattgtgagttgagtaaaacgactgattgtacactttaaaatggtttaaatggtgagggggaaattatgcaccttgaaagggaatctgtgtctcaggctcccctcactggcaggcttcccctctatcttcacctctggcttctgcaaactcctggcccccagctgcctgtctgtcttggtcctaacttacatcttttgtagacttccttgttcccacctgcctattttgactgactacagtcacggcttctgagggttttttgtctcgagacagggtctctgtcacccaggctggagtgcagtggcaccatcatagctcactggaagtctcgacctcctgggctcaggcaaacctctttcctcagcctcccaagtagctgggaccacaggcatgtgccaccatgcctggcaaatttttgtttttgtagagacggagtttcaccatgttgcccaggctggtctcaaactcctggggtcaagcagtccacctgcctcagcctcctaaagtgctgccattacaggtgtgagccaccatgcccagctccttcttaatatttgagctatatatgcatccagcacatattcgttgagcgcctactgtgtgccaggtgctgtctatctccttaggagactgtggggagtggaccacagtctggttcctcacatgcctgtcttcctgcccctgcttctatcttgcagctcagggcctggccgacctcaggttctgccagcagacctgggctggttgcccctaactaggcacacatggtcagagaaggaaacaatgccttcctgtggcccaaggactggttcgcttggtttatagcagtgacagccgttcatgcacagctgcttcccaacccagtcctctgagagagcagcagagaaagcttatgttccaatccatcatttaccctttttcttctttcttccaagcttttttcatacacacactcacatgctcactcatactcacccagcccagaagggagctgagacagaaagtccaggctttcgtgtctgataaccacactaattcatctgcttccaggttacagctccgtctagcagcaaggttgaaaaggttaaaaaggcaagagctggaaagcatttaccgccctagtgttcaccttctgttcctccccaggacccattgccattgccactgcatttcctcaccccttgcctcactttgcacttcccctagttcctttctctccaaaaaacagcccgctaaccctctcccagggaagccttggaatgtaggtaatgcctggacaggggactgtgacacccccaccttggggaatggcagcaagggggcagggagttgctgaggcagcttgaggaaggggcttcttaatatggaggagggaggccgggccacgttcagggccaggctggggacagcctgagttccacactgtctcactttatctccaggcatggccaccacggtgggcaccagcctctcacccagtgtcctcactgccctgtggttctttttgattttgcatcccaggaaggagttgctgcctcttggcctctgtggccagctctcagccccaagtggcctgggctgtttctcaaatatgaagccccactcaagcctcaaagggggctgggatggtttttctttctttctttatccctttaatttccgtggccaatcccttcacccgtccccaccccgaaaccattaaaaccttctgttatttcacatcacccccgactaacacttcagaggcttggagatcctctaatgtgttccacgtgtccccaaagccatctaaattcagccctgggcctgcattcttggtgtgagaaaactgaactcatcttcaaaggcccagcctccccttaagattttctgcccacaccccccatgccctttcctttttcaaggcactcggctccctgccccgaccatcagtggctgtgggctgctcagagagactcaggccattcccgcttggttttcttccagtgaaagatgaccaggaggctgtgctatgtttctacaaaaccgccaaggactgcgtcatgatgttcacctatgtggagctccccagtgggaagtccaacctgaccgtcctcagggagccaggtaggtgagggctgcaagggctcggcccactcagccagccctcagttctgatttctgatgccattctctgctctgggaccactgccctttctgtcctcatcggccttttgaaactgcagggagaggagggatacaatttcttctttttctttttttttttttttttgacacaggctgtcactgtgtcatccaggctagagtgcagtggtgccatcacagctcactgcagccttgacctcctcgggttcaggtgatcctcccgcttcagcctcccgagcagctggcactacaggcatgcaccaccacaccgggctaatttttgtatgtttttggtagagacaggttttcaccatgttgcccaggctggtctcgaactcctgggctcaaacaatccacctgtcttggcctcacaaagtgctaggattacaggtttgagccactgcacctaaccagtacaatttctcatgaagaccagatctgaggtcactgctgctccactcctagagtttagaagaaagatgaatgtgcagctgggggcccattcttggggcaagcgctagtgggagcgtgagtcagggcaatgggagttatagaaggatagggccctgtccctggggagggtctcatcttggaggagcacagacgtgaaagtaaccacagaacatacctaccctgcacagccaaaggcagcaaggagctgctgtgttctgcagggagggtgcagggcatctagaccaccagggctgggcagggtatcactcaagtcagggagcatccagctccacacacagcctgggcggggccactgctgcttcccagcatggattccaaggacaacggagcactgggttcaacattcctgctgctcccatgctcagctcccagcaccactgaagaggtcaagctttaatccaaataccaacattctgcctctgcttggacccagggaccaatagcctttgccttggagtaactggaatatctgatatcaccccttacattcttcttgggggtagggaggcaggggtggagcagaaaaagatttgctctcttcaatcgacagcactgcaaactatttttccaaattgagcccaaccacataatgtgccttcctgaggccagaggcagagagaagtgtggtaccagcctaggatgcacgcctgtaagaatgaggctttgtttccaatgctgtgtctgaggttctttgaaaacaagcacatttactccaagggacaccacgctaaaggcttacaaatgttggcccccagcccagaccttgtggaagtggcttcatgtggcttcatggtacctcctgcctgcccagtctgctcctgaaaccatgtacacgaaagctgagcgggtccagcatcctgcaatggagactgggccaggcgggatgtgggtgctgcccatgaggggaaaggcagccctgccccagggccctcatctagactttgccacacttgctgtgtgactttagaacagtcactgtcccttttgaatctttcattttttgtacattggggaaaccctcctgaggatctaagggagagccgaggagaaggcctttggaaggggtgcaactttcatctcagaaatgcctgcagttgcgtgagaggggcatggtgatgctagtggctttgcttaccatgcttctggtccccccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggtaagcacgtgggaaatgggaagcagaggagacttcaagctcagaggcgtggttgagttcagcggtatgttagcaatagaggctcactaatgtctttggcattaaaaacaaaagaatcaacaccagaaacgctgtgcccagttctggagagagagaattgcacagccccagtgcagagtgagctgcacagatccctgttccagacccaggtcaggaaggtcatgggggcagaggcgctgggcgtgcctcaggaagagtctgaccagtctcagagagagcacagaccaacaggaaagctcagattcttatggtccattacaacactcacacctgcagtctggtcaccccaggcagactgcaaatgcccagaggactgagcgcagtcagtttctgctgaacctgggcttggtttctgttaaagctggaagggacttcagagaccttctgacccaactcctccttccagaggtggatagtgaaagcttagagaaggcgatggctttcctggggaacacagagctgtcctagagcccacggccgtctcctcctgagtgctctgcctgctgctgtcgcagggggctgacctgggaagggatcctagggcctgcgtctgtcggtttgagtgtgtgagctaacatgtgtcctcatcctcttccccgccgtgttctgtaggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgatactctctgtgtgtttctttctttctgagcggacttaaaatggtgcccccagtggggattgaagcggccgtgtacttcctcagggatgggacacaggctggtctgatactccagactgcagcttgtcaagtaagcatgaggtgctcggggcagtgagggctgtgcaagggggaacactgagcagatacctttggccccttccagcttttactgacagagagttccaggctagacaccataaaaaccaccccttggtctccctcccttgttctgaggggctgaggctggaaatagattgtacagacaagcaagggttgagtggtggttcccacacgaagtcatctcttaaacatcattagcaatagcagttcccttccaaggcctcccctcactcccgaaacacttacgtcccatgcaggcccaatgcaaaaaaacacatttgagcttttttcccgcagggccatgaagtccccttaagttcccatatctaagatggttgactgaccctctccccttatgtacagaagaggaaactgattctcagagaggggaagtggcttgcccgagtgtttgttaggaggttactgaatgacaaactgttcctaagaccccatctcatgctggccagagggccagcctcctcattcctgcttgctcttagaaaatctttcactgatcattttttgtcactggaataacttcaaggttattatgctttcattccaaatggatctgtcctcagctctggacccaattccccttacttcattttggcaaacactaagtcaaatagtgaaatgcctgtcactacatagaacctattacctggggcaaatacgaacagattgagtttccttcatcttgtgtaaatatgatgaaacagagacctggtaacttggtgacactgttaaaccctttttgggataaagccaaatgtaaatgaaaacattaaacagataaattgtggtgttgagacttttctgaattgagaaaaataaatgtaattttggaagaaactttgggtttctctcatgtttaattttgggtttcctggagacaaatcattaactggctcagaatctcattttctctaagggcacgacattctttttttttttttttaagagaggatctcactgggtcactcaggctggagtgcagaggtgcgatctcagttctctgcagcctcaatctcctggtctcccgtgatcctcccaactcagcctcctaagtagctgggactacaggtgtgcaccatcacacccagataatactttattttttgcagagacaaggtctcactatgttgcccaggctggttggtctacaactcccaagctcaagcgatcctcccaccttggcctcccaaagtgttaggattacatacgtcagccaccgcgcctggcctgggcacaacattcttgagccacagatagcaaaggaggatttgttctagttccacttgacgtggaaagtgagggtgttttcgtctgacgccgagggatgttacggaaccagtgctcacggtgccttgctgccccctgctggaagctcttggcatgagctgtttggagatctgactcccgagattccgacccaatgtataattttaaaggttatccagcgagctgcaagtgaccacaaagataatctattccaaacgcttcatttcacaacccacccccagatgggtcattttgtaattttaagatatttttatcaaaatgggcctttggccgagcatggtgtctcacgcctgtaatctcaacactttgggagaccaaggtgggaggattgccaaagcccaggagttcgagaccagcctgggcaacacaatgagaccctggctctacaaaaaagaaaaaaaaaaaaccagggaattctcattcagcttgattgactagtactttattaaactaaccaatcgctacctcttccagggaagaaatgtgatttttaaatttgtttaattaggatcaaagcttgaggtgattatcatg

SEQ ID NO: 850 - DNA, 12570 bp, Human
  misc_feature (1)...(12570): n = A,T,C or G
gaaggactgcatttatttgccttgatccagcctgggagaagtcaggatagactttgggctgcttggccctggaggcagcttgagctgggactggggtggggggctcctgaggggctgcctaggacactgcagcttttgtgccttctccctgctgccaacacccccacacacactgctgcagccactctaaagccctttgtctttcattgcttagtcaccccctttgtcctcatctcaaataggggagtggaaaggggcagtagagttctctggtgatagctcctcttgcccctgccccttctggtctcccaccctttgtccgactcctctagtcccagccccgttggcttagaaccagggtcaggcaagtggtgggtcaagaggtgggtctggcagtcacaagggggtgggtgatccaggaagtgataggcaccagggcaggtattaccgacctgagcaggaagggagggggaaaggaagtattctgacggatatgatatgcgggggacaggaggtgacaaagcagagtgaataggggaatagaggcaagaggaggtggtccacttctgggaaaggaaagagactgctgactgcactctccttcctggggatttcctggggaaacaagcagccagaggatggggtgagcagaaattgcccctacttctgaacccttccttgccttgagagttcatacccaagacctcttttccgagttccctcctatccaaagccaaaggaataatttgcttcctttccctaacaccacctcttcctccccagccactttccccaccccaggcaatggatttctcccagtaccctaatttccctatatgcacaatgctgtctccaccctctccctgccccagggagaattaaaaagaaaagatgactagatattccaggaaccactgggttctcagagcaaggtggggtggatggtgggagccaggtggggattctcccagattgatactgggtgaatctgggttcctgagagcaagtcttgcctatgctgggggctggctgacttgaggctgggggagggtttagggcagttgggagtgggtaggagcagggccaaaagcctgggggaagctactgggagctgggccagggaaatggggagtcaggaagtggggagggggaaccctggggggaaatggaggcggaatggctgttctgggctttggagggggtgggtagtggtaactcaggaagggggatcctgagggagagaagggacgttagaaaagaggaggtgccaccctggatccgccttctataaaaggaaaagtcgttaacccctcctgccttgtcatctgccgcctctgttatgttcattccaagcaggatcatcctacctttgggcagtcaactccctgatcactgtctccttgcctcccccaatgttctgccttttttactcttcccagctgctcagttctatcctgagccatgtcaagctacctcttttatttgttcttccctcttgatgcctccttacctgttccctaccctcttttctcaggcagctcactcagtcccctcagccctggaaaccagccactagggccaaagggcagcatgagggagccttgagaaaagagaagccatggtaggttagactataagagcaggaattctcccaggaccgtgatcctatctgtgcatgccggccaggccctttccctcactctctgcctctcctggggctctgtcccaccaaaaagggaaagagacagctgagggctgattgtggggtttgggaaaaggctatgtcatcagctggcccagtgcctattatccattcggctgctagagattcccctcccctgggcaagtcccatttttttgggaagcgatgatacacccatctgagtcccaccgacagagctcagctgagtggcttagagatcagccaatcaatcgcagaggctcaccatgcttaaaagagctggcgcggagagaggctggggagaacccacagggagacccacagacacatatgcacgagagagacagaggaggaaagagacagagacaaaggcacagcggaagaaggcagagacagggcaggcacagaagcggcccagacagagtcctacagagggagaggccagagaagctgcagaagacacaggcagggagagacaaagatccaggaaaggagggctcaggaggagagtttggagaagccagacccctgggcacctctcccaagcccaaggactaagttttctccatttcctttaacggtcctcagcccttctgaaaactttgcctctgaccttggcaggagtccaagcccccaggctacagagaggagctttccaaagctagggtgtggaggacttggtgccctagacggcctcagtccctcccagctgcagtaccagtgccatgtcccagacaggctcgcatcccgggaggggcttggcagggcgctggctgtggggagcccaaccctgcctcctgctccccattgtgccgctctcctggctggtgtggctgcttctgctactgctggcctctctcctgccctcagcccggctggccagccccctcccccgggaggaggagatcgtgtttccagagaagctcaacggcagcgtcctgcctggctcgggcgcccctgccaggctgttgtgccgcttgcaggcctttggggagacgctgctactagagctggagcaggactccggtgtgcaggtcgaggggctgacagtgcagtacctgggccaggcgcctgagctgctgggtggagcagagcctggcacctacctgactggcaccatcaatggagatccggagtcggtggcatctctgcattgggatgggggagccctgttaggcgtgttacaatatcggggggctgaactccacctccagcccctggagggaggcacccctaactctgctgggggacctggggctcacatcctacgccggaagagtcctgccagcggtcaaggtcccatgtgcaacgtcaaggctcctcttggaagccccagccccagaccccgaagagccaaggtaggcatctctggagtctgtgtcctgcggtgtcctcccgccatgtctgtcctactgacccctattcaccctctctccacccacttccacttctggccgttctgcttccctcccttctgcctgcctttcctttctccatgagcctcctttcttggtaaggctcaggcctctccccttcacccttctcctagccagacccaccgagggttctcagaggtgggtcacagactctgggctgggaataactgctccctctccccaccccaccccttcctggccatggcatctcctactgacacagtccccagcagtaaaggtctcctaacagccccttggccttggctcttttctctgctccaaatttgattttcatcccccactcccagctataggagtcaggtttgaggccctagggcttggtgtctggcttctgatgctgcctttaaaatcactgtggcaaactgcaaactagggcaggagtggcaagagagggagggtatcccatacctccttctggtcaatccccttcacacactgtggccggactgcgaggctgcctgaggctccatcctttcctccctcccactcctggtctcccccttcttcccttccctcctccctcctccctctctagctttaatccagaccagacgctccctccacaaccgccacgctgagctctggccctggccctagctgctgactgaatcgttcctccaaccacacagggcagacacgttgcagcccagccctctagccctggtcccataggccccagccacactcaggcctggagaaccccaaagtccctcctgacggcagtccaggctgctttcacctctggggctcccgcagccctgggatgtggcgtccccttctcctccccttcttagaaccagctgctgactcctcagagttaccacaaaagccctgagatttggcgttgggggaagggcccaaccaagacccgccaggagtcaggaatcccgtggggtgtgtggggcccagctgactatgctgagttccagacccaggaagtgagggattggagaatcgaccgacccatgggtctgagaggctatttcaggatcttcctctccctttttctctacagcgctttgcttcactgagtagatttgtggagacactggtggtggcagatgacaagatggccgcattccacggtgcggggctaaagcgctacctgctaacagtgatggcagcagcagccaaggccttcaagcacccaagcatccgcaatcctgtcagcttggtggtgactcggctagtgatcctggggtcaggcgaggaggggccccaagtggggcccagtgctgcccagaccctgcgcagcttctgtgcctggcagcggggcctcaacacccctgaggactcggaccctgaccactttgacacagccattctgtttacccgtcaggtgaggccccagtcagcaccgcaggccatgcactgcacaattctaagaagcgccactacatagactatgatgcaaatgatgttcctggagttgtgtgacatggtgccttgccccagccacactgccatgtgtggctacctaggccctgacagtgctgggtcctcagtgcccaggtccccgggaatctggatctcaacccaatggacccaggtgtcttggctgtctatgcaccttctatgatccctctccacaggacctgtgtggagtctccacttgcgacacgctgggtatggctgatgtgggcaccgtctgtgacccggctcggagctgtgccattgtggaggatgatgggctccagtcagccttcactgctgctcatgaactgggtaaagtaggggtggatgagaaaggtattagggaggagaaggtgggggagggggtagcaagttcaccacagtgttaatgggggtcccaaggtattcttcccccaggcctaggtatagggctattactcctctctgctccaggtgtagacatacatttacatttttctattaaataaattagttggtcgaaactactgtgaactcctctgtgtgtgtgtgtgtgtgtgtgtgtgtgtctgtgtgtgtgtatttggagggggagtcagagacaatgggtggggtcacagttgggaatgttggctataaggaaaagtgggtagggagggaccctgagtatattttggggaagaggagacagagaaagagacggggctacatactgggagccctgagagtaccataaaggaaaggactgggggcagggtgaggtgggtaatggatctgatcatccacagctgcagccagatttattatggagtccctcagggcatggggaagggaccctcagatcctatcagggcctttgctcccacaggtcatgtcttcaacatgctccatgacaactccaagccatgcatcagtttgaatgggcctttgagcacctctcgccatgtcatggcccctgtgatggctcatgtggatcctgaggagccctggtccccctgcagtgcccgcttcatcactgacttcctggacaatggctatggtaagcagatggcacttacctttccctgggtagcactcaattcctgtcctccagggcactctcacttccgctgcattctgcatggaccaaattgcctcccccaagtgtgcttcctctgcagtgtgggaaggggtgagaaatgctgctgtctttgtgtagttctcacttcctcccagaataaatagcatagctagaggaggcgaattttggctcagtagaattagaactgactttctgagggccagaactgtccaccactggaatgggctggctatgaaggaggtgattaccttgtcacgcagtgaggtatgcaagaatagcaggatgactgccactaggcagagatgttgatgagaagcaaactcaaatattctatagttggttagaataggcagaattgagttcctatccttactctgttttgttttgttttgttttgttttaaatacagatgtggtctcactgtgttgcctaggctggtctcgaactcctaggctcaagcaatcctcccacctcagccttccaaagtgctgggattacagacattaagccaccatgcctggcctcttattctgttctttaagcaggtgtagatgtgtgactgtaagttacttcacctctctgtgtttgtagttgatatgtcagataagtataatagcggtacctatctcataggtatttgccatgattaaatagtgctggtcaagcatttagccaatgctcatctcataataagcatccaataaactatagctgcccattaaagcctcttacagggctaggcacagtggcttacacctgtaatcccaatgctttgggaggctaaggtgggaggattgcttgagaccaggagtttgagattagcctggacaacatagcaagaccttatcactacaaaaaattccaaaaaattagctggacatggcacatgcctgtaatcccagctactcaggagcccaaggcaggaagtttgcttgagcccagaagtttgaggctgtagtgagccatgatcatgccactgtactgcagcctgagcgacagagcaagactctgtctcaggaaaaaaaaaaaaaagtaagtaattaaaacaaaaattataaataacaaaaatttaaatcctcttatagtcctaggattgtttttctaggctccatcaggccccagggagcctaagctttctgctggcaatcctgaatgctcccctcagcccgttgctgactttgtgccccaacccccttcccagggcactgtctcttagacaaaccagaggctccattgcatctgcctgtgactttccctggcaaggactatgatgctgaccgccagtgccagctgaccttcgggcccgactcacgccattgtccacagctgccgccgccctgtgctgccctctggtgctctggccacctcaatggccatgccatgtgccagaccaaacactcgccctgggccgatggcacaccctgcgggcccgcacaggcctgcatgggtggtcgctgcctccacatggaccagctccaggacttcaatgtgagatcctagggcaggggtggggtaaagggcccgggggtgtggggactggccttaagcccaggagagagttcacttatgccccacttccgttctgtgcctttgcagattccacaggctggtggctggggtccttggggaccatggggtgactgctctcggacctgtgggggtggtgtccagttctcctcccgagactgcacgaggcctgtcccccggaatggtggcaagtactgtgagggccgccgtacccgcttccgctcctgcaacactgaggactgcccaactggctcaggtgaggagtaggggggatgggagcccttgggaggggacagtagagcaggaaggactgtcccttgagtgcaagaccaagggggtgttgattcccctgctgctgtggggagtgcctttaacctctgggaattgtccttggccgtctgcagggaagagcagagctgtgctgtctagagttctcaggggttgggtggagggatgtggggtgatgtgaggaaggaaggaggggctctgactgttttacccctccagccctgaccttccgcgaggagcagtgtgctgcctacaaccaccgcaccgacctcttcaagagcttcccagggcccatggactgggttcctcgctacacaggcgtggccccccaggaccagtgcaaactcacctgccaggcccgggcactgggctactactatgtgctggagccacgggtgagggtcaggacacccccaggccctgtctatggtcacacacacccgcagtgctccctctgctttctgataacaaagatcacccaaagtaaccctgttcctacagccacgccagcccagtccaggattccactcagacttatctgtacatgggtatcaggaaaacgagccccagactccagatatgtggccaataggtccctctagcctatcctatttcccgtggtttcttttcctctgactccccatcttctaatgctgcatttggtgagaatcgaatgtgtggcctttgggacaagtccttcacccctcttccatgggctcctctgtcaacttatagtggtggtttcattcagctcctggacagccagtccctcaatggacaggcctcctggagatgactgaagtccctacactccctctctgtgatagggtggtgggttgaaggctgcacaaagaaaaacaagccccagcagcattttgctcccttcgccccaacctgagaatttctacaggctggctgccctctagcgtccatttagggacagtgccatcaaggtttagggcttggtgctgggaccagacagactgcacttcccatcttggctcctctgcttgccatttgtgtggcttttggacaggttctttagcttttctaaacctcaacgttccatccctaaaaacctcaaatagtggtggtgagatttacatttgtgtttataaaacacttagcatgctgcctgattcatactcagtgctctgaaaatgctggctagatgttatatgtgataataattattattgttatgattatcacccacatggtggccggcactcacccatctacatcccctacttcatccaacttttccgacaacattgcttccctgatgggacatgggtctcgtttgatttaccaaccccttttgacttaggaggaaccttcagcattgttctttctcttttcctcaggtggtagatgggaccccctgttccccggacagctcctcggtctgtgtccagggccgatgcatccatgctggctgtgatcgcatcattggctccaagaagaagtttgacaagtgcatggtgtgcggaggggacggttctggttgcagcaagcagtcaggctccttcaggaaattcaggttctttcaccatcattcctccctctaccttcctggacattctgggtcctagtgatgcagaggggaactcagcactgtttccactctcaaagagctcacagtctagcgggagatagacgagtaggcagctacagtgcggtttcccatgtattcatccgaagttggaacagggtgttgtgagtgcccttgtgggcatcagggaaggcttccttggaggtgacctctgagctgagtctcagaaggagggtaggaattagacaggtaccaaggaagtggggcttggaagggcaactcaataagggggcagtgggtgtaaaggtccagagataagaggcagtagggcacatgtgcatgtagctctgatccagaccgaacagctcacataggattgggtgacagccatctacacacatgtacacacatacagtcacataagcacagctcagaaggctgaggggattcaggtgatcctgagctccccatctactccttccacacaggtacggatacaacaatgtggtcactatccccgcgggggccacccacattcttgtccggcagcagggaaaccctggccaccggagcatctacttggccctgaagctgccagatggctcctatgccctcaatggtgaatacacgctgatgccctcccccacagatgtggtactgcctggggcagtcagcttgcgctacagcggggccactgcagcctcagagacactgtcaggccatgggccactggcccagcctttgacactgcaagtcctagtggctggcaacccccaggacacacgcctccgatacagcttcttcgtgccccggccgaccccttcaacgccacgccccactccccaggactggctgcaccgaagagcacagattctggagatccttcggcggcgcccctgggcgggcaggaaataacctcactatcccggctgccctttctgggcaccggggcctcggacttagctgggagaaagagagagcttctgttgctgcctcatgctaagactcagtggggaggggctgtgggcgtgagacctgcccctcctctctgccctaatgcgcaggctggccctgccctggtttcctgccctgggaggcagtgatgggttagtggatggaaggggctgacagacagccctccatctaaactgccccctctgccctgcgggtcacaggagggagggggaaggcagggagggcctgggccccagttgtatttatttagtatttattcacttttatttagcaccagggaaggggacaaggactagggtcctggggaacctgacccctgacccctcatagccctcaccctggggctaggaaatccagggtggtggtgataggtataagtggtgtgtgtatgcgtgtgtgtgtgtgtgaaaatgtgtgtgtgcttatgtatgaggtacaacctgttctgctttcctcttcctgaattttattttttgggaaaagaaaagtcaagggtagggtgggccttcagggagtgagggattatctttttttttttttctttctttctttcttttttttttttgagacagaatctcgctctgtcgcccaggctggagtgcaatggcacaatctcggctcactgcatcctccgcctcccgggttcaagtgattctcatgcctcagcctcctgagtagctgggattacaggctcctgccaccacgcccggctaatttttgttttgttttgtttggagacagagtctcgctattgtcaccagggctggaatgatttcagctcactgcaaccttcgccacctgggttccagcaattctcctgcctcagcctcccgagtagctgagattataggcacctaccaccacgcccggctaatttttgtatttttagtagagacggggtttcaccatgttggccaggctggtctcgaactcctgaccttaggtgatccactcgccttcatctcccaaagtgctgggattacaggcgtgagccaccgtgcctggccacgcccaactaatttttgtatttttagtagagacagggtttcaccatgttggccaggctgctcttgaactcctgacctcaggtaatcgacctgcctcggcctcccaaagtgctgggattacaggtgtgagccaccacgcccggtacatattttttaaattgaattctactatttatgtgatccttttggagtcagacagatgtggttgcatcctaactccatgtctctgagcattagatttctcatttgccaataataatacctcccttagaagtttgttgtgaggattaaataatgtaaataaagaactagcataacactcagcatctagtaagtgctcaacaaatagcagctgctgttacttactgttatcaaatttctgtccacatccactctccatatgcacttgaaggtggcaaagatccacaaccatggtgcctgcctttatcctcagggtccgttcctttggttggcagacccctatcctgggttctgagggaccaacagagaaaggaaaattccatccctcacctctggaagttcccaatcacaggaaggaaacatagtaagcacgtggctacaaatacaattgacaagaacatgaaggtgcaggataacaagaacaaataacaagaacaactgcatcaacacaaatgagtgcttagtaataagggtgatagttgaggggtctgggtttcacaaaagtagaaagagcactggagtgggagccagcgggtctggattcaatttggggctcggcgtcttattagctgggtggtgttgggtaagtcactgatgctgagccttagattgctcatatgggactaacagtatctactcccacagagttgttctgggaacaaatgctagaatattttcaaaatagtaaaggttatagtcatggccatgtgagaggttacccctatgactacctgaagatggaacggagtatccagaatcctgccagtgtaaacccagcagaatgcctagaagatgtgagattagaataaaatttcataaaacaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgatgcctgaggagagggaggg

SEQ ID NO: 851 - DNA, 7065 bp, Human
agagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactcagtcccctgtcgtcattagcgcttgagcccaggtgtgcagatgaggcggtgggtctggccacgctgtccccaccccaaggctgcagcacttcccgtaaaccacctgcagtgcccgccgccttcccgaggctctgtgccagctagtctgggaagttcctctcccgctctaaccacagcccgaggggggctcccctcccccgacctgcaccggagatctcaggcacccggctcaactcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgttttaattgtgagagtatctgatattcttgactgaacaatgtaaaaaacccaaagggggctgcgcacggcggctctcgcctaaatcccagcactttgggaggccgaggtgggcagatcacctgaggtcgggagttcgacaccagcctgaccaacatagagaaaccccgtctctactaaaaatacaaaattagccgggcgtggtggttcatgcctgtaatcccagctactcgggaggcttaggtaggagaatcacttgaacccgggaggcggaggttgtggtgggccaagattgtgccaccgcactccagcctgggtaacaaaagcgaaactccatctcaaaaaaagaaacgcaaacggtgcagctgcccctttttcgaggcacgtccacctcccattacccacttccttttttttttgagactgagtcttgctctgtcccctgggctgtagtggagtggctccatctcggctcactgcagccactcccaacgccctccactcctccctactccgcgctggccggggcggggttccgctggtcgcatccaataataagaacaggcggcgcgcgcccttcccggaaactcccgcctggccaccataaaagcgccggccctccgcttccccgcgagacgaaacttcccgtcccggcggctctggcacccaggtactggggaccccagacccacgcggtgcaggccgggagcgagagcctccgtgggggctccgtgaccccggaggggtagagccaagagctgggggagcctgagagatgagggtcgggcggggagggaggcggaggcggaggcggggttccgcggagctgagaaccggacggggtgggatcgaggagggtgcgaagcgccactgtttaggtttcgctttcccgggagcctgacccgcccctgacgtcgcctttcccgtctccgcagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggtggggaccccagccccgccccgccccgggtgggagagcccgcctaggaccccgcgggcccggcacacgtgttctgtccccctcttcaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgaggtgagcgacgccggctgccaagggcgttggcattcgtcctgcttgggcaaaggggaacattctctgggtcagatttgtggttttagaagctgttctgggagaggctgccagcaggcccaggacaggtggagagccacatccccacctcctcaggccacagcctaagggttcacagccaggaagctggtgggggctacaccaggctctccttgtatctctcactctggtgtcggggcctaacgcctgccccattctctctcagaaggcccaggcacggaccagactgaggcagaggcccccgcagctgtcccaccaccacaggtacccttctctctgcctgcctctcctcctgccaggccgcggagctgcttacgttcaccctgacttttccctgcagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggtgtgggcgtgcccggggagggggggagcgcgggaggggccagtgcacctggacggacactttagaagggggctggggattggggagctggagaattaggaggggaccaccgttcccactgtcctcccctcctcaggcccagggctccctgctggggagctgtacgggtgggcagtagagacgacccccagccccgggccccagcccgcggcactaacgacaggtgagaggggtaggggttgggaggcctggggcacagggagaggctagggatgaggtgccagcacaggattcccttccggatgcaggcgaggccgcggccccagagtccccgcaccaggcagagccgtacctgtcaccctccccaagcgcctgcaccgcggtgcaaggtgagtgcatcccaggaaggggcagcctgtccccgcccacccccgtcactcacggcttgtccccgcccacccatcactcacatcctgtccccgcccacccccgtcactcacatcctgtccccgcccacccccgtcactcacagcctgtccccgcccacccccgtcactcacagcttggtctccacacagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggccccccaggctccgccagcccctccaccccagcctgcctgctgcctcggaactgtgacacccccatcttcgacttcagagtcttcttccgaggtcagtgaggcccctgcctggggggctgtctccaggggtcgttgggagcacctgcctgccaggtactcagcagagtccccttcttcagagctggtggaattccgggcacggcagcgccgtggctccccacgctataccatctacctgggcttcgggcaggacctgtcagctgggaggcccaaggagaagagcctggtcctggtgaaggtgagaccagagcctcaaggaggggaggccatgtgctcaggcccactgacagacgcctgatgccctcagagcctcggagagggggaggggaggccatacaccgggtcactgacagacgcccgacgccctcagagcctggggagggggaggggaggacacacgccgggtcactgacaagacgcccgatccctcctggcagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacacgtactggcatcttggctggtggggaattgggtccaggctgaacacgggtgaggcccagggagggaggggacctccacggcctccctgcacaccaactcacttctgtcttcaccacacacatcacagccaagctttgactcaaagaacaagacccttgacaggccagtggccgccaaagccactcccaccagctgtgccaagggcagggacagcatttccccatgcaggacacctgtcgccagccctcaggctgccactgctgcaccctgcctccaggaggcaacggtgttgagtgcaaactcgagcaattatttacaagagcacaacataattggaaaagagaaagtaaagatattcctaattcagagccaaaggtacacagcagctgttggcgggaggccacctagagatttatcaaggacgcgccaccccaccaggagcccctcttgatcaccaagtgctttatcttccaagtagtaagtcaatcaagaggtttctaaagataatccatttttgataaattagaatggaaacagtgtctctataatatacatacaaaagtgtccagttttcaactgtgagcaacacaggtgcacagaccaggtgtcagcgcaggaacccgacggcaggcatgctgatgccccccatttcccgccactcccgacagctccccgggcatggccccgattcccgccactcccgacagctccccgggcatggccccgattcccgccactcccgacagctccccgggcatagcccgtgattgcctggcctcagccctcggccccctgcgtgggcggctcctccccggcctctggtttcttgtgcctgcgcatgtgcctgtacttgtccacgtacgccttcaccaggttggccaccttcacggggttgatctctccactcttgctgtggcagatctggagaaagaggtgcaatcaccaaatgccctttcacatccagatgttccgggccagagcccagggccaaagctgggctccctcgcctgccctgctcaggagcaggccctaggtgcagcacgcagacagacggcggcagaggccgccccacctatgtgagacccccgtcctgttcgctatgccgctcacaaggccactgagggtcccacggtgtcggtgggcggggggagcatgggctgagacgtcaccaggcaactgctcacctctgggggtcgttctcccacctgtaagctgggcgtgggctgggtagttttaaattacccagggtgcactgaggcaccctccttcctaagcatctgccaggggcagccacaggcgaacaggcttgaccccaggcctacaggatgtggcaatacagccccctgacccctaacctggctggctgacctcgggcctgcactcatggccaccccaaagtccatgctgacgagacagcagcgacgtaccgcccgtgaccccgagccccacacacaggctcgcacacagcccaccttctgcacggccttgcgcaggatgtccttgtactcctccttggtcacctccctcttctggtagaagggcttgatggccagcttcacctcctccacagcacgctcctgcatgtgcagcttcttcatgtactagaggggacatgtgtgtgatgcggccaggaagggagccgggagtccctctggccagaggcactgtggttctggacacccttgcagttccagaggcacagcgaccagcttccgcccataaactcagccccaacaactttagtttcaaagtaagatgggaacatggggaaagtgggaggaggcaggactcacctcctccttcttggttttctccgcagctagcctgggggccggggtcttctcctccgagttgctggctgcagtggcttgactggctggctctgaggctggggtcagggcagcgggcactggggccagggtctgtgctgccccacagcccactagcggcaggctcccctgaag

SEQ ID NO: 852 - DNA, 7065 bp, Human; identical to SEQ ID NO: 851

SEQ ID NO: 853 - DNA, 7065 bp, Human; identical to SEQ ID NO: 851

SEQ ID NO: 854 - DNA, 7100 bp, Human
cgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactcagtcccctgtcgtcattagcgcttgagcccaggtgtgcagatgaggcggtgggtctggccacgctgtccccaccccaaggctgcagcacttcccgtaaaccacctgcagtgcccgccgccttcccgaggctctgtgccagctagtctgggaagttcctctcccgctctaaccacagcccgaggggggctcccctcccccgacctgcaccggagatctcaggcacccggctcaactcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgttttaattgtgagagtatctgatattcttgactgaacaatgtaaaaaacccaaagggggctgcgcacggcggctctcgcctaaatcccagcactttgggaggccgaggtgggcagatcacctgaggtcgggagttcgacaccagcctgaccaacatagagaaaccccgtctctactaaaaatacaaaattagccgggcgtggtggttcatgcctgtaatcccagctactcgggaggcttaggtaggagaatcacttgaacccgggaggcggaggttgtggtgggccaagattgtgccaccgcactccagcctgggtaacaaaagcgaaactccatctcaaaaaaagaaacgcaaacggtgcagctgcccctttttcgaggcacgtccacctcccattacccacttccttttttttttgagactgagtcttgctctgtcccctgggctgtagtggagtggctccatctcggctcactgcagccactcccaacgccctccactcctccctactccgcgctggccggggcggggttccgctggtcgcatccaataataagaacaggcggcgcgcgcccttcccggaaactcccgcctggccaccataaaagcgccggccctccgcttccccgcgagacgaaacttcccgtcccggcggctctggcacccaggtactggggaccccagacccacgcggtgcaggccgggagcgagagcctccgtgggggctccgtgaccccggaggggtagagccaagagctgggggagcctgagagatgagggtcgggcggggagggaggcggaggcggaggcggggttccgcggagctgagaaccggacggggtgggatcgaggagggtgcgaagcgccactgtttaggtttcgctttcccgggagcctgacccgcccctgacgtcgcctttcccgtctccgcagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggtggggaccccagccccgccccgccccgggtgggagagcccgcctaggaccccgcgggcccggcacacgtgttctgtccccctcttcaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgaggtgagcgacgccggctgccaagggcgttggcattcgtcctgcttgggcaaaggggaacattctctgggtcagatttgtggttttagaagctgttctgggagaggctgccagcaggcccaggacaggtggagagccacatccccacctcctcaggccacagcctaagggttcacagccaggaagctggtgggggctacaccaggctctccttgtatctctcactctggtgtcggggcctaacgcctgccccattctctctcagaaggcccaggcacggaccagactgaggcagaggcccccgcagctgtcccaccaccacaggtacccttctctctgcctgcctctcctcctgccaggccgcggagctgcttacgttcaccctgacttttccctgcagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggtgtgggcgtgcccggggagggggggagcgcgggaggggccagtgcacctggacggacactttagaagggggctggggattggggagctggagaattaggaggggaccaccgttcccactgtcctcccctcctcaggcccagggctccctgctggggagctgtacgggtgggcagtagagacgacccccagccccgggccccagcccgcggcactaacgacaggtgagaggggtaggggttgggaggcctggggcacagggagaggctagggatgaggtgccagcacaggattcccttccggatgcaggcgaggccgcggccccagagtccccgcaccaggcagagccgtacctgtcaccctccccaagcgcctgcaccgcggtgcaaggtgagtgcatcccaggaaggggcagcctgtccccgcccacccccgtcactcacggcttgtccccgcccacccatcactcacatcctgtccccgcccacccccgtcactcacatcctgtccccgcccacccccgtcactcacagcctgtccccgcccacccccgtcactcacagcttggtctccacacagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggccccccaggctccgccagcccctccaccccagcctgcctgctgcctcggaactgtgacacccccatcttcgacttcagagtcttcttccgaggtcagtgaggcccctgcctggggggctgtctccaggggtcgttgggagcacctgcctgccaggtactcagcagagtccccttcttcagagctggtggaattccgggcacggcagcgccgtggctccccacgctataccatctacctgggcttcgggcaggacctgtcagctgggaggcccaaggagaagagcctggtcctggtgaaggtgagaccagagcctcaaggaggggaggccatgtgctcaggcccactgacagacgcctgatgccctcagagcctcggagagggggaggggaggccatacaccgggtcactgacagacgcccgacgccctcagagcctggggagggggaggggaggacacacgccgggtcactgacaagacgcccgatccctcctggcagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaacacgtactggcatcttggctggtggggaattgggtccaggctgaacacgggtgaggcccagggagggaggggacctccacggcctccctgcacaccaactcacttctgtcttcaccacacacatcacagccaagctttgactcaaagaacaagacccttgacaggccagtggccgccaaagccactcccaccagctgtgccaagggcagggacagcatttccccatgcaggacacctgtcgccagccctcaggctgccactgctgcaccctgcctccaggaggcaacggtgttgagtgcaaactcgagcaattatttacaagagcacaacataattggaaaagagaaagtaaagatattcctaattcagagccaaaggtacacagcagctgttggcgggaggccacctagagatttatcaaggacgcgccaccccaccaggagcccctcttgatcaccaagtgctttatcttccaagtagtaagtcaatcaagaggtttctaaagataatccatttttgataaattagaatggaaacagtgtctctataatatacatacaaaagtgtccagttttcaactgtgagcaacacaggtgcacagaccaggtgtcagcgcaggaacccgacggcaggcatgctgatgccccccatttcccgccactcccgacagctccccgggcatggccccgattcccgccactcccgacagctccccgggcatggccccgattcccgccactcccgacagctccccgggcatagcccgtgattgcctggcctcagccctcggccccctgcgtgggcggctcctccccggcctctggtttcttgtgcctgcgcatgtgcctgtacttgtccacgtacgccttcaccaggttggccaccttcacggggttgatctctccactcttgctgtggcagatctggagaaagaggtgcaatcaccaaatgccctttcacatccagatgttccgggccagagcccagggccaaagctgggctccctcgcctgccctgctcaggagcaggccctaggtgcagcacgcagacagacggcggcagaggccgccccacctatgtgagacccccgtcctgttcgctatgccgctcacaaggccactgagggtcccacggtgtcggtgggcggggggagcatgggctgagacgtcaccaggcaactgctcacctctgggggtcgttctcccacctgtaagctgggcgtgggctgggtagttttaaattacccagggtgcactgaggcaccctccttcctaagcatctgccaggggcagccacaggcgaacaggcttgaccccaggcctacaggatgtggcaatacagccccctgacccctaacctggctggctgacctcgggcctgcactcatggccaccccaaagtccatgctgacgagacagcagcgacgtaccgcccgtgaccccgagccccacacacaggctcgcacacagcccaccttctgcacggccttgcgcaggatgtccttgtactcctccttggtcacctccctcttctggtagaagggcttgatggccagcttcacctcctccacagcacgctcctgcatgtgcagcttcttcatgtactagaggggacatgtgtgtgatgcggccaggaagggagccgggagtccctctggccagaggcactgtggttctggacacccttgcagttccagaggcacagcgaccagcttccgcccataaactcagccccaacaactttagtttcaaagtaagatgggaacatggggaaagtgggaggaggcaggactcacctcctccttcttggttttctccgcagctagcctgggggccggggtcttctcctccgagttgctggctgcagtggcttgactggctggctctgaggctggggtcagggcagcgggcactggggccagggtctgtgctgccccacagcccactagcggcaggctcccctgaaggatgaactggaccgtgggctggctgaccagtg

SEQ ID NO: 855 - DNA, 7100 bp, Human; identical to SEQ ID NO: 854

SEQ ID NO: 856 - DNA, 7100 bp, Human; identical to SEQ ID NO: 854
